United States Patent 7,504,493 (CHARACTERIZATION OF THE YEAST TRANSCRIPTOME) - sequence listing, part 3

SEQ ID NO: 12210 - DNA, 1090936 bp, Saccharomyces cerevisiae
ccacacccacacacaccacacccacacccacacactaccctaacactaccctaaccctattctaacccagatcaaccttctcacaacttaccctccattaccctacctccccactcgttaccctgttccattccattctacaactccaaccaccatccatctctctacttactactaccatccaccgcccatcataaccgttaccctccaattaccatatccaactccactaccattaccctactattaccctaccatccaccatgtcctactcactgtactgttgttctaccctccatattgaaacgttaacaaataatcgtaaataatacacatacacttaccctaccactctaatcccactaccacatgccatagccatcctcacttgtattctgatcggtcatacgcacacggatgctacagtatataccactctcaaacttaccctactctcacactccaatccatggcccatctctctcactaaatcagtactaaatgcacccacatcattattcacggcacttgcctcagcggtctataccctgtgccatttacccataaagcccatcattatccacattttaatatttatatcttattcggcggccccaaatattgtataactgctcttaatgcatacgttataccacttttacgccatatacttaccacttaatttatatacacttatgtcaatattacagaaaaatcaccactaaaatcacctaaacataaaaatattttacctttcaactttacgaaataaacactttgacttgaagtatgagcactaccatgacgtcattaatgtaaaagttccttaatattgctattttcttgaacggatgacatttcatgttgaatgtggtaacccaatagcatgatatgagtaatgtttagacaaagaaaacatatagtagtaaacgtttaatccggtagtacttaagaaaccatagtttctatgtgcaaaaacagtacctaggtaattattacatttacataacatatagaaaggtccaataaacttactacattatgatatataaactagatcgtaattcataacgtcaacacccaaaagcatgatacgagtaatgtttagtattttttcagtattgtttcaataatgcggtacagaggaatagcatacagtaacaaaatcttcaatcaacttgcaaccaaaaaaccctcagtttatatgtacaaaatagtaattccatgtatcttcctttttggtgagatcaaagttttcaatagttgaacctaaaacaaaattccacgatatgaggagactatcacccttcctagagataaaattttaattagcccgtctactttctcaaaaattacagaggaattttctgaagctattaatagaagtaagcagctaaaggcttaatatgaaaaaacatacagcccgagcctgtactaaatgtaacgtaaaattttgcctacgatcttgttatatgccatgaaaagtttcttttgatgatgacaattgttttaagctagcttttttcggtaatactacgaaaattctaaaatgatcagtgtggataccgaactataaatagggatgaatggagtgaacttcaagtactgatgcatttgctaataactagttgctcacatttaaagttctttgtcgtttacaggcaactgtttaccaacgctggacagataaacatctagaagtcaatgtttggccagtaatgcttttctagttttttttccagtaattatgatggcattacgtataaacggagagtgatgacgttttaaaagtcatttgatcatacgcagtttttcacttcgaaatttatagcgctaattctctcctataggggcatatatgaagacagttagactgaacaaaagaatttaaatcttgcgtatgtaggtctttagagtttcacagttgatgtttatcgctgcaaatttatataaatcatcatactgatactgctataatatttccttgttcaatattaagtgatggctttaagatagtcgttttttacagagctttaggcaagaatctgagtttgagcgttacaaaggtggttgcttcaggcatgtgcctgggaaatgaacctaattgtatctttatatttttaaatagttatgaggagtgagatgcattattatatttattatagagtgaatattgaggactgcctcggatttaacgcaccgcaagcgtatattctactatttaattatacccacttttgtaatataattattaatacaatatgtttttattaaagagagtgcagagaatcgaaaacctaaagagtagatttgaaatctaatagtttcaccttaaaacacatctccttttaaaacttattgtaattattcattagaatttttatatttaattaatctatcctttttactaatgaaaaattctttaaataaaaaaatctatacatccactagaaagtatatataaatttggggtacctgcaatctttatttattttatttgaagtaataggaattatttatattattgtgataagaagtagtattctattattataactatattaataaaaaattttattttctattgaaaaccaattttttacaccaaatatcagacacgctttgtctatttctatcatatagcgactgtgatataatgcgcgcgtgttttgaacggcatttttttagcctgcgaatatggatagatgatggttttaggaaacatatgaacgaactaccaggacgtaataactgcaaaataatgtctcctgaactacatcgccataggcatggatggagccaaatttgaaaatactgtagcttttttaccatctgaaatatttgattgctacaattccacgctacccaagaatgtattccgaagttttgttacctggtcctgctatgagaaattcaattccttagaattccgcacttggctattaatgtggttaccactcattattgcgtggaaaatacgtggtaaaagacactatctcgttatcgttactgctcttatgtttgaagtgctgtatttcttatggacatattcgtacatattccgagaacgcaccttaggaaagcaagtttctcaatttgctaaagagatcattacaaatactccgggtatagacactgaagactgggaacgtgttgcagtaaatttcaattcttatttatatgaaaataaactttggaatactgagtactttttttttgatggttccagctgccaagaagcgttcagaaagatgcttcttgagccattttccttgaaaaaaaatgactttgctaatgccaaggtacctgacggatctgtttgttacactgaaaaagctttgcaggtttattttacacagatagagagaaaatggcactggattaattctgaaggatttttacacaataaaaccacacagagtgttcaattttcgaaacatggttacggttccaaacttctctgggctttcaaggaagtgacaataatgaattcacgctttgcgttcttcagtattgcttacttaaacggtctccttactataccaagactaagaaattcactgcatatcctctatgtatgtgcagttctttcatctatgataattgaatatttaatagggatcgacaaattcaggttcaaatcaatgaatctgatacataaactacagttcttgtcatatattacatgtggacacgagaagtctgatgcaactaattggtctcaaattgcgaagaggacgaatacttacatgtttgagcagaaaatttggaattcgccaatactgttctcagatggtattgattgtgaaaagttttttaaatggtatttcagtacccctgtatcttcgcaagcgtctttgtcagttggttccactgattttgaactctggccatatataaaagaagcacaatcagcttgcaatgatgtgtaattggtaaagatattgatatactattcttaaagaccaaaaaaaagctgttaataacccaagtttaaacattagtagataatgcaatatttgatgaagtctgtagagtgccactatacatcgtaataaaattacacagtacgtgcttgtacggtcgccatatcatgagattacttgaagcttccttgaagctcataccgtaaccagttttatacgtttttctttcctcataccaacatcctttaacgtttgttgagagaaaatgcggtagtttttgtaaaacaccttacgtgaaagatattattactatttcaagaccaaacgcgtaacgaatgtatattctagtactgcgttaaggtatgagttacccataataaattttattactattaacattttcttggagtacttcgttttcttacttgatgtacgttgctatacagtacgcattaaagaaattgcagctatcgtcgtgtttggttcatacggttgagttaatatttcaaaataatgtccgtaataattattaccgacatctgtctgccttttattaacatatctcgcgttcaacctgtgcgttgcttatcgcttgagtaggggcgaaacacctgttgaaatcttacggtgaactttcactatttaaaggactgcttttctccaagagtttttattatacagaaatatcgtagcagtatcccagcgggagatagatccttttcagaaattaacgttcatgactggtcaagagaaaataggcgctaagcgttttcagatctgctggagagtttggagacgcaatatactgctattcatctttgtatttgctgtttccttttattattttcgttcaagagatgcagaagctatagttaatactacggtaattgcctcacctgtggtgactagttatctaatgaaaggcaaaactactattgggcgttagcaggtggtgccagtggattttcaattacgctagcaggactctccggtgcatacgccgctaacaaatgtacagcagattcaggtagtactcatgctggactggagctgtagttacattggtagcagatgctttagatggagttgctaccactgctgatacgattgctggggcagcggctttgacggcagcagcggcaaaaaagatctactggatatattgctactattgctggattagacttccattcttcaagtcctcgtaatttcactgcaatcaacaccaccatgcaaacagttggtcttgtattatcaggagcatttgactatatgaacacatagaaggctaatggcttagaaaagagagaacaaaataacacagttacagaaatgcagcatgtttgatattttagtagtcagttgggtcttcatgtgccactcacatgcgtaataatgtgactgaattggtcaacagtataataggtgttcaaacacctggatcgctaccagatactctttctggggcacattcattgcagagacgcataagctattttgacgtcaattggatatcatggaattgggacaatgtaaatgttgatcttaataaagaggtaaaaaaaagtaggcccctccttggggaggaggacgatcaatgcatgttcggttggttcgcaaataatccagggtggaaatattactggtcggtaactgataatcctgatccaggatataaagagaattactctgacattggagatgaaaatgctgtccacggtgaattatattttaacacatatggggggttgatggcttctgtaatgacaacaaagatggtgctcaatgcgaagagacagcttgtggttattgatacaattgtggtaaaggccatctgcgattatgttatgaaatattggaaaaaaaaggttaaccttactacgatatcattatatttgatgttaaagttataaagccagacattttcaatctttctttaaatcaatgaaagaagatgcgcaaatattgaaagcattgactactaagacttaggaaaaagcttctgttgacgatttataatgttatatcaaataattaaatttatttcctagatttttgaattgtgagagacatccctagcatgattttttttcacatatactttcaattttaatagaaatggagccgtcaaatttaacttattttctatttttataattgaaaattttatttattcatctattctacattttattttggtgttgggatttttttccggcttaaatatatggtcagatcttttatttatattacacttatctacaatttgtatttatatcatcaaaaagagctttttatttctatattttatttttcgttacttaccaatgtctatagaatttcgttcgtaaaggcgtttgtctctagtttgcgatagtgtagataccgtccttggatagagcactggagatggctggctttaatctgctggagtaccatggaacaccggtgatcattctggtcacttggtctggggcaataccagtcaacatggtggtgaagtcaccgtagttgaaaacggcttcagcaacttcaactgggtaggtttccgttgggtgggcggcttggaacatgtagtattgagccaagtgagctctgatatcagagacgtagacacctaattcaaccaaattgactctttcgtcagactgagctagagtggtggttgcggaagcagtagcagcgatggcagcgacaccagcggcgattgaagttaatttgaccattgtatttgttttgttttttagtgctggtataagcttaacaggaaagaaagaaataaagatatattctcaaaagcatacagttgaagcagctctatttatacccgttcctctatcagtcatcactacttaaacgattcgttaacagatgctcatttagcacctcacatatcctccatatctcatctttcacacaatctcattatcactatggagatgctcttgtttctgaacgaatcatacatctttcatagacttcgtatgtggagtattgtattatggcactcatgtgtattcgtatgcgcagaatgtgggaatgccaattatagggtgccgaggtgccttataaaacccttttctgtgcctgtgacatttcctttttcggtcaaaaagaatatccgaattttagatttggaccctcgtacagaagcttattgttaaagcccatactcagtctgttctaaacggcttccatgcaagaaatatttctatctcttgaattcgtacaacattaaacgtgtgttgggagtcgtatactgttggcgtctgcaaatttgtgaattctccgcgaatgccttggtgcaattacgtaattgtagccgctgaaggcggatggttttgagagaagttgatgttcaaagaatcgtgtatgataaaaaaaaaaaattgtaaccaattcgtaaatactgaaactctttgcagtaagaaatctttcattcccagagagaacgcggaaatattcagcctaagtctctccaaattgatttctttcattttggtagcgaaagacttagtatcaacctcaaaaagctgaaatttttgtagatatatgtgcagatgacatgaagtatccagctcttttgtgaatatggaagcaagtttctttcaaattattatcgacttttcctctgccccttttaccttataactttaggaaacactaccctattcatactcaactaaaaaagtagtacgttttcttctttgagaggtatggtgcaaaccagtgcaatctgattccagattgccctcacgtgaggcttcagtaaatctcgatccctctacatattatattatctcctacttggcaaaatagatgtggctttagttgatgaaaatttaccacgtcaactatttatgtcctttctacaataaaccccgacctactatcctctatgttgtttttaacataccatacgagcgtcatatgtcttttggttcactggggaagaccatcactgttgaacgtttgttgaaaagttcgagatgatgaagattgcataacaaaatgtaaagttatatttagaaactataacggttcaagacattcaacactataacatagcttggctggcttgaacaaaaagaggaagaagcaaaagcaagagtaaaaagcttctcatatatttctggcattgttgatcacccagtgcaagcccaatttcgcctgtgcttttcttaaattgtttctgacaacaccgaggttttcgctgcagaaaaggacatatggtggtaatttgtataaggggttaagggtccaaaaatttgctaccctatcgctcactatagcaaaatatctcgagagatatccgaggagttaaaactgactagacctgttgcgtaaacctcatgcaagcagtactcttcgaggatttaagctttggaactgctttcaaagttgagagtatataaggtgttatgatcttggaataaggtttttcatcgttcttccttgttctctattttcattggttgatcagttgttaaattttgtctctttcgaaaataaggatatttgaagacaacgcaacgctatcaatatgcaattgttttccatcctctctttgttgtcatcattgatgtgttcattgaccgttttagggtcttccgcaagttcctatgttaagtttcctgttcaaaagtttgctgatattataaatataggcacacaggatgtttctaccgtcttcaaaagaaatgaggttcttaacaccacagtgataaatggaataggagtgtatgttgtcaagatggaaatcggaacgcctccacaaacggtgtacctacagttagatactggctcttcagatatgattgtgaataatgctgacattgcctattgcaaatcgatgtctgacggatctgactacgcttcaactgataattacgaactcacggcaacattcactgggcctcgttctactaccacctcaccagagcttataacactgtccgctcttataggggtaaattcaatgcaagaaactcatctacttttaagaataacgcgactttcttcaatgacatatacgtattagaaggaacctatggtacggacgttgtctctttaaagaatttttcaccttaaataatatcattgttggcctattaaattataaaatgggcaatccaagtggcattttaggcatatcccttccccttgcagaatttacagataatgttgaaaatgcatttgctttgaacagaaaactcttcgtatatgagaattctaatggcatttgaaagacaaggaaagatcgaaaagaagatatcgtattccttatttttgaatggacctaatgtacactttgggagcatcttattcggtgcagtcgataaaagtaagtacgcagaagagctctgcacacatcctatgcgtcaagcttataatacccttgattcaaactcaagaataattatcacagtacagagtgttgcaattttggacggcaaacttgtatggtaaaagtgttgtagatattcagtttccagtgccattaaattccggtacatattctgtttacctacaaaatttgtaaattggattattaagagttttaatgagaaatataactctgatgatcaaggctacacttttgactgctcaaaagtcaggatactttactgtgtgtcgactttgaatgacttaatatattgagtttatctccgatagtgtcccagcgccaccccttgctccaggatactccagtatgtcggtatataagtctgatagctccatcgggacaggagattttattaatgtcagctgaacctcgtatttagaattttcacagtacacatcattgcttgtcactggaatgcaaggcgatggtgttagttctttcccaagtgggggcagttctagcaaaatggcccctaaaaaaaaaaaggttgcatatatcgttcttctttttcctattcattgctgtgcttcacatcttattttctttcataattaaagaagagccatatagtttcgcattgtactactgtgtaagacagcaagttttttgatagacaacaagaggagctatagtggtaatacgagttatactcataggtcctatctcctattcgtatttattacattgtactctgcggcttcatatacaaataataaacttataaggaaggattatacatttttggaaatattatcgctacgatagataatgtgatgagttttacaagtgtaaaattcttccgtagagtttgagggcaatcgcaaaatttccggagagtccttgataaattattacagtgaaaacgtatatgaaatgttccaattgagatatctcgcttatattaatacttcttctttcttttaccatatattttctaattggccgctcagctatagcgatctttacatgtatactttgaagtttttttaaacagtgcacccgtgcatcatacctcatgcaaggtacctttttttctcaaaggtattgtcttctattgaagtggcactatggcatgatgaaccctgagcatttccgaattcaacagaaccaaattgtccagaattaaatctgtccgtcatgaaataagcaactttttttcaatcaagtgaagtgagttttgcagtatcttaccattattttgacctattggccgcatgtttgtgctttgacttcgagaaccatgttaaagcttacttgtacgacaaccaatgaagtacattacggcagttttttggactgggtcaaaaaaagtgttgcataatcaaatcaggaacacattaaaatgttataaaatttgtcttagtatgacctgagtggttattcattacgtactactgtcaaaatattcggatctttcctaaacgggcttttgaattagtgttgcttctattcctggaatggaaggtagtaatttcatgcattctcgcttttcggacttttaacaataaattaaaaacaatgatactttcatcaactacctatacaccctgcgggtcaattattttttttttcgaataaccgctgaggttggaaatatagaaacatattccagatctgtattttcagttgctagaaaaaggttaatattatcattaaggttttcagcatataacaggtataattgatatataagcatcgtaattttcattcaaaatggagagctactgcttctgatagattgtacaatctcaagaaatcaagaacaacaaccataccatgagtttcctaagcatttttacttttttcagcgtccttatttctgttgcaacaaccgtcagatttgatttgactaacgttacctgtaagggcctacatggacctcattgtggtacctacgttatggaagtcgttggtcaaaacggtacatttttgggtcaatctacgtttgttggcgccgacgtcttgactgaaagcgctggtgatgcttgggcaagatatttgggccaggaaacaagattcctcccaaagttgactactattgctagtaacgagacaaagaacttttctccactcatcttcaccaccaatatcaacacttgtaaccctcaatccattggtgacgctatggttccttttgctaacactgttactggtgaaattgaatataactcttgggcagacactgctgataacgcttccttcataaccggtttagctaaccaattgttcaactctaccgattatggcgttcaagttgcttcctgttacccaaattttgcttctgttatcttaagcaccccagctgtgaatattttcggtaaggatgacacattaccagattattgtaccgccattcagctaaaggccgtttgtccaccagaagctggttttgattaatcttttctcacatcctcacttatagatatgttttgattattttcgttatagacaaaaatcttttgagaaagccatgcggaagttatttttaactgtaaagtacaatcgatttcctttaggcatttctactttcttctgaccctgatttaaaattttcgagttctttttgttacgatgcgttatttattgtcgatttattacatataattctttataatataaaagtgcaatacagtgcatctagatatggattttcaaaattttgcagaatatgatcggtttgcctacaagataaaagtaaattattcacaatttccaacatttaaaagtggcgatcgcatagtaaaagcgttaagaatgatgctacatcccacatgagagtggttcgattatgctgaatttcaacaccaattcaatatactttaatttaaacagacatttatgatgccagagacataaaggatccgaaaggttttaggaacaccttagtggaaaatcattttagcgtggccgggagtaccagatttttcatagttccctattgcaatcaatttggatttttgctggcgttgcatcatggctatgttatccaatgcatgccaagagtgatttacttaaagagtaacttcgttacaaaacattacgttatacttcagtgcgataatttttcagatatcaaaaattatactacattatacaacaaaagcgtgtaggtttacctattgcttataagactagaacaactcttggtcaaatatctttattccatatgtcgactatttgtgaaagccggagcttttcgtcttctttaaatttgatcaactttccaaactcaccttccttgaataatgtgcaataattgaacaaaaaacactctcctgagttaatccatcctgatatactagtatctggtattataatcccttcaagttttactggtgatgcataatattcacgtaattcatctgcattttggaacatatcatttagtctctgtctatgctcataatcgtattcccatgaagtttttttacaaatattaaggcccccgtttagccatagcaaggacccgtccctgtctgtatgagatagttgcacagaacaaatctggtaaaactcaccggtactctcttttgaaactacattgcccaactgaccaatgtttgatgcatccacaggatggaacgtaaagcgattgttcgaaagtaattcgcccagccaaaaaaagtccttatcaccatgaaaatattctgcaattggagaaaattgtaaagctattgaagtaagcatactgaagagatgctttcctttatgcaatattaccaggccgctttccaaatgatgtttatatttctttataaacatgttttccagaacctgtgcaaccactggatcctctacttgctcatgtatcttggattcatcctctaaatcaagcccaatacacccatagacaatttcccttagaatttttaattcagaggattcaaatagatcatctgatattacccgatctttaaagaatagaactccagtcttttgaaattcctctaattcataaaatttttctattgaaacaaagggcactgtatctgagtccattagaataggaatttcaaaggatgagaaggtcaatgctaaccacttgttggaataggtggtaaattttttcgaatatttcgggtttagcagactatgtacatttaaaaaccataattcttgagcaggatattcagcggtgtctagacttctcgcatatttgataatagatttcatggaatcttgactcagatctgcattatgaacaatctgtataggataatcatttttgatgaacctcaacactttcaataagcgtatggtttcattcaactgcacgtcagaagcactaataactatgcctttcgaaccactttgagtcacagtgtgcaaccaattctcccaaaaagatagccctgtatcgaaattgatgggcttagaacgaaggaattgatggtttttggggtcaaattccaacatagacgcatggtaaacctcgccattccatctcgtagttgtgtgccagaaggcactttcatcagtttctaatttttcaaagttaatatacggaaagagcttcttttcaatatccctcaaacgctgaatattatgcccatcaacctgctgcaagcaattaaaaaaaatcttaatcctcgtaaccagttcaatcacatcttttgcaggattcggggttatttgatttacgtcgtagaagtcattcaaccacccaggcgtaagaccttcatagtaactccagcagccaccattgccactgctgctactttgaactggttctaccaaatctaacgaattcaactgagagtaatatactactaacacaattcccagtagtacaactaatataaacagtcgattttttcttctcatattcgataaatactattggggctacttttgtcctgtcactgcggatttgcaaacactcatgcgaatattttactcaattgagagatttgctgtctccccccacttcgatggtccccacccctaaagtaaaggaaagaagaattagcactgttttagttccaggtacttctttctttctttaccggtattgtgtggctcatcaaaacttcgtctcgggaaaatgaaaaatgtaaacaagaatttccgtttcaaagagttgcctaaggcccactaataatgtacttattatttacaattcggagaacgctgctgatagaaatcaatcaagaagtcccttagtctttgtgtgtttacgccatattgcttagtttcgtagtgcgttacagttctatcgtgtgaaaatttttttctaatgcatcagctgttatgcgcactacttgaaaggttatcgagcgtttgtaaaaagtagaagtacttaaatgaaccttcacggttaagcaaccagtataattgaggctgctgatttgaaattgcgttttgtgttcagaaggatccccggaggccttcaatgagcttccattttattttctccaaggaggccattttttgtagtgtgatgttgacatggttataactgttagcagtgtttgtgatgatggctgtagtatcaccgcagtggattagctatgaaaaaaaaaaaaaagaactagtttttagttcgcgcatcacgaggtacgtgtttaatatgtcagatgcttgggatcacgtatgccgttaactctacaaagcaattgatattttgctgcctcaaatatctcacactactaggatatattcttttatcaaacaggaaaaaagggcagcgtaccaacatgtataaaagggttattagcatttctggtttattaaagactggagtcaaacgtttttcttctgtctattgcaaaacaaccatcaacaacaagtttacatttgcaacaactaatagtcaaataagaaaaatgtcttccgttactgggttttacattccaccaatctctttctttggtgaaggtgctttagaagaaaccgctgattacatcaaaaacaaggattacaaaaaggctttgatcgttactgatcctggtattgcagctattggtctctccggtagagtccaaaagatgttggaagaacgtgacttaaacgttgctatctatgacaaaactcaaccaaacccaaatattgccaatgtcacagctggtttgaaggttttgaaggaacaaaactctgaaattgttgtttccattggtggtggttctgctcacgacaatgctaaggccattgctttattggctactaacggtggggaaatcggagactatgaaggtgtcaatcaatctaagaaggctgctttaccactatttgccatcaacactactgctggtactgcttccgaaatgaccagattcactattatctctaatgaagaaaagaaaatcaagatggctatcattgacaacaacgtcactccagctgttgctgtcaacgatccatctaccatgtttggtttgccacctgctttgactgctgctactggtctagatgctttgactcactgtatcgaagcttatgtttccaccgcctctaacccaatcaccgatgcctgtgctttgaagggtattgatttgatcaatgaaagcttagtcgctgcatacaaagacggtaaagacaagaaggccagaactgacatgtgttacgctgaatacttggcaggtatggctttcaacaatgcttctctaggttatgttcatgcccttgctcatcaacttggtggtttctaccacttgcctcatggtgtttgtaacgctgtcttgttgcctcatgttcaagaggccaacatgcaatgtccaaaggccaagaagagattaggtgaaattgctttgcatttcggtgcttctcaagaagatccagaagaaaccatcaaggctttgcacgttttaaacagaaccatgaacattccaagaaacttgaaagaattaggtgttaaaaccgaagattttgaaattttggctgaacacgccatgcatgatgcctgccatttgactaacccagttcaattcaccaaagaacaagtggttgccattatcaagaaagcctatgaatattaaaaaaatcgaacgaactcataaacgtcaattatgcgtgtgccttatttatttagttgtgcgtacagtataatgcacttatttatttaccaatcaaatgatttttttaacttttcacgatctatataattacgttaatttcgagtatataacaatgaaaatatatatctacgttgttttaaattgaaaaaagaagaacggaagttctattaatgagccgagaccggtacgtttgttgaaaatagtttggacttaattactgacatactgttggctttgaagcatttaagactgaaaaatagtcatgcaaaagtcatgctttaatatggtgggtttcagttggatgcaagaaataaaatgaaattcgaaggccttttgcaattaaacaaggcatcgtcaaccagacaatgtcgaaaattttgagtcaatctaaatcaatccaccgccacactgaattctgtcaatgatattgtcttcctttttttggtttgatatctctaattttcaacctgttataagcaacgtcaatccgattactttcgtgtgtcattcacatgcgcatatttttttattcgttttatgatatagctgtctttattataacctcgaaacacaacggcaatgtaaccttaccagccgcattattacaaggagcccactttattttcaattgctatcgctacatcgcaaatgctacagcacccccatcagaccttgaagtatatatatatttaataataaatacattattggaatggctagtaaattttgacataaacatgatttccgaacgaattaaaatacagttgatttaggagaaagtatcagtacattgctaaaaattttaagcaaatgttaagtgaaaaaggcttatcattcagatgagcttaagaatatactttttgcgttattcaagagcgatgattattactgaactactgtgacgatatcagcagcatgcctgataaataaatctgtacattcgtggaaagtagtatgtacttttcaaatatttctaagagctaatgatatttatttgatatttatatcgacaaatgaatctttttcatagaagccgttatgaagactccaaatagcaatactcaaaatatactataagatctccgaccaggtacataatacatgacacagcacaaataaccgaccaactgacaatagtagaaagtagcggacggtgtcacacggttttctcgtccacatcactggaagtaagcaatctcttggccagctttcggtgatccaaatattatatcagaccagtttcattattctcggaagtagagtcgaatatttcctattgtatagtgctaatgctatcaatgtttattatatacaacgtacaatagtattattctctaagatcgttgagttgctcatagagaaatccaaaatattgtgcacaataaattatattatctttttgagacgatgaaatcttaaaaattgtcagcaaataaatgtttatttatcgaatactaggtcgaaacattttttttgtttattcaaaatgatcatgtaccttcttctcgcgaaagttttaattaaaatttactgatagttttttaatgatgaacttctataactaaaccataataatgaaaattacaggtaatatttatatcacaagaaacggcccctcttttctgtttttatatagtaaccattaagaatagttggctaatctactatgaaagttcctaattaaaaaaaattcatgaagagttaatcaacgttccagtaccaaatttattctatgttctccttggaagatgaacttgccgcagtagatcatagaacctcattttcaacgttttccaaagaaatactttttttatttaactgacaaatattaatacagtctttatatcatcgatatgactaaagtacatcggaattgcccagcagtagagctcgtgatcgaatagaaaaacgagggccttcagtagctcgtagacataggttaagatcatggatcctgcattaaaaaattcacatagcgctagaattttgttagcgcatccgcctgtttttctttcaaatgtaaaattttaaatacgatcattcctttggatactcagcaatagtgcgcaccagttaagaactgtttttatggttaaacatgtcttaatataatgtgcatacttcaatgcacccaaaatgtatatgttcagacagtttgtcaatagagtaataatcattcaaacaaaaccgtaaatttgaatgttagatgtagctgtaaagaaacttgctagatctaaatattaatagaaaaactctaactatcaattaaacgacatcttacatttcaatttcataaaaattattcttttggctagtttatatcatatagctttccgtaaaaccagtaacaagcaatacactaaattgtccatgttttaactaccatttccttctaatttttttcctttcttagctgatttaattcatttatttgctgtcgtttgcatttactgactaaaaaaagtgtaaaatatgggaagcgcaaattgaaaagtcgggttgcgaaattacctgccaaaaatccacctcgttaatatctaacaagattcaacgcctgttgacaaaagaaactcgtcagtctctcagtttacttctatgtttaacatatttgctatgatccactctagattctgcccagccctcaacttcacgcccacgttgagagtacattcagtacgttgaaaatacattcagtcacacccgcagcacagcaagtcgtttcatctaagctattttgatcgttagaatatccacacctcacaagtatcgacaatttagatgtgtattgggttttgtctacgcaaataccattagtttcacacaagatgccatcagcgctactgtaaatagattgttcctctgttatcgtgcgaatggaactagaaaaccaataatcattgaataatatatgtgacagtgacaggccaccagaataaagctaatatctagaggggtatttcttcttgagtgaagaagaaatatgctacttccaaattttaggacgacaaatcctcataatatgaattaggcaaattacagaatgaagggggttgagaagtcccacagcacatcgctccttcgctaagagctccactgctaaaacagaaaaaaaaagtattaatcaattgtactaccatgttctttgttactaaacgcgcctatttttttcgagagcctttacgagagtcaatcaagcattctcccgcatacttcgctaagaaaaaagtgatctttaattgggcccttcatctatcatttttgcttaagtggcgtaacttattttatcatttcctctccctgccatcctctttatttttgttctgtatcacagcagttaattcagtttccattcaaagtatgccacggataacttgatgcttcaagaagaaaaattatttggcctaaaacttgctgtttcttcacaatttttctaaatgctctccgattcccggattgcagatgtttcactgctccacattatatcctttgtgtccaccttgataatcgatactttaaagattattttgtgggaggagagccttagaaagaatacgcttgttttaagaaggaaaacaagcggcaccaatcttcaattggtattttaaaatctattagacgtcaaatcccggttagacttgagatagatgtacctggagagaaaatctataataaaaaaaaaaatactttcaggtcagatatttctttttttgtccctaataaaaagaaatggtattctgccaaacaccaaagtgccaaataagcattattttacatagtacgaaatggaaattacgtcaattatcgacattatgacataaaattggatttaacaagatctctgaatctgatatgcttctttcattagggtggaaataacagcatttgagagaagcaattgccaagcttctatgaaaattttctagaaggcaagagtatttcagactttcctaatatgaaaggacaaattgacactaatgtctgattatggccaattcctgcggtaaattacacggcgattacggcgacatgagctcacattcatcactctatgggacaaatgtttccaaactgggcgcaacaaacacctgatgtgactcctaccctttggacaatgcagatccacgctacggcaaattagtcaaatgcactagaacatggcgcaagtacttattgtgacctttggggtaccgttaccgtcagttttcttcagctaaggcgcgcgcgccagataactaaaaaaaaatatagttgctgcttaaaaaacaatacacccgtactctcttgcctgtaaaaacctcgaaggaccaaagataccctcaaggttctcatctgtgcggtattcttcaaattacaatgacatttcccaaaattatcagatgtgctcaggtatcttctctccaatgagatgagacagatgaacatatttgaccttgaaggtcatggaaagtaggttgagagcaaatgtgtagaacgaaattaagaaaaaaagaaattacgcacggcattagctcgatgacttagttataaatagaggcctggtatcggctgtcatgatctcatctcttccctatttacaaaaaaactgcaagtatagacaataaaacaacagcacaaatatcaaaaaaggaattatgagcaacgttactacgccgtggtggaaacaatgggacccttctgaagttacacttgccgataaaacccctgatgatgtgtggaagacctgtgttttgcaaggtgtttactttggtggaaacgagtacaatggtaacttaggtgccagaatatcttccgtctttgttattcttttcgtgagtacttttttcaccatgttcccattaatctcaacaaaagtgaaaagattgagaattcctctatatgtttaccttttcgcaaagtattttggttccggtgttattgttgcaaccgcatttatccacttaatggaccctgcttatggtgcgattggtggtaccacttgtgtaggacaaaccggtaactggggtctttattcatggtgtcctgccattatgctaacgagtttgaccttcactttccttactgatctattcagtagcgtctgggttgaaagaaagtatggtctttcccatgaccatacccacgatgaaattaaagacactgttgtgagaaacactgcagctgtttcaagtgagaatgacaatgagaatggtactgcaaatggatctcatgacaccaagaacggagtagagtattatgaagattcagacgctacatccatggatgttgttcaatcatttcaagcacaattttatgcctttttaattttagaattcggtgtgattttccactccgttatgatcggtctaaacctgggaagtgttggtgatgagttctcctccctataccctgtcttagtgttccatcaatcatttgaaggtttaggtattggtgcaagattgtcagccattgaattccctagatcaaagagatggtggccatgggccctatgtgttgcgtatgggttaaccacaccaatctgtgtggccatcggtttgggtgttcgtaccagatacgtcagcggttcttacactgcgcttgttatctctggtgttttggatgccatttctgctggtatcttattgtacactggtttggttgaactactagcaagagactttatattcaatcctcaaagaacaaaggatctaagagaattgtccttcaacgttatatgcactcttttcggtgctggtatcatggctttgatcggtaagtgggcttaaaccaaagcgaaattctgcatgttccatatagattctatttcatattttatagttatttattctttagtaatagcaaaaaaacagtaataatttttctttaacagtctcggacaataaatacgctaaagaagatgaaaatgacaacttttacgctggtgtgcacaagtggtaccagaatacgtggccaccaaaacaatgacggatatagggagaaccaagtctagaaattacaaatgttcttttgacggttgtgagaaagtctacaacagacctagtttgcttcagcaacaccaaaattcgcataccaatcaaaagccgtatcattgtgatgagccgggatgtggcaaaaaatttataagaccgtgccatctacgagttcacaaatggactcattcacaaatcaagcccaaagcgtgcacattatgtcaaaaaagatttgtcacaaatcagcaattaagaaggcatttaaatagtcatgaaagaaaaagcaagcttgcatcaagaattgaccgtaaacacgaaggagtgaatgcgaatgtgaaagcagaactcaatggcaaggagggaggttttgacccaaaattaccttccggctctccaatgtgtggtgaagaattctcgcaaggtcatttgcctggatatgatgacatgcaagtgctacaatgcccatacaaatcatgtcaaaaagttaccagcttcaatgacgatctaataaatcatatgttgcaacatcatatagcaagtaagcttgttgtaccatctggagatccatctctgaaggaatcgcttccaacctctgagaaatccagcagcaccgacactacatccattccacaactttcatttagcactactgggacaagcagtagtgaaagcgttgatagcactacggcacaaaccccaactgatccagagagttactggtcggataaccggtgcaaacatagtgattgtcaagagcttagtccattcgcatctgtatttgatctcattgaccactatgaccacacgcacgccttcattcctgagacgctggtaaagtacagctacattcatttatataagcctagcgtctgggatttattcgaatactgaacgccatagaagagcaatttccgtcctctactcatgtgattcgaactatgaaacaaagaaaaggcaagagtaaatagcgtgatacctattacgtattacgtatacatcctattattcttgaaaaaaagtgcggggctccagagctccacattggtgaccccagagtatactgctctttctaatgccttttccatcatgttactacgagttttctgaacctcctcgcacattggtacctagaaatggctatcatgccggacggcaccgggcaataaaccggacggcacaaaaaaatcgaagaaaagagatttctttttctcgcgggcagtttttccggtcgatcgacattcgtacggtactttctctgtttcagggacatcatgttgtaaaagaaaaagacagtttaggtaatcgttcttttctttctgaaaaattttccacgacgacgacgacgaccacgaaacacctttgattgcgagatccacgaaattacctcctgctgaggcgagcttgcaaatatcgtgtccaattccgtgatgtctctttgttgcaccttcgccactgtcttatctacaaaactataaaaaagagtaatcctaccccatatctaaaaaaaattccttaacttttataacttaacttcaaagtttcttaatattttttcgctttttctttgaaaaggttgtaggaatataattctccacacataataagtacgctaattaaataaaatggttcatttaggtccaaaaaaaccacaagccagaaagggttccatggccgatgtgccaaaggaattgatgcaacaaattgagaattttgaaaaaattttcactgttccaactgaaactttacaagccgttaccaagcacttcatttccgaattggaaaagggtttgtccaagaagggtggtaacattccaatgattccaggttgggttatggatttcccaactggtaaggaatccggtgatttcttggccattgatttgggtggtaccaacttgagagttgtcttagtcaagttgggcggtgaccgtacctttgacaccactcaatctaagtacagattaccagatgctatgagaactactcaaaatccagacgaattgtgggaatttattgccgactctttgaaagcttttattgatgagcaattcccacaaggtatctctgagccaattccattgggtttcaccttttctttcccagcttctcaaaacaaaatcaatgaaggtatcttgcaaagatggactaaaggttttgatattccaaacattgaaaaccacgatgttgttccaatgttgcaaaagcaaatcactaagaggaatatcccaattgaagttgttgctttgataaacgacactaccggtactttggttgcttcttactacactgacccagaaactaagatgggtgttatcttcggtactggtgtcaatggtgcttactacgatgtttgttccgatatcgaaaagctacaaggaaaactatctgatgacattccaccatctgctccaatggccatcaactgtgaatacggttccttcgataatgaacatgtcgttttgccaagaactaaatacgatatcaccattgatgaagaatctccaagaccaggccaacaaacctttgaaaaaatgtcttctggttactacttaggtgaaattttgcgtttggccttgatggacatgtacaaacaaggtttcatcttcaagaaccaagacttgtctaagttcgacaagcctttcgtcatggacacttcttacccagccagaatcgaggaagatccattcgagaacctagaagataccgatgacttgttccaaaatgagttcggtatcaacactactgttcaagaacgtaaattgatcagacgtttatctgaattgattggtgctagagctgctagattgtccgtttgtggtattgctgctatctgtcaaaagagaggttacaagaccggtcacatcgctgcagacggttccgtttacaacagatacccaggtttcaaagaaaaggctgccaatgctttgaaggacatttacggctggactcaaacctcactagacgactacccaatcaagattgttcctgctgaagatggttccggtgctggtgccgctgttattgctgctttggcccaaaaaagaattgctgaaggtaagtccgttggtatcatcggtgcttaaacttaatttgtaaattaagtttgaacaacaagaaggtgccctttttctacttatgtgaacatgttttctatgatctttttttttcttacttttacaactgtgatattgtataaactttgttagaaattcacgggatttattcgtgacgataaatatttatatagacaaagaatatgacgatttatgaaatctacatgattttagtttcttttaacaattgctcgtttttttctcttgcttaattttaaatttttttggtagtaaaagatgcttatataaggatttcgtatttattgttcaagtatttaaagactagatgtctttattcttcataaaattgcacgccaattttaaccctctctacacttcctctagatagcttgcgtactttcttttgtagcgtgataattctggaacgaacggaagcacttgttttaagatcgtccttactaattctcacaaccacttcatacccgcgatttttacgcgtggattcttcttttacctttgtagtgtttgcatcatcaatgattaattcttttaaactggtctccacctcactacgcttagaaacatggaaatcaaatacgttatctctgatattaccacctggatgaacaccgcaaatcacatacataatcgtaccaatatacttcgtccaccatacaattctcaatgcttcagctttatcaccttcgcgtagaactacttgttctaattcttgggagtatttttcttcagattccggaatgttgccgccccatctactacatagagcaattcctatcagcgctctagctctgtgagataatccatgacagccggctattatccctcttgtagcaacatgtaatgcagctgttggttgtaactcctttggataagaggcatgaacaaatgctaagttacataaagcaggagcaatcctttcgtttactatttctggtatatcttcttgtgggattgatgttctcaatagatatagatatttttcagtaagtaatggagcataaggacgggacgcaattagcaatggatcttgtgcacgaatttcttttggaagaagagaataaagtgaaccctctcgaacaccaccctcactaaaatgtacagctttgatctggggaatcgcttcaaaaacagcactcatgaacaaaccaacggcaggaagttgtaaagcccttctatcagaaaccttaaatattttatgctcttttgaagaacctggtattttttgttttaggaatagataatctgacatagacgagaattcttcataagtgcaagcatatccgttaattattgtttggatgggataaccttccgactggtaaagaagcagatgtcccatacctcttaaaccacccccacgggtccaaaggtcaaatccaccttctttcttggcgtcatcaatcatttcttgaggtataccaattttttcaatcgcatctttgtacgcttctttaatctcataaaaaagtgccctattatcatctgttctcattcttctcaaaagagttccagctccatatggcaaagatacaggtttgctggattgcttgacttctccgtgcgagcttattacccatgataactgagtactaccacctgccacatctagatatagacctcttactgtattaaatgaggaaacaacaccatatatgccgaccctagtttcatcttcctggcctaatatttctactttccagccagtgctaccgtaaacagcattaacaaattcatccgcgttaatagcatctcgcgtggcttctgttgcaattactctgacactagtttcaggtacaccaaaatcatcgcaaattaatttgaatctcttcatggcagaacaaacctcttttataatatctctgggaatagggcattttgcgttcgtatgtgtattatattgaacttcgtatagagaaagaccaaccctatctttaaaaacacaaggcataattcttgcatgatgtgcagccttggaagatatactaaaacgaataccattagaacctatgtcgacgattccacacaagtttctcgacacgacctcagtctcggtatcactatcgctaagtgttgacatttgtggcacgcctacacttttcgttcaaaacaatccttagtaaaggacacttccaagagtgagtttcttttttaaaaggtacatatgaatgaattactaatctcacttcgattctttcaattgatctaggaactccgccggcaaagttatcctatctcggcattctgacccggatcgcttatcgcggtcatgtgactaataattgaaatgataaatagcacgatatgtaacaatagtaatatatcaattgacaatgtcatcttgttccctaataaatagtaaaggttccaattgtttcaccactggctgcattttaaaaacaaagcattataagtaaactctcacacatgctaacttctgttgggaagcaatacaaataacagaaaggattggggtaatgaatatcagtaatgtctattgttcccggccatgccgctcattcaaactctatatcggaacccaagaaatccagatcaccattcggatcacttattgagctcgccgctgtattactagaataactatcggatgattcaagatcaataggaattatttcagggcagttttcggggcctgattttaggacttgttcacccgcttccatagacgacatctgttgcgatagattataaatttttgaaggaagtgtatgaactgtcgcaatatctgtattttcttcttgccactgctttggtttactattcagtcttttttccaggtgaggggttgtgttgatattttttgcaagcagtggctggcgtatttgatcaggttttgatactggcttgattgaggagggtcctttttcttttatatactttactggaataccctctttacaacataaatgtctgcattgcgttttgtctttgcagctatgaaaacactcgtaattgccattagatcttacttggcggccattactaaaatgtgaagaagagtgtgcctccgggtgaataactgctgcagattcaaccgcctttgatgatttcttcctttcattcaaataatctagtatactatcatctgaggatagcgattcttctaatccatctttatgggaaaccctagacgttttccccacttctccgtcactactgctttcatagaagaggcatttttctaaactatttagatctttccttatatttggtgtcttcgcagagaactgtgatgccaaatgatcagtggaatatacgattgttttgccgagtccggcgatttcttggcaatgaattgagaattctattttttctagttttggtgatatttttgctgaaattctaaagccccttggtgactgtagtttgttaacttgcaatcttctaaagtcgattaactctcctgagcttttctcggtttcgatatctaatgagaggtgctgaccatgccaaatgctagacttgaatgttgcactaatctcaactttaaatgtcaaccacaactcttcattttctattttgcaattttctagttttgttctaatattcagacaaggcaacaaagaaatgtcgtttttaatttttatgccgtttccaatcttgaggttaagatagtattcaatctgagtatctgacaaatgccccatttcttctagattggtaattccatgtcgtattagccttcttactgaaactagtccaattgttttcaattgcctaagaaccattggcgtgttttcccagcagtgaccattcaggcttcgcagtaagaacaaagtatttttcagtgatgttccatcacttttttcaataaatgtgtctaccatgcattttagtaatctaaaacaatgtctaaaaacgaggaatttatcctgaacaagagtttgatgtagtttagaagcgccttcgtatgatggaaattctaacccacctaactcatattgaatcaaaagagaaaccttttgactaaccctgtcaattatttggctctgtttcttctcggttaaaaatggatatttcaaaagtggcgataaattgatttctttgaacaattttttttcattgtgcctcaccctcataactgaaaactcttcagaagtggccagtaaatttagtatcccttgtaatgatagaaatttttttgcgttaatgaattgtttcatcgactcaaaggatatataatgtcgcgtcattgcatttccgtacgctgtagatttgtactccccattgctgatatcgattattttcacttttactaaggtgtcaagcaaatactgacagaattgatttatctgagagtcttcaacggaatgaaaactaacgtatctgttcacctcttgatatgcagctggattcttcccaaatctaacgtaaaagaatgtgtttcgtagccaatttactgcagtttcaattgaatatacagtttccaaagaggtttctgctgctaaatgctcgatcaaattcaaatgtaatgaactttccaaaacgtcagttccatgaattaagttttcatatgtttgcttcattttagagtctgtcatgattactgcgcacccgtgagtttcaaattgaggtcttcctgcccgcccaatcatttgcagtacatctaggtctgaatactcttggatttcagaagagttccaacttttggtgcctttgataatgaccaaatatgcgggaaggttcacaccaacagctaacgttgaagttgaacacaatatattaattgaacctgcaagaaattctttctcaacggcagtacggtcttctaaagaaattccagcatgatggaaagcgataccttgttgcatacattcatttaatattttatcggagggattatgattacatcttttcttactttttgaaaaaatatgattatttaataaaaattttgctgttgatatagttgaagccctagtcggacaaaatattagtacgggacgattatcggcatgcttttcaattatttcaatcaatttggaattatatatagcatctttttggaagtcatttttgcaattgaaggagtacccataaacaaacttcgttaactgaacttgcctgtacgattcgtcaaaagaaagaatatttgcaggaagctcgttgttagttttgagccacaatgctaggtcttctatatttggaactgttgcacttaaagcaacaaaccgaatgttttgacacattgtattcatccttgtcagaattacttccaaagatgctcctcttttctcctttatggtatgaatctcatcaactaggacaagtttgaccaattcgaataatcggctgtaatcggaccatcttcttgttaacaaatcccatttttctggtgtcgtaattattatgttacattttttagccttttcagtttccagaaaagaggtatcactagtaagcataccaacagaaagattcacaaaggaaggaaaccagttcttgtacatctcgtaacatagagatttggttggcgcgatgtatataattttggtgttattggtatcactatttgtttcctttataagacgtaatattgccaattcaaataatacagtcttgcctgatccggttggtgaagaaattatgcagttctcgttactctcataaatactaggaaaagcctctgattgcattttattaaattctgtaaatttaaaaacccctctgaatgaatctggtaatatggtcgtgctcaaacatttcttcgctgatttccttatcgtgaccttcttaggtttcttcgcctcttcatcaggtgtctgctctaaatcgtgatcaaataatttactagttacttgtgtatcatctgctgttattgaaaaattatcgtctttgtcgaagaattgcagaccacggccctcaaatatttcctctgtttcattttcatcatcacaatcatccagtaaactgttataagacaaacctactttaaaacttggttggcggctatttttcttatttcttttaaatgtagcagactggtcgttaaagtcaatatctataagtcctctgaaattctagtccagaaaaaccacttttggttgcatttccgctagataataaaagaaagaggtaacaatgttagtcaaaatactgttgttgtccgatatggtgtaaactgataagggtgttgctaagcttcgttactactatttggagagggtctacttctttttcctgtaccgaggcgatcaaactttgttttcatccttacgacgcctcttaagttgtcaaatccaccttgaggtatcaatcattttcaatgaaaggatttcttgatagatgatactaatagtcccgttttgtttataatccggggcaaagtctaaatacccgccgagcctgcatccattcgtggtacatgatatgttaaaactacaacaaggcataaaaaagggaagtatatatgattaattatatatacgtaaaggaaaagatacgtagttaaagattgtttttgttggtatcaatggaatcaaagatgagtgaagaagaagcgcataaaacagtggaggtggatgacgtcggggttcaattggatgagggcgatgaagaagaccttttggagtatgatgatgaactcgtggaggaacaaccatcggacgcccgtatacgcaacgtggcagagactttaatgaaaagcgaattgcccaaagtcaccgtggaatataaagatactacatttctgttgttcacgtcggatgataagaacgaaagtaacaaccccataatatgtgaaaacgctgctctttatcagcgacccatgggggaattcatggaatccattcgtaaatttatgggaaatcgttttggcaggttggcttttgctacgaaggagttggttttacaactgaaaagcctcgatttgaccttgttcgaagataatgtctacaacaaccatatttcattcagcgatgtttatactatatttaaaatcctgaaggaaagatcggagtctaattttgaaactgatataccgacgcacttggctattgaattaagtacaaggccaagatttgtctctcggtacaacgccttggttgaattaactgaaagctcagctacgttgaaaaacataaagccattttctaacgatgaaacgcatcccttaattgtggatgacaatgaccaatatacacaccagaatacttcagaagtcattgtaatggacatagatgatgacgtaggtgaggattctgaagactaaagtagccatgtttaatcagcactgatcgtgggaaatcctgatgtccaacggtgagtttctgatttcccagtcacggattccttttgagaatcttctcccgcgaataaattattggctctgtgtaatatttaaggtcgccttctttttcgtttgtatagtcagcagttaagtattcattaattttggatgatgcaaaggtccatattcgatttctgatagcccttcccccttttttgtagcgaattgtattattgttttgtattgttttttcgtcattttcttcaatttttttcaagttttactttcggaagaattgctgaaagtattttctgttaggatatgtaaaatacaagcataaaatatgtttcaggagaagaaaatcactcaatagtgccacaccattgttaacgagctcgagtaattgaatcaatttagagaaatagatcatattacaaaaatactatgattattgaacgttgggaagtaaagttatctaaatgtaaccaaaatgtgggcggctattctgttctgtcaggaaacttaaaagaaaacatcaaactgggaagacgagcacaaaaatatttgaaagagctaagaaatttgcaacttaaaccactgaaaatcggagggtatgaaaactgcggcacgatcaatggtgaagagtattttttggaggtaattcacatcacctctggaagacaaaaaatagatgtagccgttggcaaaacatggaatgtgactaacattgagaatgacaacaaagaagaactacagtatgagttattcaaggaaaagttaaaagtcgggaaacaggacatgttattttttagctggatgaaaagtctttcagttcaattaaatgctcctcttcaccaaaaaatgacggaacacggtttggcagacgataacacgaggttagagtggttcaacatcccacttctcagaagaagtcaatacaggaaaaaggtaccatatccgagtttaagacaaatgtcctctgtactggaagtgcaatgcagcacactaacggaggaaaagttgaacttctgcgttggattttctgataaacctttgtcagaatggaagccccaaatttttgagcaaacctacaatagataccgtttacaacggatctcacctgagaaatctttcaaatataagagtaggtgcagtaagtacaatttcaagaccagttcgcaaagctgggttgtgaaagtcccagaacatgatcaacagcttaatacgtttgaaaaacgttatgatgaactctttgatgctcaatttaataaactagaattttttaaaataagaatgaaaaaattgaaaaagaataagccaattgagaaaaagaactataaaatatggtgtctagaaaaagaagacctaaaggatttggtatgggatcctctgaaaagaatttgcaatcattctaggtatgcaatatttgagcatgttaccataaatagggaggcctattcgatcaaaccattaaggttaacttttcaaaaattagattccggctcccttgacctgatcgataatcaaaaaaagacgtttggtagtataaagcttgcaatgagtatgccagatgtaaaaaaaactgaaaatcagtcaattgaagaaagtgaaagacacgatgaaactgctattgaaacccaagaatttgatgaaaatgattgtctttcatctaaggcggatattaatacatcattagctcctcaaaagagatctttcatcgataatgaactaatgtccatgttagtcaccaaaaaaaaaataaagaaggacaaggatgttagtgacaccggtatatcttccacttcatacttgataaattctgggacatatgcaaattctcatattgaaattcctacctctaattcagtttacaatggaaaggaagattgctcatttaataactactcagtaaagcattcaatattggaagaagatattgagaataaatgcatagccgtaaatgaaaacaaggtgattgagaaccaaaaggtaattcagtcattatgtaaaaattcccatctagaccttatcgaacaatcttactttggcgaatgcgatttcattataaaccattcaacatgtgtatataaaattcaggcgagccgatttatgcaactcagaaataacggctcattgcattacgataaagcggtaaacgatcttttaactgaatttcagagagtcattataattgtggagttttctgaaataatacaagacgttgatcctgatcttttctggaaaatcaaactttatttattgaattcacgtgttgatgtttttttcattcatgagactactgacttttttattgattggatgaaatatttcattgcaagatgggccttttcatataacgatgagaaagaaaaaaatattgcaaatgccgatattcttctagatttgggatttaacatcctcttagtacggaaaattttccagacatatagtctcgaagaattttttatggcaataataaaggaagaaagcaaagctgttaaaatgcttacggtttcacaaatgactcgcctgaagaagttattaaccttagaatggtaaatccagcaaggatcgttacccggtaaactatttatactacgcctgcctctttcgttcttcgactacatgctacagttagtaaattcaaccaaggaaaatgtatttattaacatgaactagccacctaattaacccttaccttattttttatacccttggatcatcggagtatctgtagatcatatgttaacgtatgtataatattacatctgtcacaataaacaacccgaaaaaaataccgcacggaaaatgagttactgattaagatgcactttttggtgagggtgcgtgacttgaaactaaaaattaccaatagtcaaaccctttccattttcgagggaagcaatatctgaaatttatatttttagaaatttccaagagaaagtggcttttaacgaggttcttcttcttcatccccttttttaccaatattcctttttatggttgtattcgaaataactatacttggggccaatggaggacccaccgaatacggaacacagtgttttatacttaagcctgctagaacagaggatccagaattaatagctgtagacggtggtgcaggaatgtaccagctacgggagatgttggtccaagggcgaaatgaaaatgaaggtgatgatgagcttgttccaagcttttatgaacatgatcgagagccaatagagttttttattgattccaaactgaacatacaaaagggattatccaagtccttgctacaatcattaaagaggcagggagagcattttgaaagcgccaatacaatgaagaaaacttacgaggttttccaaggaattaccgactactacattacccatccccatctggaccatattagtgggctggtagtaaactccccctcaatatatgagcaggaaaacagtaaaaagaaaactatttggggattaccgcatactattgacgttttgcaaaagcatgtctttaatgacttaatatggccagatttaacggcagaacgttcaagaaaattgaagctaaaatgcttgaatccgaaggaagttcaaaagtgcactatctttccttgggatgtaataccgttcaaagttcatcatgggataggcgtcaagactggcgcgccggtatacagcaccttctatatcttcagagacaggaaaagcaaagactgtataatagtttgcggagatgttgagcaggaccgcagagaatctgaagaatctctacttgaagaattttggtcttacgttgctgaaaatataccgcttgtgcatctcaagggtatattagtcgaatgttcatgcccattatcttccaagcccgagcaattgtatggtcatctatctccaatatatttaatcaacgaattatccaatttgaacactttatacaacagtagtaagggattaagcggtttgaatgttatcgttactcacgttaagtcaacacctgctaaaagagacccaagactaaccatactcgaagagttacgatttttagctgaggagaggaacttaggagacttgagaatatctattgcgctagaaggccacactttgtttctataatgtacacaacgtcaataacataatactacgtagatgaaaagcggaaaaattcattacccgggagcaagcaaaatactagtagtaactaatgaaacttctttccattattattgatgagttaacttatgtagactcatctttgaatcccctatcccaacataagtcccggaatggaactccgtagtttttctagacagcctgatggcatacttgctaacccaagattgggaagggaggaagtattggaaggtgaacatccgcaagatgctagattagcccgacaaagcatttggttgagcccaagtttaattgcggagtatatacagctttttttcaattttattataggaactataggactgtctcttgctattaaattcattttgatgataagaaacgatgttaacttaaaactggagcataacgtgagggaagaattagataaaattgcaacttgcaaatcaaggtattttgaaaaccagtgcgaacctcatatgagggttccagcattggaggtacgttgcaatgaatggtcaaaatgtatgaacaaggaaatagtgtctggctccgattaccaatgggctaaagcatgggctcgtactctggcggaggtaataaatgctttttttgaagcgttcagtatacgatctttccttttcattttaattagcataataggtataatatttgttaccaatacgagtttcggatcatacagggtttatctcaataataaagatacaaaatcggttcgccatgcatagtgtatataacttaatctaatctgcacatttatattatttagatccatacgtcgatgaggatatgcgcaggaaagacataaaggaatattgttatttcaaagattttctccactccttaaacccgttcgataatatatgttctccatcaatcaaacctgaatattcctcatcactttcttcaatttcggataatcttaggtgattattttcgaaaaccaacttaaatgctcttatttgagaatgaggatcctcatctcttggtatcattttcaaaagccactcagtaaggagaccataccatttaatggcttctaaacatgcacttccaacttgtggattattgttctttaataaaacaggtacttcctccgttgaaaactcttccacagtttttaatacataatggtcgtctttaaaaccatatatgatccttgggatcccaactaagaagcattgcagccaggtccggaacagtttacgctcaaacttatgcgtatccgatatgttcgcaacttgctgcgtacatttcaattcggcataatgttttaaattgtctctaccgttttctttaaagtcaaatatacaatccacctcagcaccaagaattaacttgcagttacctacaccagttctcacaacactaatgtattcatctccatgcgatacaatccttttagttcttttttctatcacttcacggggtgtatactgcaacggattggaaagagtagccaaagtttcaaacttgtaccctgtaaatacattcagatcttgatttatattacgccctgcttcagttgcagaggaagccttagctgcattgacagcttcaggcacttccttgataaaaagttggccgttgaatgaaacgatacgaagatcaactgtattaaaagatggagagtcaaatgcacatgaaattaatttccgtgctattcctctaaaagtaattatatcagcattaattttttttcctttatgtctttcagagctttctatggtttctaatagcccacgcagggaacacctgtcttcaaaatctttgtaataatccttaaatttctgaaatcctgatgaaagatccaacttcctgtccaattcagcgtctggaagatagtagtaattcaaattcgtatcatcgctaattaaatattcttcatccttagttcttgaatagaatcctatttcctttggctgcttcagagctgttgtcgaccctctttgctttacgaacaaatttgcactaacacccattgggatacactatgttggtctaatatttcgctattctttcaccatattacagaagtattagtaacattaccagacctcatctgttcctaatattctcgaagtaaatttttcaatttacccgaatgcttactctttttttcttcttcgttaaaagcaagataaagtgaaaaaaatggaagataacttccataagaatgacgaaactattttcaaaggttaaggaaagcatagaagggatcaagatgccatctaccttgactattaatggaaaagccccaattgtggcttatgctgaactaattgctgctcgtattgtgaatgcgttagctcctaactccatagctattaagttggtggacgataagaaagcacctgctgccaagctcgatgatgctactgaagatgtcttcaacaagataactagcaaattcgccgccatcttcgataatggtgataaagagcaagttgctaaatgggttaatctggcccaaaaggaattagttatcaagaactttgctaaattatcacaatcattggaaacactagattctcaattgaacctaagaacctttattcttggcggcttgaagtattctgccgctgatgtagcatgttggggtgctttaagatccaatggtatgtgcggttccatcatcaagaacaaggttgatgttaacgtttctcgttggtacactttgttagaaatggatcccatcttcggcgaagctcacgatttcttgagcaaatctttactagaattaaagaaaagtgctaatgtgggtaagaagaaggaaactcacaaggctaactttgaaattgatttgccagatgccaaaatgggtgaagtcgtcactcgtttcccacctgaaccttctggatacttacatattggacatgccaaagctgccttgttgaaccaatattttgctcaagcttacaagggtaagttgattattagattcgatgacaccaacccatcgaaggaaaaggaagaattccaagactctattttggaagatttggatttattaggaatcaagggtgatagaataacctactcatctgactacttccaagaaatgtacgactactgtgttcaaatgatcaaggatggtaaagcttactgtgacgacactccaactgaaaagatgagagaagaacgtatggatggtgttgcttctgccagaagagatcgttctgttgaagagaacttaagaatttttaccgaagaaatgaaaaacggtactgaagaaggtttgaagaactgtgttcgtgccaagatcgattacaaggctttgaacaagactctaagagatcctgtcatttacagatgtaatctaacccctcaccacagaaccggatcaacttggaagatctacccaacttatgatttctgtgtcccaattgttgatgctattgaaggtgttacccacgctttacgtaccattgaatatagagaccgtaacgctcaatatgattggatgttacaagctttgcgtttgagaaaagtccatatttgggatttcgctcgtatcaatttcgttagaaccttgttgtctaagagaaagttacaatggatggttgacaaggacttggtcggaaattgggacgatccaaggttcccaactgtcaggggtgtgagaagaagaggtatgactgtcgaaggtttgaggaacttcgtcttatcccaaggtccatccagaaatgtcattaacttggaatggaacttgatctgggctttcaacaagaaggtcattgatccaattgctccaagacacactgctatcgtcaacccagttaaaatccacttggaaggctccgaagctccacaagaaccaaagattgaaatgaaaccaaaacacaagaaaaacccagctgtgggcgaaaagaaagtcatttactacaaagacattgttgtcgacaaagatgatgctgacgtcatcaatgttgatgaagaagtcactttaatggactggggtaatgtcattattactaaaaagaatgacgatggttctatggttgccaaattgaatttggaaggtgatttcaaaaagaccaagcacaagttgacttggttagctgatactaaagatgtcgtccctgttgatttagttgacttcgaccatttgattaccaaggacagattggaagaagacgaaagtttcgaagatttcttgactcctcaaacagaattccacacggatgccattgctgacttgaatgttaaggatatgaagattggtgatatcatccaattcgaaagaaagggctactacagattggatgctttacccaaggatggtaagccatatgtcttttttaccatcccagatggtaaatctgtcaacaagtatggtgcaaagaaataagcatcacataagtaatgtatatacatatttatgttatttctcaaccagtaccttttgaacaatatcttttataagtgaatggtttgctttctgaaccagtcctgtgttcgctgccttgaatcatgtaaggatagcagcttatgacatgtatgtctacctatagaactttgactgtaaaagtttatcatccattacccggttttgtaattttgacaatttatattttattgaaattggttcaaatagtgactacgagctggaaggaaaatattcaaagttacaaaaggtacttgaaggataccaaagtttgtaattgtattgcactaatttgttgagagcactatagaaatgtctgatttagatgaggatttattagccttgctggtgccgatgaatccgaagaagaagatcaagttttgacaactacatctgccaaaagggcaaaaaacaacgaccaatctctttccaagaaaaggagaattgaagtcggcagtgtagaggatgatgatgaggaggacgattataacccttactctgtaggaaatgcagactacggttccgaagaagaagaagaagctaatccttttcccttggaaggaaagtacaaggatgagagcgacagagagcacctggaatccttacctgaaatggaacgtgagactctattatttgaaagatctcaaatcatgcagaagtaccaggagaggaaactttttagagcacgtggaagagatatgaaggaacaacaacagagagccaagaacgacgaagattccagaaagaccagagcttccactagatcaacccatgctactgggcattctgatatcaaggcttcaaaactttcgcaattaaagaaacaaagagcgaggaaaaaccgtcactacagcgataatgaagacgaagacgatgaggaagattacagggaagaagactacaaggacgatgaagggagtgaatacggggatgatgaagaatacaatccttttgatagaagggatacatacgacaaaagagaagaagtggagtgggctgaagaggaggacgagcaagacagagagcctgagatttctgatttcaacaaactaaggatcggtcgttcatttgtcgcaaaattttgtttttatcccgggtttgaagatgcagtcaaaggttgttatgggagagtcaatgttggcacagataaacgtaccggcaaaacttcttaccgtatggtgagaattgagagagttttcttgcaaaaaccttacaatatgggtaagttctatactaaccagtatttcggtgttacccaaggtaaagacagaaaggtttttcaaatgaattattttagtgatggtttgtttgccgaagacgaataccaaaggtatctcagggcattggataattcgcaaatgattaaaccttctttacattctttgagtaacaaaacgaaagaggttatggattttgtcaatacaccattgactgataaaactacagatgaggttgttcgccataggatgcaattcaataaaaaactatctggtacgaatgcagtcttggagaaaactgtattgagagaaaaattgcaatatgccaaggagactaataatgaaaaggacattgcaaaatactctgctcagttaagaaactttgagaaacgaatgtctgtatacgagaagcatcatgaaaatgaccaatctgacattaaaaaactaggcgagttgacctctaagaatagaaaattgaatatgagtaacatcagaaatgcagagcatgtgaaaaaagaagacagtaataactttgattcaaagagcgatcctttcagcaggctaaaaaccaggaccaaagtttactatcaggagatacaaaaggaagaaaacgcaaaagctaaagaaattgcacaacaagagaagctacaagaagataaagatgctaaagataagcgtgagaaagagctacttgtggcacaattcaggcgccttggtgggttggagcgcatggttggtgaattggatatcaaatttgaccttaagttttagtaggcaggacaatttcagtgtttgtaaaaatatatttatatttatatatttaaatatactaaataaaaataatactatcatcgttgtgatgcaaaaaaaaaaaaaaatgaacagaaaataatagtgatgtgaatggtttcgtgccaaggaacaaggccatgcatagtaaaccttctcactatgccaagtgaggataaattgggtgaagagatatcaacgagggtgattaatgagtattcaaaactaaaatctgcctgcagaccaataattaggccttcaggtatcagagagtggacaatattggcaggtgttgcagctattaacagagatggcggtgcgaataagatagagatactttccatagctactggtgtgaaggctttgccagattcagaactacaaagaagtgaggggaagattctgcatgactgtcatgcagaaatactggcattacgaggtgctaatacagttttattaaaccgtattcaaaactataatccatcaagtggtgataaattcattcaacataatgacgagatacctgccagattcaatttaaaggaaaactgggagttggcattgtacatctcgagattgccctgtggtgatgccagcatgagtttcctgaatgataattgcaaaaatgatgatttcatcaaaatagaagatagcgacgaatttcaatacgtcgaccgtagtgtgaaaacaatattgaggggacgcttgaatttcaatagaagaaatgtcgttaggactaaaccaggaagatatgattccaatatcactttatctaaatcctgttctgataaattattaatgaaacaacggtcgtcggtactgaattgtttaaattatgaactctttgaaaaacctgtatttttaaagtacattgtgattcctaatttagaagatgaaacgaaacatcatctagagcaatcatttcacactcgtctaccgaatctagataatgaaattaaattcctgaattgcctcaaaccattttatgatgataaattggatgaggaggatgttcctggtctaatgtgtagtgtcaagctctttatggatgactttagcaccgaagaagcgattcttaatggcgtgaggaatggattttataccaaatcatcgaaaccactgaggaaacactgtcaatcgcaagtaagccggtttgcacaatgggaactattcaaaaaaataagaccagagtatgaaggaataagctatttggaatttaaatctcgtcaaaaaaagagaagccagttaattatcgcaataaagaacattttatctcccgatggttggatacccaccagaacggatgatgtgaagtaatatatatatatattgttgaatatgcgtatatgcacacttttttgttagtgcaccttaaagaaatatatacacagtagaaatatctatatatccagagttcatctatctttccctctctgtggtattatcatcacatattttatcattttttatcatcttcttcgtcatcgtcagatggaccatcatctatcatttccccatcctcattgttatcacctgatccattggtactatcaatcgctaactcggcaccctgcaaaaggtcaattaattcatccagttcatcaccatgaaccaaatcaactggcttttgattgttatagtttctcaccctaggatccgcacccacttcaattaagtttctagcaataaaagttccatgctcaggctcctcttgactgtatctgacagtaacatgtaacggagtgtcgccatcaacgtcgttttgtgggtctatttcgatttcaccgtcttgatcgagaatcttgtcgagaacttcccaggatccatacttacaacataaatgtaacgctgtattccccagtggttctttggattcgttaattagctttgcaatcttctcaggatcattatctaagctatcaaatacggtctccaaaagatccagattgtttcttctagctgcatccagcaattgttcacttaaagaagcaccttcagtattcatgatcaaaaaaagaaactaatttattttgtgaaaaacttcgacttctttcacttatgacttttttcactgggattcagaaactacctcacaggacccctatataatgaatttattgtcaacctttctatcaacgcgttataccttgggtatactaggaaaaaaaaaaaaagatacatatggatgtatatgacctgcatacacgatccgaaaatcttgaacgtaattgtaacactatcaacacattaaaatggatattaatgaattgataataggtgctcaatcagctgataaacacactagagaagttgcggaaacgcaattgttacagtggtgtgattccgatgcatctcaagtgtttaaagcgctggcaaacgttgccttacagcacgaagcttctctagaatcgagacagtttgctttattgtcgttaagaaaattgatcaccatgtattggagtccaggatttgaatcataccgttctacatcgaacgtcgaaatagatgttaaagattttatccgagaagtgctactgaaattatgcttaaatgacaatgaaaataccaaaataaaaaatggtgcatcttactgtattgttcagatatctgcggttgattttcctgatcaatggccgcagcttttaacagttatttatgatgctatctctcatcagcattcattaaatgcgatgtctttattgaatgaaatttacgatgatgtcgtatctgaagaaatgttctttgaaggcggaattggcttggcgacaatggagatcgttttcaaagtactcaatacagaaacttctactttgatagccaaaattgctgctttgaagctacttaaagcatgtcttctacaaatgagctcccataatgagtatgatgaggcgtcacgaaaaagttttgtctcccaatgtttagctacttctttacagatattgggacaattgttgactttgaattttggaaacgtagatgttatttctcagttgaaatttaaatccattatatacgagaatttggtttttattaaaaatgatttctctagaaagcatttctcaagtgaattacaaaaacagttcaaaataatggcaatccaagatctggaaaacgttacccatataaatgcaaatgtcgaaactactgaaagtgaaccccttttagaaacagttcatgattgttctatttatattgtagaatttttgactagtgtttgcactttgcaatttagtgttgaagagatgaacaaaattataacatctttaaccattctttgtcagctaagttctgagacaagagagatatggacaagcgatttcaatacatttgtatcgaaggaaacaggcctagcagcatcatataatgttagagatcaagccaatgaattttttacttcattacccaatcctcaactttccctaattttcaaagttgtttccaacgatatagaacacagcacgtgtaattattcaactttagaatctttactatatctcttacagtgtattttgcttaatgatgatgagataactggtgaaaatatcgatcaatctttgcaaattttaataaaaacgttagaaaatatcttagtatcacaagaaataccagaattaatattggcgcgtgcaattttgactattcccagagtactagacaaatttatagatgcattacctgatatcaaacccttgacatctgcattcttggcaaaaagtcttaatttggcgctaaaatctgataaagagctcattaaatccgcaacattaatagcatttacgtactattgttattttgccgaactagattcagtccttggaccagaggtctgctcagaaacccaggaaaaagtaattcgaataatcaaccaggttagtagtgatgccgaagaggacactaatggggctttaatggaagtattaagtcaagtcattagctacaatccgaaagaacctcattcaagaaaggaaattttacaggctgaatttcatcttgtgttcacgatctcatccgaggatccagcaaatgtacaggtcgttgtacaaagtcaagaatgcttggagaaactattggataatatcaatatggataattacaaaaattacattgaattatgtctcccatcatttattaatgtgctagattccaacaatgcaaacaattatagatactcacccctgctatcattagtcttggaattcatcacagtttttttgaagaaaaaacccaacgatggatttttaccagatgaaataaatcaatacctatttgaaccattagcaaaagtattagcgttctctactgaagatgagaccctacagttagccacggaggcattcagctacctgattttcaacacagatacacgagccatggagccaaggttaatggatatcatgaaggttctagaaaggctgctgtctttggaggtatcggattcagccgctatgaacgtcggtccattggtagttgccatattcacaaggttttcaaaggaaatccaaccgttaataggaagaattttggaagccgttgtggtaaggttaattaagacacaaaacatttctactgagcaaaaccttctttctgtattatgcttcttaacgtgtaatgatcctaaacaaacggtggattttttgtctagtttccaaattgacaatactgatgctttgacattggtgatgcgaaaatggatagaagcctttgaagtcattagaggtgaaaaaagaatcaaagaaaatatcgttgctttgagcaaccttttcttcctgaacgacaaaaggctacagaaagtggttgtcaatggtaacttgataccatacgaaggggacctgatcattacaagatcaatggctaagaaaatgccagacaggtatgtacaagttccactttataccaagatcattaaattgtttgtttctgagttaagcttccaaagtaaacaaccgaatccagaacaattgatcacaagcgatattaagcaagaagtggtaaatgctaataaagatgacgacaatgatgattgggaagatgtagatgatgtactcgattacgataagttgaaagaatatattgatgatgatgtcgatgaagaagcagacgacgattcagacgatataacgggactcatggacgtgaaggaatctgttgttcagctactggtaagattctttaaagaggttgcaagcaaagatgtgagtggcttccattgtatttacgagactctatccgacagtgaacgtaaagttctttcagaagcccttttgtagcttatatacataagccgtggagatatcagatgtaaagtagttagagtagaaaaaatgcggcaaaataagcgccgtctatataaaagaaagaaagtgttaaataaactgaccacagaaggtggcaaaaataatacgagatttagaagtcagataatggacccgattggaataaacaaagtcttggaccatttagcaccctcagagcttatcaaacctgttaagagttgccataataaaccttcagtgttggtgttggatgacaggattgtggatgcggcaaccaaagatctctacgtgaatgggttccaagaagagattcagtatcagaatcctacaccggagaacttgcaacatatgttccaccaaggtattgaaatattggattcggcaaggatgatcaacgtgacacatttagcgctttggaagccttcttcttttaagttggggaatcctgtggactttgctctagatgataactacgatacgttttggcagagcgatggagggcaaccacaccaattggacattatgtttagtaagagaatggacatctgtgtcatggcaatattcttttcgatgattgcggacgagtcctatgctccaagcttagtgaaagtttacgcggggcatagtccttctgatgcgaggttttataagatgcttgaagtgagaaatgtgaatggctgggtggcactaaggtttctagataatagggaggacgaccagctgctgaaatgtcaattcatcaggcttttgtttccagtcaaccatgaaaacggaaaagatacacatctgagaggcataaggctatatgttccatctaatgagccacatcaagatacccatgagtgggcacagaccctcccagaaactaacaatgtcttccaggatgctatattacgttaataatatgccgtttatgatattttcttccttgctattaccctgccttttgctttttttttttcacttcaattgcagggattatggaataaaaaaaaagttgaaagtagtataaacacaagatcaaaaagtggcaaagaggacccgctctgtttattgctactcaattgtagaagagaaaatagtaggatgtccgatttggaaaccgtagctaaatttctggccgaatcagttattgcttctaccgctaaaacttcggaaagaaatttgaggcagttggagacgcaagatggattcggtttaactttattgcacgttattgcttccacaaacctgccgttatccaccagattagcaggtgctttgttcttcaaaaatttcatcaagcgcaagtgggtagatgaaaatggtaatcatttgctgccggctaacaacgtagaactgatcaaaaaggaaatcgttcctttaatgatcagtctaccaaataatttgcaggtccaaataggagaggcaatttccagtattgctgactctgattttcctgataggtggcctacacttttgagtgatttagcttccagattgagtaatgatgatatggtgacgaataaaggtgtccttacagtggcacattctatttttaaaagatggagacctttatttagatcagatgaactttttttggagattaaattggttcttgacgtgtttactgctccatttttgaacttattgaaaacggtcgatgaacagataacagcgaatgaaaataacaaggcatcgctaaatattttatttgatgtattgctagtattaattaaactatactacgattttaattgtcaagatataccagagttttttgaggataacattcaagtgggtatgggtatcttccataagtatttgtcatattctaatcctttattggaagaccctgacgaaactgaacatgcgtctgtcctaataaaagtaaagtcctctatccaggagctggttcaattgtacacaacaagatatgaagatgtctttggacctatgatcaatgaattcatacaaataacttggaatcttctgacctcaatttcaaaccaacctaaatacgacatcttagtatccaagtccttgtcatttttgactgcagtaacacgtattccaaaatactttgaaatattcaacaacgaatctgccatgaataatatcacagaacaaatcattctgccaaatgttacactacgtgaggaagatgttgaactttttgaagacgatccaattgaatatatccgtagagatctggaaggttcagataccgacactagaagaagggcatgtactgatttcttgaaggaattgaaggaaaaaaatgaagtgttagtcacaaatatttttttggcgcatatgaaagggttcgttgaccagtacatgagtgatccatccaaaaattggaaatttaaagatctttatatttatctattcactgcattggccattaatgggaatattaccaatgccggtgtttcatccacaaacaacttactaaatgttgtagattttttcaccaaggaaattgccccggaccttacttccaacaatattcctcatattattttgagagtggatgccataaaatatatctacactttcagaaatcagttgaccaaagctcagttgattgaactaatgcccattttggccaccttcttacaaacagatgaatatgttgtctacacgtatgctgccattactattgaaaaaattttgactattagagaatcaaatacgtctcctgcttttatttttcataaggaagatatttcgaatagtacagaaattcttttgaaaaatcttattgcattaatcttgaagcatggcagctcccctgaaaaactagctgaaaacgaatttttaatgagatcaatctttagagttttgcagacgtcagaagattccattcaacctttatttcctcagttgttggcacaatttattgaaattgtaacgataatggcaaagaacccatcaaatccaagatttactcattacacttttgaatctattggtgccatcttgaattacactcaaagacaaaacttaccactacttgtagattctatgatgccaacatttttaacggttttctccgaggatattcaagaattcattccatatgtgttccaaatcatcgcatttgttgttgagcagtctgcaacaattccagaaagtatcaagccgttggcacaacctttattagcaccaaatgtatgggaattgaaaggtaatattcctgccgtgacaaggctactaaagagttttataaagacagattcatcgatcttccccgatctagtccctgttttaggtatttttcaaagattgatcgcatcaaaggcttatgaagttcatgggtttgacttattagagcacatcatgcttctaatcgacatgaaccgcttgagaccatatattaaacaaatcgcagttttattattacaaagattacagaactctaaaacagaaaggtatgttaaaaaattaacggtattttttggtttgatatctaataaattaggctctgattttttgatccactttattgacgaagtgcaagatgggctttttcaacaaatatggggtaattttattattaccacattacctactattggtaacctgctagatcgtaaaattgcattaattggtgttttgaacatggttataaacggccaatttttccaaagcaaatatccaactttgatttcaagcacaatgaattccattatagagacagcatcatcacaaagtattgcaaacttgaaaaacgattatgttgatttagataacttggaggaaatctccacgtttggttctcatttcagtaagttggttagtattagcgaaaaaccattcgatcctttgcctgaaatcgatgtcaataatggtgtgagattatatgttgctgaagcactaaacaaatataatgctatctctgggaatacatttttaaataccattttgcctcaattgacccaagaaaatcaagtaaaattaaatcaattattagttggtaattaacatggtgtagagaattatatatagatgaaaatggagctcttttgaatagctgtttatatgtagatagagtaagcaaaaatgaaaaaagaaaagcacgtaaatacgatcgcaatatggtttcttttccagcggagtacataggtctgttagaaatgaaacgaaacgaaacgaaacgagattggtaaaagtacatatacatattgattcagattaaataggccatatggataccatgtggtataagagggcacttttagttcttttaggaatgatattaacattggaatattacaaaattatgtttttttgtctgctgcagctgcggtggaagtagcatgcggctgttcttgtattattttagtagtgatttttttatcctcatgactatcgtcaggatcatcgctagccccacttttcttcgatttcatggctttgatctcagcggctgtcaagaacctcccaccttcaccacgaggtcttcgcatcgcatgtttatgtcgagattcgtgtaagtatggctttcgttctcttgatattcgtagcttttcctctagtttagctcttgcatatcgccttttcaaaattcggtagtactgcttggcattaacataaaatggttgctctgctatagcggttcctaaaacatcgctttgcaagtttggttgattttgggtgtactgggcttgaaccaccaattgctgctgctgctgctgctgctgttgttgctgttgttgttgatgaggaggaggcggtaaagtagtcactgcagagaaactagtaaagtcggcagatggttccatcgtactgacactggaagatgtatactgtgactgttgttgtggttccaaggagtccataactctattctgtgatgcccgcaatctgttaaacaaaaacaaatcttcttcatttgtaacccgttgatcttcgcctcttggagaaggcgcttttcccatatccaagggcatctctatgggcttctcttgaagagagggactgcgtgaagctgctgccgttgatgttgcagccgctgtatcagattgcagatctgtttctaatggatgaaatttcgcatccgtttcgtctgctgacatggcgttcttgttcctcttccaaaaagaaatgcttttccaaatacagatgcgattagtaaatcaaattataaacgacagtgagttgcccttttgcaagtaccttcaacacaaacactttatttattcatcgaggtccccttgtaagggagaattaatgttacgatacaagaagttttccgggtaagattgctaaataacgaatttgatggttacatacaatgaattatttacatatacaagctaacgattaaaggatatttacatgactggttggcttggcttcgtgccacacggtagagttcaaatagggctgccgcagtgataccttgaatccgtcttgcttggcctatggtcaatggctgtacgcggttcaagagtagtttgcattcagtggaaagcgtgggtaactgacggtaatcgtaatcttgcggcaacagcatattttcgtctgcctgaaatgccttcacaaactggttctgtttgacaatgtaaggttcgtatttaccttgaatgttaattttggtgacaacatgcattgggatgtccagcaaattaatgggtaaatcgggaatgcactcgtagagtttatgtagatccatatctttgaatctgaatatttcccaagcagatctgttttcagcctgtggcgcgatattagcctgtagtaagctagaccatttttgagagcttagcttgaaattttgaagcgcccgtattgtttcatcatataggtgcttgtctcttgaatattgacttaaacggacaggagatataatccctagttgagcaccaatgggcgtcagtctgaagtctgcgttatcggctcttacgctgattctgaattctgatctggaagtaaacattctatatggttctatgacgccattattgattagatcgtcaatgagcacaccaatgtacgcttcggaccttttcaagaccaattgctcccgttcttggcgcgatagtaatcctgcattgatacctgcaatgatcccctgtgcagcggcttcctcgtagcctgtagtaccatttatttgtccggccaagaatagtccatccaccaattttgtttccaagctaggctttaattgccgtgggtctacgtagtcgtattccacgccgtatgccggctgcaagatctcaacgtttgccatgcccgggatgagcctcatcatttgtaactggacatcctcaggcatagaattggatatcccgttcggataaatgacgtcggagttgaaaccttctggttccaaccatatcttatgggaagatctatcaggaaaccttagaatcttagcttcgatggagggacaatagcgggggcctttgatggtcgtgtcctgaatatgaatggattgatgcaagttattgcgcaaaaagtcgtgcatttgaggtgtggtatgtgtgccaaagcaatccagttgcttcgtgggttcgactgacacggtttcattcagaaaactcatagggacaggcaacgcatctcccttctggacctccagagcgctgaaatcaatggattccttggccagcctagccggagtgcctgttttcaaacgccctaactgaaagcccacctcattttgtagagtattgctgatcccatatgttggctgctcgccaattcttcctgctgcaatacgcttgtcgccgatgtgaatttctgcactgagaaacgtacctgtagtgattatgacctgatctgccccaacctgggtaccgtcatccagaaccacacctttgatgaccttgtggccacatccggggtcatacaagatcaagtcagcaactttgttctgcagcagagacaagttggggtgtgctttcttgtcggaaagttccctttgcatgtatttcttatataactctctgtctatctgggctctgggcccccacacagcaggacccttgcttctgttcagcattttgaattgcactccagcgagatcagttactttgcccatcagcccatcgagagcgtcgatttcctttacaaggatgcccttacccactccaccaatagaggggttgcacgaacacttaccaatatctgttaacgatggtgtaatgagagtagtatgcgcaccagtcctagatgacgcagctgcagcttcgcagcctgcatgtccagcaccgatgaccacgacctgtgtcttggttgtgggttggaagcttgtcaaagaagatatggtcaaccgcctcctgaggacctgtaagggaaatgaagtacacgaagacgccaaggttgttacacgcagcatcgttctttggggcgtttagctggtattctgcagaaactattggatgccctcaagatttaagtgaagaattaaaccgcacttatccgtctgtgaaagatgccaccatacgttaccaaccataaagaaagtggccgcacacaggtaccttagagaagccacaagggctcgattacacggtggcgatcaagagccatacaaaagtagaagacccccggatgaagaagcacctctttgtacgttccttctgcaacgccatatctaagtaacaagaaagaagccacagcattactacaaccccacacagggacagacagatatcataaacttgaatctactatatcatactctaataactacctaagcgttaagaaatcgtctaatcttcaactgccgttgttcataccgtgactaatagtggcagtaagcagctttttttttttttcaaaatttttcattttttttttcagttgactcgccccgtcggtagtgacaagtgccgactgactcgtgtcctggtaataacagcaataatgaatatgcgatgggcttgaacttggtatttaaactatgttcagaggcaagtgcaaccgctgttaaccgtcccaggagctaccactagtagcgcagttatttcttattactttcttaatcatagcttaagagaaccattctccctcccctcacaatgctcaacattctcgttttaggaaacggtgcaagagaacacgttcttgtcaccaagctggctcagtcacccaccgtgggtaagatctatgtcgctccaggtaatggagggaccgcaaccatggatccttcgcgtgtgataaactgggatattacgccagatgtcgccaattttgctcgtttgcagtcgatggctgtggaacataagatcaacttggtcgttcctggtccagaattacctctagtcaacggcatcacctccgtgttccatagcgttggtattcccgtttttggaccttccgtcaaagccgctcagttggaagcttccaaggctttctccaagagatttatgtcaaaacacaatattccaaccgcgtcttatgatgtcttcactaatccagaagaagccatttcattcttgcaagctcatactgacaaagcttttgtcatcaaggccgacgggatcgctgctgggaaaggtgttattatcccatctagcatcgacgagtccgtccaagctatcaaggacataatggtcaccaagcaattcggtgaagaagcgggcaagcaggttgtgatagaacaattcttggaaggtgatgaaatctctctactcaccattgttgacgggtactctcacttcaatctccccgtcgcacaagatcacaagaggatctttgatggcgacaagggcttgaacaccggtgggatgggtgcctatgcccccgctcctgtggccacaccatctttgttgaagaccatagattcacagattgtgaagcctacgattgatgggatgagacgtgatggtatgccctttgttggtgtgctgttcaccgggatgattttggtgaaggattctaagacaaatcaacttgttcccgaagtgttagaatataatgtcagattcggtgacccagagacacaggctgttttgagtttacttgatgatcaaaccgatttggcgcaagtgtttttggctgctgctgaacatcgtttggattccgtaaacataggaatcgatgacacaagatctgccgttactgtcgtagtggctgcaggtggttatcctgaatcatacgccaaaggtgacaaaattaccttggataccgataaattacctccacatacacaaatcttccaagcaggtaccaaatacgattccgccaccgattctttattgaccaatggtggtagagttctttctgtgacctccactgctcaggacttgagaacagcagtagatacagtatatgaagccgtcaaatgcgtccatttccaaaattcttactacagaaaggacatcgcataccgtgcgttccaaaactcagaatcatcaaaagttgccatcacatacgcagactcaggtgtctctgttgataatggtaacaatctcgtacaaactatcaaagaaatggtcagatccacaagaaggccaggtgcagactctgatattggtggttttggtggtttattcgatttggctcaagcaggtttccgtcaaaacgaagataccttactagtaggtgctacagatggtgtcggtactaaattaatcattgcccaagagaccgggattcataatactgtcggtattgacctggtggccatgaatgttaacgatttggtggtacaaggtgctgagcctctattctttttggactactttgccactggtgctcttgacattcaagttgcctctgattttgtgtccggtgttgctaatggttgtattcaaagtggttgtgctcttgtgggtggtgaaacttcggaaatgcccggtatgtatccacccggccactacgatactaatggtaccgctgttggtgctgtattaagacaagatatcttgcccaagataaatgaaatggccgcaggagatgttcttctgggtctcgcctctagcggtgttcattctaatggtttctctttggttagaaaaattattcaacatgtagcattaccatgggacgctccatgtccatgggatgaatctaagacgttaggtgaaggtattcttgaaccaacaaaaatttacgtcaagcaattattgccatcaattagacaaagactactactaggtttagctcatataacaggtggtggtttagtagagaatatcccaagagctattccagaccacctacaggcccgcgttgatatgtcaacctgggaagtaccccgtgtcttcaaatggtttggtcaagcaggtaatgttccacacgatgacattttaagaaccttcaacatgggtgttggtatggttttgattgtcaagagagaaaacgtcaaggctgtttgtgattcattgactgaagaaggtgaaattatttgggagcttggttctttgcaagaaagaccaaaggatgctcccggttgtgtgattgaaaacggaactaagctttactaatcaacaatattaactttataatagattcatatatgcgcgtacatatattatatacaatttttctacacaagaatgcttaataaagatacgataattttttgttcgcttttacttttccgcataattcttccagaaaaatacaataataaaaggacaattaatacctttaacgagcgtaaaatagtagcaagagaatactgttgaggagttgtagcgaattagctgtcaataatggaccaagaaggccagccattgctttcaaaagattttcagcaggttttactggctactgcatccggaaacaattcatcgtggacagaaagggctgttctcaacaatgaaagtacagatgcagtgaaacacgaacctgcgctgggccaaaatgatgtgtttgatttagatcctttatcctttgataagtgggtaccttttttaagaagggctcttgataaaaatcaattggaccccgtaattgatgaattggaaaattcaattgaggataactttcaaggtctggaattgcaattattacaagattcccaaatgaatgataagctggaaacatctatagacgaaattgcaaacatccaaggtatggtgcaagacactttatccagtgaaatttccaaatttcaaataagattgagtgaatcagctaatgaactaattgtcaagaaacaaatgtatgttaataacaaaaaaatttcactaaaaatttcagaagcaacaattttaatcactaaggttgttagaatcttggaattatccagcaaatgtcaagaattgatcaccgaaagaaagtttttcaaagttttacaaaacttggatagtctggagaaattgtatctacaagaatttaagaattataatttccaatttttaattgaaatttacaattctataccatttttacagaaagtcaccaaggatgagtgtataaatttgataaggaattctctaaatttaaatttagggaagaacttgataaaagtggggcaagaattcgtggcaatttatgagaatgaattacttccgcaatggctcgaaacgagatctaaaatgaagttgacaaatttcaaatttaattcgcctatagagatctccatgagagatgaatcctttctagcaaagctaaacttgggtgaatttttccagttagatgactttcacgattctataatgatttttcaaaacttaaatgagttgagcgtcctctctggagagtttaacaaagaatatgaactgagaaagacaaaactaatgtatccattgatatggaagaagaataaaacagctgcatatcaaatggattcgttattacggggtacaggtactactcctggatcaaccgcgcatgacgtttccacagatgatcctttcacacaaagtctaagtttacactttttgcaggattactttttgaaaattctcggcttcttattatatgatattaatttgaataaagctacagaatttatcctcgttgataataactataattctacaaatgaattttgggatggactcatggacaggttgtcaccatatttgagttatttcatagatgagaagctgaaaacagaagaagacatgattaaattgaaagattttctttgtatttatgttgccattttagaaaatttcaaactgaacatcgaacctttatataaaattttggtttcaattttcgagaaattctgctctgtttccttgagagcttttgacgatgaatttcaaatcttgttaaacgatgatgattttatgcctttatccattaatgacaagacattatatgagaaagttttgaagatttgctggatgaaggagggcgaacacctttccctgccagatccaaccaacggagagccatttgctgtgactttgcctttttctccattatacccaatgacgtgtacacttgctaagaaaacatattctaaaataaccgcatttctttccatattttatcgtcatgagctacacactttgaataatattttggtcaaaacaatggacgatatatttaatgatatcgtcaataaaaaaattcgttctaaacttgaaagtacgtcgagagaagaaattgcacaaatcttagtcaatttagattattttatcatagcagcaaaagaatttagtaacttcatgacaagagagaatattttacaaaacccggatatggaaatacggttatcctcgataaaatatcttgcggaaagcagaaaattggcagaaacaaagttaattgaattaatcgattctaagatatcagatattcttgaaactattgaaattgactggcaaataacggaggtaaggcaagacccggatatctccatcattgatctggcacaatttttagaaatgatgtttgccagcacgctacaaaatttaccatacagcgtccaaacattattgattttccgtgaatttgactccttgacgagacaattcatgggtctattattgcatgacacaccaagtacaattacacatgaaagcataatgaattttgaagttgatgtcaattatttagagagcattattcccagaattttcccctctacaccaggtactatagatagtaatggataccagtcgccaatgaccccttcgacgcctacatttccaaatgccaacggtgttgacgcaccaacattatttgaaaataatatcaaatcgctagaagctacatttatggagttgaagcagtgtatagagttattaaagactcagggaaaagattataatgaaccagaaataagattaagaaaatattcaagaattagacaggaagatgcggctcttttgttgagcaagattcagcacttcgtctcatctgtagaaggagctaacggcgatgacactagcgtaatggatagtagcagcatattcaactctgaatcagcgagtgtcattgactctaatacgagtaggatagccaaattttttaatagacgttaaaaaattagatattatctcagtataatcatttgtacgttcataagaaagaatttcggacagtcttgagttttttggttttagcatcgaaaaagttcacttcaaataaattttttttttatcattgaataactctttatttttcacgtcaaccaaatacatctcaaaagtctactatatattgaaaagtatcatacaattagtgtaaataagtatcttaattatgggtgaaaaacgtaaccgtaatggtaaggatgcaaattcccaaaacaggaagaaagtatgtctgtctgcacacgaattagagttctttaagtactaacgatcaaaagtaatagtttaaagtatcttccggattcttagaccctggtacgtctggaatatatgccacatgttctagaagacatgaacgtcaagcagcccaagagttgcagcttttattcgaagaaaaatttcaagaactctatggggatatcaaagaaggagaagatgaaagtgaaaatgacgaaaagaaagatctatcaattgaagaccagataaaaaaggaattacaagaattgaaaggtgaagaaacaggcaaagatttatcttcaggggagacaaagaagaaagaccccttagccttcatcgacttgaactgtgagtgcgtgacattttgtaaaacaagaaagccaattgttcccgaagaatttgtgctaagtatcatgaaagacttagcggatcccaaaaatatggttaaacgtactagatatgttcagaaattaacacctattacgtactcttgtaatgcaaaaatggagcaattaatcaagttggccaatttggttattgggccacactttcatgacccttcgaatgttaaaaaaaattataaatttgctgtagaagtgacaagaagaaatttcaatacgattgaaagaatggacatcattaatcaagttgtgaagctggtcaataaagagggttctgagtttaatcatactgtggacttgaagaactatgataaattgattctagtggaatgttttaagagcaatatcggaatgtgtgtagtcgatggggattataaaaccaaatatcgtaaatacaacgttcaacagctttatgaatcgaaattccgaaaggatgaagataagagtgtaaaacaataatcatatatgaaacagaatagatattttatataagtatatacgctctcaatcggaaaaccattgtaatccattattataatgagcaattcgttcccagggtagccaatcacccttagcgttaggaatgagacccattgaatttagtttcctgtatccaatgtacattaagacgccttggaatacgatatacatgaacatagcagtttgcacttgactttgtgttgctttattacccaacactggtttgaatgcactccttgttgaaaatattgctttaatgggtccagagagtagcatgagggcagtcattataggaatgatttgtaaggatgtaccggacatatacgacataaaaatattcatcggaatagatttggctggttgtaacgcaatttgccatgccttctgtacttgtaatactgttatttggtttttttgtgccaaagaagtagtttgagatgtagcatcttgttgttttcttgtaacatttcctttagaggaattaccttcaaatcctggtggtgaaggtaatgtgtttgagttctgaatgttgtatttttcgatatacttggtgtccaataggtgtttagcccattcgtaaggctcctgttcactcatttctgttgcttatatcgtttggctttattttaaccttaactgatattatgttcaactttttttcattctatttatatagaaaagaatacgctttttttattatttatgaaaggaacatgaaaaaactacgaatgtacaaaagcagagattgctagagaatacattggtcaagaattttcgcatatggaacgcattgctcttttagatgggctgttaaataatcgtaatttaggttagttattgccctttgcgtcttccgtggaacaatgttggtccaataaattataaagaaaagaaattggatagcacaaataaaagagcaagcgataatgcaaaacattaaaagtctgttttccattagtttgtaatattctgaggtcatcaataaaaaccattttttcgttcttgtaaaattgtatctctcatctgtattggatttttcgaccatttgaaaatcatccttgctttttcctttatattcagtcgaggaatcatttgctgtattaggctctggttgagaaacctcttcaaggcccttttttgggtaggctttcaataaatgtagaacattgccggatagtgtaataattcccattattatggttttgttttgcctggtttgggcctgactttagttatatgattatttttgtatagatagctataagttattgaaagtaagctagacaataatttttggtgaatagttggtgaacattcctgaactacaaaggactattgttatatttagtttacttcaattggcccccaataggcttcgtaatttttacatgtcacaaaattaaataaggcaaaacgagaaacaaaatattaaaaatgtaggaaaaaaaaagtcaaaattggtttgacgacttaacctaatcaatttaagtcggaatgatgatcaacaataacatctttaattttatcatgaatatctaattcggttaattgacccaattcatctatgagctcggcaactttatcatgcaacttaacatcctcctcgtgaacaatttcattctcatccattgtggatggatgagctggtttactcatatcagctttttccaaaaagtcctggttagtattttcatcgctttcggcacagaactggcctccaccaagaattattgaacacattgtccttgtttcgttcaagatgtcactagaatatgacatccaaacttcatcttgtaagaaggcatatatatctggagcaattagatcggtcttataaattttggaatacttcgcaatttcttcggcaattaatactaattgacccatataacctaaatttgttttctctttttcgtaaaattcaaacgaatccttgtggccttgtaaaatgaaatcagagataatatggaagtctttaacaggtaacttttggttgctgccgtacaaaggttttgggataaatcttgtagactttttgaaatcaaacaaagaatagaccaaaaatgagttataagaaaaatccattcgaccattgaatatctgctgaataatatcaaatacaatgttgtgccaaaagttattccaaggatatcttaagaataattgtagaaactttggaaaaaacccaaggtcatgaagtttaattttgaataaatctccaatggtagggtttttacgtattttcaaattttgcgtttcactgacgtaaggaatttcaaaactcatatcatcatcatcatcaatattgtcatcagatgtatcaaaagtagaatacaattcattatcatgaaacttttttttaatattttttttttgtttttggttgtcattactgtcattactatcattattattacatttatcttctaatgtattggaagtaatagtattatcatttatatttaaatttttcatggctttctctagtgagttttgatcaagagtgtccctgcatttatctctggtacgtgctattttttcgcctctttttgaattcatcaatcccatatttgaacagtgtaacatttccgatatcaattctgtaatcttgactctttcaaagcccaaaggcctgaatgattcatgcaattggttttctagtaggtgatgcttaacagatggaagagcttttgaagcagtgtcatgatcatcgtcatcatcattttcaagtttaattagtaatgcataaaaatcttccatatgcatagtgagctcatataacaaatggcccaaatagactggatctctttgagaaggcggattgtctactatggtggtacttaacaaatctacttcgtcatagtcggaattattcttcctgatcaactcaattataatagatacggcaactcccattgcatggcctctttgaaataagattatattaataagttggtcgacatattgcggagaggcaagctgtcttgtcaatcggttaggtccgatccacaaagtatccagtttaaaattggtggaaatgctgatcagtgcttttagaagctctccgctactgttttgaataccaggtgagtatttgctattttccaagagattcaaacacttaggtatcagatcctggtgatacaagaagtcaataatgttcgtaggtgattcaacttgatcagtcagcatgattttaatgagaaattcaaccaagggtgagacttcaatatgatataagaacttgtccacaatgttcggttgcgatttgaaaaattccaaatagctagatgtctgttcaaacagaagagtttcgttaatcttaaggaaaacagccaagataggacaattttctgcctcaatattttcaaactggaaaacctcgaacagagaggacaaaaatggggtattttgcacgagtgcctccactatgggcgcacttttcgaacaaaaaatactggaaataatgttgacatacagcattgggtcttcatcgtcctgatcttcatattcacctgtttgatggaatgaattctctaaaagaaatggggttctataaccagtgcggtctatgtccttcaggtaagccatcaacatgtccactaggtagtccatgtggcggacctgctgggaacggtcgtcatagaaatatcccaagcaaatgaagtcgacgagtctgtcgttggctgctccattcagttcatccagcaaagctgtttccaacaagatcctatcaataaatgactggttaaggtcactcctatcccgagactcggtaccaaattcggactctgactccatagaaggctcattcttcttgtcgtcagttgaagaggtctcatttccctccaaactacgaaaaattagatagtactcttcaagtatcgaatcaattccggaatgactcagcgtctctccaaagggccatagtgacatatttttattttattttagctttatcgaaaagcaagagagcagtaaactggacggtatagaagaaaagagaacttaataacaaaagaccagattgtctataactttatctcacaccaaataccaggttgtccttttcccgctgggtgaagcaaccgtttcacttattcgcacaatccaattagtagaacacaacacaacacaacacaacacaacacagcacaacacgcttaccaaattatatttactacggcaaccaaaaaccgacagaataaaaaacagccatcatacgtggatgaactcttggtttattgtctgttattatcctcgagagttcttatttaggggatttagggctggcatcaataccctaactaaaccctgaactgcccaaggaacaattttcaaaagtaagaaatgtcctatacgtttctatgtataaccctaagatagtcaggtttcggaaataaggcggatttctacgtacatgatgataatcatgtatcaaagaaaggatcaacttgaagaacagccttaaagtaagcgtaatgggcattctgtttcaaccaccatttctgaagtactttatatcttggatgcacaaaagctgttacatctaaacaagaacgcagcgtaacgaaatgggaaagctgataaagttaatcacaactctgacggtgttggtatcgttgcttcagtactgttgcgaattcaatagtgggagcatatcgtgtgaacgcacgcaaacgctttgccattataccaatccaagagtctggaacacctacttttcaagaaattgtgaattatacaaaaataaagttagtcccggtttcgatatagtggcgcgtaaatatgacacggctgtcaaacctgtcatcgatgacgctacagtaaaagtgaacaaggtcgctatacagcctgcattcaaggtcatccattcacaatgtaagaaatggaactgtggaaagtattaccaattggtccgctccccaatggtcaagactagacgatttttcttcgcaaaatacaatgcttttgtgaaacctaacttagacaaattctttactgcggagtttcgctctcatttgaaggaaagaattttaaagtataaaaatataggccattattactttactatcacttcaagatgcatcaaatccaaatacgactttattgttggtaatacagaggaaaaattaatgggaaagttcaagaataaggacacgcatggcattcatggttctgtcacacgtgagccttcctcggaggacatggttttaaccgtaagtactatggagtctgacgaagaggagctaactacaacaagtactcaaacagtggttgaaacaattactttggaccaggaagaggctagcgctgttgctaatcatgcgcacgacgatgaggcttccacagacgttgaaggctccacagacgtcaatgtcaatgaacaggctctgttgcaagaggattttgacatgtggagtgagactatattgcagaaaacacaagacgtcatacagctatttgaaaaggatgtttccaaatacatcaatggtaaattggttgaggaggccaaccattttaaagccaagtttcaatctttagatgataaatctaagaagttcttctccaagatttcgctagccattaacgatattgaatgtgtggaaggcattgatagtgaaactggcaagaaaattttcttcgataaatctggaagtactgagatttctcagtacataacgagagagttagttcgtgagtacttcaacgagacgcgctcgacgttagacgaactgacaaatgctatggagaaagatttgagcgaaatcactgatgaaattgaaaaaaaagttaatgcaattagagaggaaaacgtcgaggtatttgaagaatggggtgatatcattgtaaatgaatggtccaaaagaatggcttatgtggatgttatcaacgctcacatgggtgcagatgatgacactacgcttgatgaagagaaagcaaagtcttctgttaactggaagaagtttttgaagggcaagaaacagatcatagaatctagagacaagctggctcaccattccgctgacttatcccgtgttaacgcgtttaggcaaaaagtgcaaaagaagatattatcgttcactcaagagagtggtgagtttttgtatattctaagatcgaaagccaacctgcaatttcaggaacgtgaaagaaaggaacgtgaaagaaaagagcgtgaaaaagctgcagcagaagagttccaaaggcagcaggagctattacgacaacaggaagaagaagacgaagaagacgtatcctacacctctacttcgaccatcaccacaaccattaccatgacattgtgatgaaattcatgcgcttgctatacacacacacacacacacacacacacacacacacaatatctatctatatatatatgtatgttctttattgtttgtctttacctttatatataaacatatatagccatataagaatataatattaccactccactgtattttgtatcctgcctatttttgctagattacaggacgcgcgagcctttcaggggagggaactgatgaatcgatcaaccaaaagaaagagccaaaggattggaccagaactgttactgttatagcagaaatattagtagtacgttaaagccaagcgtcgaatttcagcataattaagaggaaatgtctgaatatatggatgacgtagaccgcgaattcattaactgtttgttcccgagctacttgctgcaacagcctgtggcttatgatttatggattttatatttgcaacatagaaaactctttcacaaactgaagaacactaacttaatcaacgctgatgaaaatcccactggcgttggaatgggcaggacaaagttaactgctttaacaaggaaagaaatctggtctaaattgatgaatttgggtgttctaggcacaatttcgtttgaagctgtcaacgacgattacctgattcaagtctataaatatttctatccagacgttaatgattttactttgagatttggtgttaaagattcaaataaaaattcagtgcgagttatgaaagcttcctcagacatgaggaaaaatgctcaggaactattagaacccgttttatccgaacgtgaaatggcgcttaactctaataccagcctggaaaatgacagaaatgacgatgatgatgacgatgatgatgatgacgatgatgacgatgacgatgacgacgacgacgatgaatccgatctggaaagcttagaaggggaagtggatactgacacggacgataacaacgaaggagatggctctgacaatcacgaggaaggtggagaagaaggaagtagaggagctgatgctgatgtgtccagtgcacagcagcgtgccgaaagggttgcggacccatggatatatcaaagatctagatcagctattaatatagaaacagaatcaaggaatttgtgggatacatctgacaagaacagtggtctacaatactacccccctgatcagtctccaagttcttccttttcttctcctagagtatcgtctggtaacgacaaaaatgacaatgaggcaacaaatgttttgtccaacagtggtagcaaaaagaaaaactcaatgatccctgatatttacaaaatacttgggtactttttaccttctagatggcaagctcaaccaaataacagcttgcagctatctcaagatggtattactcatttacaacctaatcctgattatcactcatacatgacttatgaaagatcaagcgcttcttctgcctctaccagaaatagactgagaacctcttttgagaactctgggaaagtggactttgcagtcacttgggcaaataagtcattgccagacaataagttaactatattctattacgagattaaagttctcagtgtaacgagtacagagagtgctgaaaatagtaacattgttatcggatacaagttagtagagaatgaattaatggaagcgactacaaaaaagagtgtttctcgttcaagcgtggccggttctagtagtagcttaggtggtagtaataacatgagttccaatagagtaccttctacttctttcactatggaaggtactcaaaggcgtgattatatttatgaagggggcgtttcagccatgtctcttaacgtggatggttccataaataagtgtcagaaatacggatttgatcttaatgtatttggctattgcggatttgacggtttgataactaattctacagaacaatctaaggaatatgctaagccttttggtagggatgacgttattggttgtggcataaattttatcgatggctcaatttttttcacgaagaatggtatccatttaggtaacgcattcaccgacttgaatgatctagaattcgtcccatatgtggccttacgacctgggaattctatcaaaacaaattttgggttaaatgaggattttgtatttgacattattggatatcaagataaatggaagagtttggcgtatgagcatatttgtcgtggacgccaaatggacgtttcaattgaagaattcgactctgatgaaagtgaggaagatgaaactgaaaatgggcctgaagaaaataaatcaacaaacgttaatgaagatttgatggatattgatcaagaggatggtgccgctggtaataaggatacaaagaagcttaacgatgagaaggacaacaatctgaagtttcttttgggagaagataataggtttatagatggaaagctagttagaccagacgtgaacaatattaacaacttaagcgtggatgacggttcattgcctaatacattaaacgtgatgataaatgattatttgatccacgaaggattggtggatgttgcaaaggggtttttgaaagatttgcaaaaagatgcggttaatgtcaatgggcaacattctgaaagtaaagatgttatcaggcacaatgaaagacagatcatgaaagaagaacgtatggtaaagataaggcaagaattaagatacttgataaacaaaggtcaaattagcaaatgcatcaattatatcgataacgaaattccagatctgttaaaaaataatctagaattggtatttgagttaaaactagcgaattatctggtgatgattaaaaagagttcatccaaagatgatgacgaaattgaaaatttaattttgaagggtcaagaattatctaatgaatttatctacgatactaaaattccacaatctttgagggataggtttagtggacaattgagtaatgtctctgcattgttagcatattccaatccacttgtggaggcaccaaaggagatatcaggatatttgagtgacgaatacttacaagagagattatttcaagttagtaacaacacaatactaacatttttacataaggatagcgaatgcgcattagagaatgtaatatcaaacactagagctatgctttctacattacttgagtataacgcgttcggttcaaccaactcttcagatccaagatattacaaagctattaacttcgacgaagatgtgttgaatttatgagcataaaacaagcaccttcaaacaacaaagccatgtgatatcagtcattatcttcccaaaaatcgcatattaatatgtcttaaaccgtttatataatgaaatttacttgacacctttctttttaatattctcatccaaaatacttcttaagtatagtatataattcatcgataattcctttataggccaacgaagagccactagacgtagacaccgaaagaattcgaagcaaaaacagtggtcaagccagcaaacaagctgccaattacacttaaaattgtgtagaagaagagtttcttaatgtatgaagatttagaaccgacggcgaacagggcagatgataatacagctaatgtaacgattaaaccacaaattgcaaattttggttgagtgtctaagtggataaatggctggaagctctttgaggaatggaactctttcttaagtgattacacaaatgccgagaaggcgaattggctatacttgttagtaattatgaattagaaaacaggaagggaactattcattgtcctgtgtgttgttaaaaacatcaaaagaatagcatcaaccagcgttacaggcaacgtacgtataattgttcataagtcattgtaaaccttgaatatgcagggatatctctcactgcttatgttttgcctatttacagtatacgttttatgtgtacttgcatccttcttcgaaaagtatttgcaatttcaaatttcgcgtcaaagaaaagagaagaccacccaaaagatatcatttcaacataggtagaaataaggcagaagatgatgggacgaaacggtattcggctagcactgaaaagatctttcagcacttatcagccaccggtagtagagattacgaatataacgaagttatggcccactctacgacctgaagttagggatgaaatcaaggaatacttacgatggaggatgcaagaagattggagacatataccgctggaggagaccaaagcagcgtatttcttatcttatggaccctgtggtggcagatccaagggcaacgaatggaacgtagggtacacgggaatgcggatagtgttcaaccttgttttatttggcggtgcagcgactgcattttataattggaaacaagataaaaagctagaggaacaattaagggatcttgtataaattggaagcaacaatagtatatatatatatgcgcttgcgcagagtacgttctattcattttttatcattcattatctatccctgtaaataaactaatataaaaattcaaaaaaataatgatttcgcccaggatcgaactggggacgttctgcgtgttaagcagatgccataaccgactagaccacgaaaccacttaattgaaatatacaaccccaagataagatacttgcttcatagtttagttgtaaaattgaagttcagtacaacatggcactagtataaaaaaaagtttaccagccattactgcgcacttacctacattagtcactcttagcgtatattctaaatacgcttagagacgtctccttactatttttcatacgtataactctcaaaggacagtatagacatatccctgggggcttttagagtgcagcctctggaggtctacacacgttaatagtctcaaaaaatacgctaatatttgttaaataagcgaataggtcttcatgtgcgcctgaatcagtagctgtctacatggtaaagagtaatttgttgacacgaaaattgatagttggttaaaaaatattgcagattcaatactacatgaaagacttaattacaagatagactgatggtgaaaaaagaatgtacaggtttaccggcaaacattttgagaaattaaagcccaaaaaattttgtgtaccttatgattttcctcctctgtctaatccagttccgtatctgggtactgctgcttctttgttaaaatcgcagcatgcttcccattgttgggaattgactttgagcaatatttagttagtaactaccatataggtgactgtcgtgtgccagctataacagaaataatcctttcaccatgatcattgtaaacgatcaaagaaaactctgaagggactataatgcagtcttcatgcagacacttgaaatatacgacattagtagctcccaaggtagtaggcacatcctgcgtaaattctccacaaccatgttgtatatatagcagccatagtatgaccgagcacatgggacgtacgaataaaagattttctcagatccctgaacttgagcgtcaaccatgaatttctctacttttttttcgagcagtaattaccattttaggtttgattacaatcacagcttcagcagaatttgatttcgacgtaggctatgaagagtttgtccgtatcaaccctgataagaccttcttagaaagtgagattggcctttacgttggttggaccgagggtagtcaacggcagataacaacgataccacataattccacgttggcggcatcactacaagagtagaatggttgtggtggtaatggcacagaaacctccatcgctacgtccacacttacgatgagtggtatacctatcgctacgataatgaagcacagaaaaagtgtacttatcatattaccgcaactatgtacgtgaggtgtaaattatggctctcataggacataagtaggacagaaattgaaatttttgtgttggcagagcgaaagaaacttgaattcgtttatgaggaataaattctcagctccatccatggttccagttgacgctatgatacgcaaattcctttgtgatacaggtatcatttctgcaattcctcgtagattgttgatcataccataagattgatgctggggaaagtggagaagctaacttaacgattgaggccttggcaaaccctgttaaaccagtactatcggccttaacatgcgacttagagagagagagagagagagatgtttgcgtttgcgtcatgatagagatgctacatccacatagttgttgtagacatgtttaaaggtacaattctgcaacaacgccttgaaattttccaaaactaaccaagcacattggagttacgcttatatagtaagccacttcacttgcgttgctgtaaaggttgataactacaggtaggaattaatgaatgttaaataaaaaagggaaataccatcatctcgacaagaaaggcaaaataacttttcaatctcaccaagacgcgcgaacgaaactcgtgcgtctatattagtatcttgacggcgcttttacatcattaaaggtgtaataaaactgaagtcatgcgatggcactgaaataatcaaagtaactatttgtgatggcatgcactgtgatatgatctcaaggaaaaaaatgcaatgtcgggcgccaatacttatgatcatgcttagtctcgacattgaccttgcttgctacagtaatctggtgtccgagtagtgacatctaggtaccggtgagaactatatcttcattactacacttgtcgcccctgaatattatcgctacacacgcgaaagagctcttgttaaagttactctcgcatcattgcggtacatgttttgcatattcatctgaagtaggaaagggtataagcagtatatgatgtaccatctgcataagcggtgtttaatgcgtacctatcgtttaagaacaaaaggaacacacccacacccgctccaataccatattgagagaataatgaggtaacatatgcttctatttggttcgataagacggctactagtccaaaaaaagtcaaacaacaatttcaacagctacattctgaagatagaacgcatttttgcctgaatattgcaactcaatagacattctaaagtgctacgagaaaaaagcttgtaatggaccatggcaatgtgcgccatatatatatgcggctcccttatgagtagaagaaaatatatgactggtggtacaaagtggcatggtggtatatagatgtaggaacaccatttgagtttgccataatgattaaatttccctttttataaagaattagccgcccataacacgaaaaatatcacagttgacgaaagaagacacgtcgcctaaacgcgtaatgaatcgcaatatacgaaaagctaaacgggtttttcagaatcctcttacccagccttggataatagttttggccgaaaaaaaaaaaaagaaagaaaaaaattgaaatttcgcgatccgaacaaacaatgaacagaaaaacagaatatatataacgctgccaagcctatttcttgttgccgattaattgttgacatcctcttaattaccaaaagagcctaagaaaacaaacacactaaccacacagtatctttcgcccgaatgtctgaattgaaaacaggtcatgcaggccataacccttgggcttcagttgccaattccggtccgatctctattttatcctactgtggttcctctattttaatgacggtgactaacaagttcgtcgtcaatttgaaggatttcaacatgaactttgtcatgcttttcgtgcaatctttggtttgtactataaccttgattatcctacgtatactgggctatgcgaagttccgttcattaaacaaaacagacgccaagaactggttccctatttcctttttactggtcttgatgatctacacctcttcgaaggctttacaatacttggctgttccaatttacaccattttcaagaatttgactattatcttgattgcttatggtgaggttctcttttttggtggctctgtcacctccatggaattgtcatcatttttgttgatggtcctttcttctgtcgttgcaacttggggtgaccagcaagctgtggctgccaaggctgcttcattggctgaaggagcagccggtgctgttgcctcctttaacccaggttatttctggatgttcaccaactgtatcacttctgcattattcgttcttataatgagaaagagaattaagttaactaacttcaaggatttcgacactatgttttacaacaatgttttggctctacctattctattgctgttttctttctgtgtggaagattggtcttcagttaatttgaccaataacttttctaacgattcgctaactgctatgatcatcagtggtgttgcatccgtcggtatttcttactgttccggttggtgtgttcgtgttacttcgtctactacatattcgatggtaggggctttgaacaagctgccaattgccttgtctggtttgattttctttgatgctccaagaaacttcttatctattctctccatttttattggtttcctatcaggtattatttatgctgttgccaaacaaaagaagcaacaagcccaacctttacgtaaatgagaacttacggggggtgcaatttattttttttttttggtttattttattttatagaggcatctaatgcaagtagatttatatacaattatacttaaaattgatataccttagaacaggtcggacacaacgtgtggtaactccaatatatcactaatgacaatagcgccttctggtgtttgccccaaaatttcatttacttcattctcaactaaatgaatacatgttttcatgcccaatttgatacctgtctcgatgtttttcccactgtcatctataaaataagcattctcgtatcttgccaacccgctttccttcatggctttttcaaatgctttaacatgtggtttgcagaccagcgtatctgtcctagagtagtcacaatatgtcaatccatcaaataaatccgctatacccaacaatctcaggcaacgtattgcgtggtttttataagcgttggtgaaaagccacaatttatcaatctttcccgattgtctcaatctcaacagcatattccttaatggtatatcaggtttcaagatatcttgtagtggtaaggaatcatccacaagccggttatattccagtgcgttcactttgtggaacattacaagtccccttatggcaagtccatactctttgtagtaagagttattcaaaacgtgagcatcttcaggtgatagtttcaagtgtgtttgaaagaacctcagtatagattgttgcataagatcgtgaattctcgtggatgatttatagagacagttgtcgatatcaaaaaagaaaacttttaagttcgggttttgaggtgtagcagaaatatcttgatcgatcggaaatgtcactttcgaacctggatgagtcaatgattcaagatgtgctttattcttggcaatttgttcgttcacctcattctgataggttgccaaatcggatgcagtatattcaacagtcatgaagcctagtaatgattcggtccaagagcttactcatgtattccgaaattaattcaggtgaaatgggggagtaatatgatatcaagaaggcgatcacttattgaagtccacatagatacacacagataaacatatatatattatgtatatatatatatatatatatatatatatatatatgtatatatcaacgcccataccattatcattatcaataagtttgcgaggcgggtaccctccctcgtgctattatattactgttgccttaattgagtaatttgatcgatgactaattgcaagagattgtgattgttgtacgaagttataaaatcatccacaacactcgttgagttttccagtggtgaaggtaagcgggatgagatctgagtcttaaactcttgcaattgagtaatcaatttatttctcaaatctgtcagtgtctcttgagggcatttatacaattctaagttttgtaggatttcaatcgtaggctgcaccgtttgataaatttgcaacgtggtatcattggttaaaccttttgaatagaataccgctgtatcaatatattgtttcaatgcatcatcatcaagtggagatacagtgccatcattgaggttcgtatcattatcatggaagatatctaatttatgaagagtttcaggctccttaagcttggctctcaaagtagagagtgtatccaaatgtgtgtttatttctttcacggttctccgaatgagatggtctctaaaggtggacgaattcacaaaatcgacaacaatcgcgtccttatattgctgattggagtgatattgatgatctttgctgttggcacttgatatcagtaacgcttgaacgttatcgttaaatagtgtctcgaatagggattcattgaatatagaaagtaaatcatcgtcccacttcgaggaaaactccgtgtttagtaaattgtatagttttacccactgtagtaaagttaagtttaatgtcttcatagagtccaccaagaacttctgtagtcgacaacatttgtccttgacaagcgcttcaaatttggaaggaactggtatcaaagataattcgtggaaattcaacagtagctcgtcgaatatccgcgacggagtagtggaagtaactatacgattacagaagttgttgatggagatggtccaatttgaaattactaaaatgttttgcgatggtatgctgactttttcttcgtcacgaggtggtgatatatgggtagtggtttggtatggtagtggagttaacttattcaactgaaatttttcatcattgaaacacagggatttaaaatcttgatcaacatttttcaaattgagcgacaagtcattaacagaatcggtcaagcttaagatcttgttatagttctttagcaaattcttttggaaggcctcattggttttagtcaaatcgttctgtaactccaattgataatctttaatctgtggaatatgagaatcgcgaaacaatggtaagacttcatccattttctatcgtattggttttttttaggttttctaccacaagatttgttgtacgaatgtgttatttattattcaccgccatgtttcatttttcttcagcataatgatgaactgtaacagaaaataggaaaaaaaaattgtcatctgagaaattgctttggatgaccagatccaaaacagacataagcattcgtataattggtacataggtatatatcaaataaaaatatgcattattctaaaaaaaaaaaaaaaaaaaaaaaaaaaaaaatcaaaaatgtctctctaaagggtgattataaaaaacttggtttgggcaagtttttagcctcccttggaccattagtggcgaaagtggagcctgcataagagtgactgagttttttggcactgccattacaacccattggtattatcccttgagagccatgcggggattgtttctggttcagaagcagattctttaggttctgactcagtaaacgagtatcatctttgttgttctgtcgtggcgtttctttattattctgtctgttttttttacctaaagtagttgtagaggaaggggaagaaggtggagagtgcttcttttgattaaatgatggtttcttgttggaagaatggccgaagttaggtttctgaccgttaggaagagtttgaggaggtggtatatctgtgatatagttgttattattggcgttcttagcagcatttcccctcgcacgattatttctagttttttgtttgattagattatttgtcttgttcctgccagccgatggcaacagcctggagctgttgaaatacatggtatccgtcgacatgccttgtaatatttgtgtgagtatatttgtgtgctaagtgtaattacgttacgctttgctgagtacttcgtcttcaatacagagtatgttattgtccttgttatttgaagacttttaccttttctatccgtatttctctatccgatacaacaacatcattttacacgaacagccggatgataaaactgtagtacgtatggtatttgtgatatcctatatagccatataattactagcagctatgcaacagtcaaaggatcgcaatccattttgcttacgactacttcgtggccctcatcttgcaacaagcccttcataacgtcttgaaggaatccacgctcagtatttgagtggttgcaaacaataacggtcttgcccatttctttccacttcagtacttcatgatgtgacatttctcccgtatagtaaaggtctacgtcctcttttagttgcttaaacacgccagaaccgctcccggcacagacagcgacttttttgattttgagttgattccatgcggatggagcagcaagagatgctacttgtacatagggaacccgtaaaacacgcttgacatttttgacaatttgctccaaagagatgtctttattgaattctacgaatctaccgtagccaatcaagtcgtcagtttcgccacttacagtttccaaggcataagactttgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatgacaggtgaaagaattgaaaaggtgaaaataaatgacgaatttgcaaaatcacatttcctaacaactcagtggagagaaacaaagcgccaacgacactataagatgcccgttactgaacagggactccgcgagaggatagaatcagccataccgcaagtttaccatatcattgtgacggatctttcgtacggttgtggtcagtcgtttgatattgtggtggtcagcgacttctttcaaggtaaaagcaaactaatgaggagtcgtgcagtgaacaaggctgtgaaagaagagctgcaggagattcatgcctttagctgcaagtgctacactgaggaggaatggtctaagattgtggtatgaaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgctgttactcctatcgaaaagtcgagactgaatcttggttatcgtagccaaatcgtactggctggaatctaacactgttttaggtaatagattgtgggaacagtagaatggctttaccaattgttttgatgatacggttgatgactttggttgtggaaatgattgcgaagagtagtaattgtttaaagagggcatccttgatataaatctgtacaagttttgtctttccaagcaaccaggtatagcggaaagagaattcatcacagtggaatgtagtgacagtgttgacctcgacgacacaatgcttgaaagacgtagcatgtttattggagaaagctcttgaaaatctgatccgtccaagattacattcctagacattgtagtttgttgatgatgatgctctcttttaccagggatggtactggtgctctcgccgcgattggtgaaccagttctgtgacgtgttgaagatcaaagaaggaagaacatccttgaacactacatgcatggactcttttagccttctctcaatggtgctttggagaatttttacagaacaatcaaacttaaaatccaaatcaacgtcattaaaggatatcccaattccagggttctttacaaaaatattcgtgatggcttctagctcgatggaactgaacgtcatagttataggaattgtgaacgatccattattgatgagctggggcatggtaaagctgggtgtatcctgttcgttaatcaataaaagattcgactctatgactgtctgtatccgcaacatagcatccttacatgaaatcttgcaaatccccttggccagagacttgggctgcgtgataatgtctaggtccagaatttctagctgtggtattgtaggaaaatccaccttctgtaccttaattccgcttttcaagatatctaatttctttttagacggtgagttcaaagccgtagataacttttcccgtattcgttcattgaaagagttatcaccaaacacagcttcgttgaatctaaatgacatgacgatgctgaagtttcttgcagttgtgttttttttgttataattgttactgtttctatgttttacgaatcttccatgactcttctaattggtctctttttactacaaggcttcatggccctttttcaaacctaatttataagttctttgccctatgcttaaaacagtttagccctatttaatatagtacaaaaaaggaaaaacctaattgaaaaaagctattcaccctaggtcattactactttttcccttagctagccgtgtttttagtttttgttttgtttattttacctgtattatgccttgtttgatgactttagtatgggtttggtttgtcttatccttggatacaaaaggaccagatacattcacgtctggtcggtagaacatcggtatccagtatagtgttcagctgttcctatagagacaaaatttataatctgcgtgtaacaaatatctgcaggttaaaaaagtccagatcagtgtttcgaagctgttgatttttctttttttttttttatattaaaattttcatattccctgattgcatcgtttatctgattatcatttcattgcattctttaactacttgagttttctttccagctgtatactattgacactaacatgaacgtgcctgaaacaagacaatcctccatagtcgtagctataagagtaaggccctttacgtcaatggaaaaaacaagattggtcaatgaagctagtggtgcagaagctaactttcccggtttgggggattcgtcgttaatattacccatgagtaataactccgactccgatatagacatagacgctgaagaaggttctacgcggagcaaaagaaatagcttgctgaggagaaaagtaattagaccggagggtatacgtaaaattgtggattgtgtggatgatagaatgctcatattcgacccagctgatagaaacccattgaacaaagtgagtgatcaggtcctgaactcgatgcgtgcaagggccactaaggccactgcgtcctctatcaataacagcaatgctacgaacaaattttcttcgcaacgtcgaaggcacggtggcgaaatcaagtttgtatttgataaattgtttgatgaaacctcttcccaagcccgtgtatacaaagagaccaccagcccgctcctagattctgttttagatggattcaacagtaccgtatttgcttacggtgctactggttgtggcaagacatatactgtgagtggcacaccttcacagccggggatcatatttctagccatggaggaactattcaataaaattacagacctgaaggacgaaaaagacttcgagatttcactgtcttacttggaaatatacaatgaaagaatcagagaccttttgaaaccagagacaccatctaaaagattggtcattagagaagatacgcagaaccacatcaaagtggcgaatttgtcgtatcaccacccaaatacggtagaagatgtgatggacttagttgtccagggaaacataaacaggactacgtcaccgacggaagcaaacgaagtatcttcacgatctcatgcagtgctgcaaatacacatcatgcagacaaataagcttgtagacttgacctcgcaacatacatttgctacactttcaataatcgatctagctgggagcgaaagagccgccgcaacaagaaaccgtggtataagattacacgaaggtgcgaatataaatagatccctactagcactgggcaattgcattaacgcgttgtgcttgaatgatggcagcagaagctgtcatattccatacagggattccaagttaactaggctgttgaaattttcactgggtggcaattgcaaaacagtcatgattgtttgcatatcgcccagcagttcacattatgatgagacattgaatactttgaaatatgcaaatcgtgctaaagaaataaagaccaaaataatcagaaatcagcagtctttgagtagacacgttggatcttatttgaaaatgattacggaacaaaagcgacaaatcgaagagttacgcgaacgtgaagagaagatgatttctttgaagctaacgaaatacaaactaaacaaagaaaagatccagttagccattaacgagtgcgtcaatcgtgttcagcaaacgtatgcaggagtggaaacgtatcaagtagccaagaccttgaaatcattaatactttgtaaaaggcggtttttgcaaatggtcaagctagaagtggataatttgatactattatttgaacgggaggaaagtacagccgccgagatgcagccggtgattagtaattgccgaatgatcagtggtcagctttataacaaaatacacgagttagaaatgaaatttgatgaaaccgacactctgagttccgtcattcatcaggtacattccattgacttgaacaagttaagagagatggaggactgggatgaaacttacgacctggtgtacttggagtcgtgtttaaatcaaatatcagaattacaaagaaacgaaatcttggttaattcctccataatgacagaaaaattaatgtcagatccgggtttgaactcccgatttaaatttctatcaaagtggctgatgaataggacacctaacattgaatccataattcaagacctggttcatatcgacgaggagtttgaatcttttgccagaacttttatcgccaatcccgatagcaattttacaaacacaaatataaatataataaacacgacggcagctgacttggctgttcccgctgagaccctacaacggcaaaatttttcccaaaaaaaagtaaagtggacgagtcccgaccttagtcccagccctatgattgaaccacaaccggagctagaaccagaactacaccaagatcaagacgccattgcaagtgaagtggacgtaagtatgcaagataccacattcaatgagcaggggccctcgaccccctccgctccgactacagcggttccaagaaggaagatgcgctcctcccttcttactcatcaaagtctactggccactgccaggaaataacatacatatcctacgtaaactatcgaatataacttctttccgccagcattaaacgcatttatgttgattaattccgggttacgggaaaaatttttctttaatttcttttttttgaatttatttggcacgagaaaaggttcaaagtgaataattgcttttagtcattagacacattacctactttctaagagattctaaaagaaactaagcaccacaaatcattgatcttttaagaaaaacgcacaaggatcatatactagattctcgttctcgttttttcttccttttttttttctctaaagccttttactgggttaatttcctttattgacccaaattaaaagaaaacgtttctcaggagactcttttaagcaaaatttagcaaatttgtgtttgctgttgtttttacagagactgcattacttgaaggtttgcctttaagtcttcgagtcgtttttttttattaactttaatcctttttctgtgtgtttgtgtatattcagtggggttattttacagtattcgaagagacttcgtttcacacatttaaaccagctttattagcgtttagcttatacactacaaggaattttttttttctttaacattattaagacagttattgagttaattcgtcttcagcccccctccccccaacaaaccccccttcatatagaaatggctaatactttcaagtattatcctgaaacgatgggtaattctagtggttatccaattagtttgccttttccgaaaggttcggctacttctgctgttaatgttgctaggcaactgcctaaatatttaggtcatgttccctcgcaatcagttcatactcagttgccatccatggcttctttaggttacttcaatcagccaagttctacttactatgctcctcctgcaccacttcaacagcaccagcaaccacctatccttccccctccgggcctaatgtacactagtaacaataacagcaacgttattcctcctcctgttcaaatgattcgggatggacaacaacaaccacaacaatctaaccaagtaaatgggggcgtcagtgagaacttggactacgatatttctataatgtcaaaatttatcatggaaaatgcctttgttgccttcaacgcgaactatagtactgatgaccagaccactgatctttttttcaagggcatatcttctgtgttgaatgccacgagattgccttcagctactatttttttggctatagattatcttttcaagtatatcaataaattatctaatgggatacattcaattggtggcaattcgatcaatatcatttatcaaaatactatgattgcgttcatattagcaaacaagttcaacgatgacaaaactttcaccaataactcatggtcacaggcaacaggaatactgataaatgttatcaatgatttcgagagacaatggttgagaatatttaactgggaattgtatgatagtgcttttctttattttgagttcgtcaagaattttgagattttcaagcaaaatcaactcaaacctgctgtagcggttcctacgttattatctccaattgtcaacgttggtgatacgagaaacgtaaatttcaacttgaagcctacttccacaaacaacctattatctccagtttccaattatgaaacccccatgctgatgccgcataacatgttttcatcaccatcttatcagagtaactcaaggtctgaattttctagtatgaatggttattataactattacaactataatcagccaagattgaattactatcaacaattccccaatatatattcttcaccaatttcggaaactcagtttgattacgacttctacaatttcagtagtcaacaacaacagcaacaacaaaaacaacactcacttttacctgccgctccacaattacctccccctcacgtccataatcagtcttacggtcatcatcttggctggaagtcaatggatgacacaataaatcattcaagatttgagcgaaactactttccgtattcggcagtgtattagtgaaaacttttttttccttattttttctttgatcccatcgaattactttctcttttgcccaggatcatctttctaatctatcattttattattttctctcatgagaaaacagaatttcgaaacagatataataaaaaaattgaaaaatttgaaaaaaaaaaatctagaaacatattttcctaaaatgaaaatcggaagctaacaaaatttttgaaaaacgaaataaagaagaaagattattattattagttactttttttattgtactccagtatggacctcttaggtgagtgatcttattaaaaaaaataaaaaaaataaaaaaatatgaaaaaaaaagaaaattaaaaactaaacaaattttatgacaggaataaaaactataaaaaatgaaaagcaaaaaaaaaaaggctactggatttttaacatcttgtccttttctttccctttatcattttttctcatttactttgttattaattttttttttcaagttctccacatatacatatgtaagaattgagtctatctctttctaatatttaagaaatacataaaaaaaccaattttttttttttattactagcaaatttatttttgtgaagtgaaattcatacattggcttattaaaggtattaaatattactgaaattttatgaaccaaaaagaataatggatgatgtaaggttacatgcaatatatcaagatattactagagattatttaccgccagcttctctaaaccacctgatgcttctatctaaacaaacacagcataaactttcatttaaatcagctcccataccagatctccaaccttttttcaaaaacttcacgtcaaagacaccaggttcagctaaagaatctccatgttcatcaacagctaagatatcctcttcaatttcaatatcatcacaatgcatattcaatgtagtgattctttcctttgtttttacatcccaaaatctcaatttaccatcccatccggcactgcataatgtttcaccagaatcattaaacgatagactcatgacccagctagaatgtgcaaattcacccagacttgcctgcgagctatgggttggtacggataaggagcctattctttcaccaaattcagtttcatatagagtgatgcaaccaaatgaatttgaatcgtgagcaatggctaataaggatccttgaggagaaaatttcaccgatctgatggaattcgaattattaatcatagaatgctgagattcaaaattgtacaacgggcgtaatgtagatagttctgaaatttgtactgttccattattaaaacctgtggcaattagtcctcgttcagagatatccacagaagtggcaaattgacttggagtcataggcgattcgacagtgccttgtaattctaacgtggggctccaatttagtgttaaagaatttgactcatctgcaaacgggtgaaacttccaaatgtaagtggtccctttgacgtctgtagcaaccagcctatgggaaagtagtctgtcatttgaggcaccccattttaatgcccaaaaggaatgctttttcatgtctgagtctagaagatccaatttctcgaatataacttttttagtctcatcttctctagtgatacgatagaagagtaaatcgccagaaaatgaagtggtagcaacaaggcataattcaaatgcatctctctcaatagcttgcaagacatcgacatggtgcaatccggacttatggacaaagtgagaatatgacttatcttttggattttcattatctaacagcttattatcccacacctttaagtaaccgtcacctgaacaacttaccgtaaatgaattgcaagcagaaaccgagaaaatatcagcgtcatgagctttacctgcatttgctgtggcaataaacactttggacatttttccaatacttgattaacctctttttcgtttcttgtctttattttagatttgttttaatatcgcctaatttttccttctttactttatattttttttatttttcgcctaaagatttgtatcaattaattagccaacaaaaacaaaaacaataaagtcatataagggttgataattgatattgatggcagctaattctgtagggaaaatgagtgaaaagttaagaatcaaggtggacgatgttaaaatcaaccccaagtatgttttatacggtgttagtacaccaaacaagcgcctttacaaaaggtattccgagttttggaaactgaagacacgattggagagagatgtaggaagcaccatcccatatgacttccctgaaaagcccggtgtattggacaggaggtggcaaagaagatatgatgatccggaaatgatcgatgaaagacggatcggactagagaggttcctcaatgaattgtataacgatcgttttgattctcgatggagagacacaaaaatagcgcaagacttcctgcagttgtcaaagccaaatgtttctcaagaaaagtcacagcagcatctagaaactgctgacgaagtgggatgggatgagatgataagagatattaaattggatttagataaggagagtgatggcacacccagcgtgcgtggagcactaagggcacgtacgaagctccacaagttacgagagcgactagaacaggatgtgcaaaagaagtctcttccaagcacggaagtgactcgtcgcgccgctctattgaggtccttgctcaaggaatgcgatgacattggtacagcaaacatagctcaggaccgtggacgacttctgggggttgccaccagtgacaactcttcaaccacggaagttcaaggaagaacgaataacgatttgcaacaggggcagatgcaaatggtgcgcgatcaagaacaagagttggttgcactgcaccgaattatccaggcacaacgtggattggccttagagatgaacgaggagctgcaaacacagaatgagctacttacagcacttgaagatgacgtcgataacactggtaggaggttacagatagccaacaagaaggctagacattttaacaacagtgcttgaattaatgagttactatccgggttacaaatcctgagagtatatttgtactaaaaaaaaaaattgtaaatctagtaattgaaaaattttggcgatgagacgatatggtaagagtaaagcaaaggaaccgtcatgtcgtttactgctccttcagatcccgtcaataaaccgacaaaagtgaaggtatcacagttgtgtgaactatgtcattcaagaaaggctctcattagaagacccaaaaacctgtctaaactttgcaaacaatgcttctgcctcgtgttcgagacggagatccataacactattgtagcaaataacttgtttcagaggggagaaaaagtagccgtgggggcctctggtggtaaagactccacggtgttagcgcatatgctgaagcttctgaatgaccgttacgattacggcattgagattgtactgttgagtattgacgaaggaatcatcggatacagagatgattccttggccacggtgaaaaggaatcagcagcagtatggccttcctttggagattttttcctttaaggacctctatgattggacaatggatgagattgtatccgttgctggtataaggaacagttgcacgtattgtggtgtttttagaagacaatcattggaccgtggtgctgcaaagtgggcatatctcacgttgtcaccggccacaatgcagacgatatggcagagacagtactaatgaatatcctacgtggtgacgtagcaagattggaaaaatcgactgcgattatcacacaaagtagcggctctcccatcaagagatcaaaaccatttaaatattcttaccaaaaggaaattgtcctgtatgcgcactacatgaagctggattatttttcactgagtgtacctatgccccagaagcgtttaggggcactgcgagagaatacatgaagaatctggaagcagtgaggcccagttgcattatagacatcatccaaagtggcgaaaatttggcattaaaggctaaaaaatctaacgctggaaagagagtcgtcaaatttgttgaacggcaatagatgcgctagatgtggatatctgtcgtcaaataacatttgcaaggcgtgcatgttgctggaaggactggagaaaagtagagcccaagtggcaatcgagaatgacacttctgccgatggtgcagccttgaagctgagagctcttgagaaactcagcttttgacatatatatagctcgcagtagaagaatgcagcgtaacataatataatataatatagtacggcgccgccctccattagaacgcgcaacacaataaagacaaataaaagaatcagctataaagctggccattgcatggttcgcgctggaaagagaggaaaagcgtggtgataaagagcgaaccaagcatattgttttccaagaatgagcaacgaagattacggatacgactacgattatttatttaagatagttcttatcggcgactccggtgtgggtaaatctaatctgttgtcgagatttacaaccgatgaattcaacattgaatccaaatccacgattggcgtggaattcgctacaagaaccattgaagttgaaaacaagaagataaaagcacagatttgggacacggcaggtcaagaacgttacagggccatcacgtctgcgtactaccgtggtgctgtaggtgcacttatagtgtatgatataagcaaatcaagttcatacgaaaattgcaaccactggcttaccgaactgagagagaacgcagatgacaacgtggctgttgggttgatagggaacaaatcagatctggctcatttaagagcagtaccaaccgatgaagcgaaaaatttcgcaatggaaaaccaaatgttatttactgagacaagtgctttaaatagtgataatgtagataaagcatttagagaactgatcgtagccatcttccaaatggtaagcaaacatcaagtagacttaagcgggtcgggtaccaacaacatgggctctaatggcgctccaaagggtcctaccatcagcttaacaccggcaccaaaggaagacaagaagaaaaaatccagcaactgttgttaaaaattttgtgccctactaaggtcgcatggtttcatgcatattctgtctacatataacccccgttaataatgcttttataaatataatcaattacatataccttcccaagttatttattactaaccttcgtgcacgcaagaaaaaatgtattaacgtacatacattttctaaatagacctttcctgacgcctgcattttgcaatagccgaagataagaatatgattttttttttacgatttaaatattctgttgttgtgcagtctaaaaacacacgtgtatgtttttttccgcacgcatgagcagaattagacggttttataaacgttcgctctgtgtatttcacgtaccttcccggatacaaatttcgtcatggtttatattggaagtttttccgaaattgcgggttttgaaggtttatccgagacgacgtgaggggtaggcaggagaaggaaggctgtttacgtacgcaaggatggggtacgacaatgattcaatttctgttgctaagttttttgttattttttcatattggcctactcatctttgatatcattattttttcgaatctacattagagcgtgtttcggaaaacaaactcgctcgatacagtaattggcagttttatttacggaaattaccgttctcggttccaagaaggttagaaaaatcggttgtcgctctttctttcccccacttgtaaaaacaaagaaagtataaaatagtttatggcccttaaggcaggccttgttgaatttgagctatacctaccccaatgatagttctgtggtagtttgtttgaatatgtaatatgagaagcacgatggcaaacgataatcttcactgagctgatttacgagcgaccatcatctccacggtgcgaattaataagctgtggcgatgtgctgtagttgccctatcgcccctgcggagcttgcgtcaactagctctcccctttccccattgaagttagcgtattaacctacagttaatgattgataggctcatcgaagaagaaaaagccgggataagaaaccccgcctccacttttttggctcatccgaaaatttatccgcggagacatccacggagcacccgcaaaactgaagtaataactctaaattatatgccgctgagaaaaatctcgtacgaggatacggtaaataatccgtgcgagaaagtttttccgaaaatcattcccggtcaaaagcgtttctggtatataagcgattgggaaacccgtctataatacgtagtaacttacgatctgcctgtcaaattgtgtgcttgtccttgtactattaccattgtgtagcttatcttaactctcaattaagttttaactcacgctaagactattgacctcgagaacaaacaaaataaaaataaaaaaagagaatgcctaaaagcaacgaatttcccagtagataacgaaaacagaccttttagatgttgatacctgtcaccgtggtttccatcggttagaacataaaaagagacacttgagaacacacactggggaaaaacctcatcattgcgcatttcctggttgtgggaaaagtttcagtagaagcgatgaactgaaaaggcacatgagaacgcatacagggcaatctcaaaggagattgaagaaagctagcgtacagaaacaggagtttttgaccagtaagcggaattcctaccattgcatcgggcgtgatgatacaccaaccaataccgcaagtcctaccagcaaatatggccataaatgttcaggcagtaaatggaggtaacattatacacgctcccaatgcggtgcacccaatggtgataccaatcatggcccaaccagcccccattcatgcctccgctgcatctttccagcctgcaacttctcctatgccaatttctacatacactccagttccatcgcaatcattcacctctttccagagctctattggctccatacagtcaaatagtgatgtttcatctatcttctcgaacatgaatgttcgcgtaaacactccacgctctgtgccaaactctccgaatgatggatatttacaccagcaacatatcccacagcagtatcagcatcaaactgccagcccttctgttgccaagcagcagaaaacttttgcacattctcttgcatctgcattatctaccttacaaaaaagaacgcctgtaagtgccccttccaccactatagaatcaccatcctcaccaagtgattccagtcatacctctgcatccagcagcgctatctctttgcctttcagcaatgctccttctcagctcgccgtggccaaagaacttgagtccgtctatttagattccaatagatacaccaccaagactaggagggaaagagcaaaattcgaaattcctgaagaacaagaagaagataccaataacagcagcagtggtagtaatgaggaggagcacgagtcgctagatcatgaatctagcaaaagccgaaagaaattgtcagggcgtaaaattgccgcctgtacgtaacctactgaaacaaattgatgttttcaacggtcccaaaagagtttaacctttgcggcccctttttatctcaccatttttcctctaacgaactgtcatgaaacaacttagcatataacgcgtacttacatagatagattaaatagataaccatgcatatcactaactagcatcgtcatgaatagcacgtttgcctatacgaattgcggccggcatggtcttttatattgctcccttggaccgagtaaagatttaccttgcgttttcggatcgtcaaaatcttttagggaaaggataaatacaccacaagattcctgggaaatgaaaagtatctgaaataattgtgcttttggaagggtactgagagcagtgaagtttctatgggtactacgacaagtcatccagcccaaaaaaagcaaacaacaaaaaagtgtcgtgcacctatcatgagtgacgttagagaaaaacccagcaatgctcaaggctgcgaaccgcaagaaatggatgctgtgagcaagaaagttactgaactgagcttaaataaatgttcagattcccaagacgcggggcagccttcaagggagggatctattaccaaaaaaaaatcgacgttattgctgcgtgatgaggacgagcccactatgccaaagctatctgttatggaaactgctgtggacactgactctgggtcttcgtctactagcgatgatgaagagggagatattattgcccagacgacagagcccaagcaagatgccagtcctgatgatgatcgctcaggccattcttcgcccagagaggagggacaacagcaaatacgtgccaaagaagcttcgggaggtccaagtgaaatcaagagctcattaatggttcccgtggagataaggtggcagcaaggtggttcaaaagtttacgtgacaggctcattcaccaaatggaggaaaatgatcggtttgatacctgattctgacaataatggctcatttcatgtgaagctaaggctgcttccaggcacacatagattcagatttatagtggataatgagcttagagttagtgatttcctgcccacagcaactgatcagatgggaaacttcgtcaattacatagaagtcaggcaaccagaaaaaaacccaactaacgaaaagataaggtccaaggaagcagattccatgcgacctcccaccagcgatcgatcctcaattgctctgcaaattggtaaggatccagacgattttggtgacggatatacaaggtttcatgaagatctgtcacccagacctccgttggaatatacaacagacattcccgccgtgtttactgacccgtctgtcatggaacgatactattataccttggatcgtcagcaaagcaatactgatacgtcatggctgacaccaccccaattacctcctcagttggagaatgttatcttgaataaatactatgccacgcaagaccagttcaacgagaacaactcaggcgctctgcccattccgaaccatgtggtgcttaaccacttggttactagtagcattaagcacaatacactttgtgtagcctccatcgttcgatataaacagaaatatgtcacccagattctttatacgcccatagagtcctcgtaatccgggattcctactttttaaaggcgtattgtatatatttttggcagctatggcacactaatttctatttccaatttagtgtaagcagagatatagaagcatataacataatgatttactaatgggctcagtactctcaatgcttattgttatcacaaaccacgatactaatacccggaagtcgcgtgatctttttttttttcggaaaatgagaatcgccacttttctaacgaaagaatattgaaatcttaatattggtgagaagaggaataaaagtagctaagagagtcacgggactaaaaggtaaaaagttcagctattccaactttactcctttctgatattgcacctttcgtgaactggcttcgtgtatttaagtgaatatggaagagctgaatattgattttgacgtatttaagaaaaggattgaattgttgtattccaagtacaatgagtttgaaggttctccaaattcgctgctgtttgttttaggttcgtccaacgctgaaaacccgtaccagaagacgaccatattgcataattggttgctaagttacgaatttcccgctactttgattgcattagttcccggaaaggttattataattactagttctgccaaggccaagcatttacaaaaggcaattgatctatttaaagaccctgaaagcaaaattacgctggaattgtggcaaagaaacaataaagaaccagaactcaataaaaagttatttgatgacgttattgccttaatcaatagcgctggtaaaacagtgggtatccctgaaaaggactcttaccaaggtaaatttatgactgagtggaacccagtatgggaagcggctgtgaaggagaacgaattcaatgtcattgatatttcgctgggtctttctaaagtttgggaagtgaaggatgttaacgaacaagccttcctgtccgtttcaagtaaggggtcggacaaatttatggaccttttatccaatgaaatggttcgggcagttgacgaggagttgaaaatcaccaatgccaagttatcagacaaaattgaaaataaaattgatgatgtgaaatttttgaagcaattgagtcccgatttaagcgcattatgcccaccaaactacaaattcaactttgatttattggattggacctattctccaatcattcagtccgggaaaaagtttgatcttagggtttctgcccgttctaccaatgatcagttgtacggcaacggttgtattttagcttcatgtggtattcgttacaataattattgttctaatattactaggacctttttgatcgatccatctgaagaaatggccaacaactacgattttctattaactttgcaaaaagaaattgtaactaacattctgaagcccggccgtacaccaaaagaagtttatgaatcagtaatagaatacatcgaaaaaaccaaacctgaactagtgcccaatttcaccaaaaacattggttcattgattggtctcgaatttagagattctaactttatattaaatgttaagaatgattaccgtaaaatccaacgcggtgactgctttaatatttcgtttggtttcaataatctgaaagattctcaaagtgctaacaactacgctttacaattagctgatacggttcaaattcctctcgatgaaacagagcctccacgcttcttaacaaattacaccaaagccaaatcccagatatcattttatttcaataatgaagaagaagacaataataaaaagaaatcttcacctgccaccaaagtccctagtaaaccagacagaaattccaaaattttaagaacaaagttacgtggcgaagcccgtggtggtgccgaagacgctcaaaaggagcaaattcgtaaagaaaaccaaaagaagctacacgaaaaattggaaaagaatggattactcagatttagtgctgctgatgccaatggcccagatagtgaacctcgtcaatacttcaaaaaatatgaatcttatgttcgggattcacaactaccaaccaatattcgtgatctaagaattcatgtcgactggaaaagccaaacaattattctacccatttacggtaggccagtcccatttcatataaattcatataagaatggttctaaaaacgaagaaggcgaatatacgtatttacgtttgaactttaattcaccgggatcttctggtggtatttctaaaaaagtggaggaattgccgtatgaggaatcagcagacaatcaatttgtacgttcgattacactaagatccaaagatggtgaccgcatgagtgaaacctttaaacaaattgcagatttgaaaaaagaagccacaaagagagagcaagaacgtaaggcgcttgctgatgttgttcaacaggacaaattgattgaaaataaaactggaagaacgaaaagactggatcaaatttttgtgaggccaaatccagatacaaaacgtgtacctagtactgtctttatccatgaaaatggtatcagatttcaatccccactaaggactgatagcagaatagacatattattctcaaacattaagaatctaatttttcaatcttgtaaaggtgaattaattgtcgtcattcatattcatttgaagaatccaattttaatgggtaaaaagaaaatacaagacgtccaattctatcgtgaagcttctgatatgtccgtcgatgaaactggaggtggaagacgaggtcaatccagattcagaagatatggtgatgaggatgagctggaacaagaacaagaagaaagaagaaaacgagctgcgcttgataaagaatttaagtattttgcagacgcaatcgcagaagcatcaaacggtttattgacggtggagaatacatttagagatttgggcttccaaggtgtcccaaatagatcggcagttttctgtatgccaactacagattgtttagttcaattgattgaaccaccatttttggtgattaacctagaggaagtcgaaatctgtattttagaaagagttcaatttggtttgaaaaacttcgacatggtttttgtttataaagatttcaataaacccgtcactcatatcaatacagttccgatcgaatctttagatttcttgaagcagtggttaacagatatggatattccttacactgtctcaacaatcaatttgaattgggcaactattatgaagtcattacaagatgatccatatcagtttttcttagatggtggttggaattttctggctactggttcagatgatgaagcatctgatgaaagtgaagaagaagttagtgaatatgaggcttcagaagacgacgtaagtgatgaaagcgcattttctgaagatgaagaaggatcagaggtggatgacgatattagtggtgatgaaagtgaggactatactggcgacgagagtgaggaaggtgaagactgggatgaattagagaaaaaggctgctagggctgataggggtgcaaactttagagattagactttataacacttactgggtttcaccagcaagaccttgatctgacagaaaattactcttatgtatctgaaaaataatgatggtatttaggcatagtatttatcaatgctaagaaatgtaaatggactgaatgtacactcaatgctaacggtcaaggtcataggacgtttgcgtaataaaagaaactctactagagttgaacataatttgatataaaagtatataaattgaaaaggcagtttcaatcattttagtttctgcaatttatttattcctgtaatctacaattttatagttgggaaattctctcgaaaatattaagaaaaatacagaactcataaggtcttttttattggcattttgaaatcccctcagataatcaaagatgctaacaaacaaaataataacggtaaaaaaaaaaaaaatacacgatggggtacagcaaacgaattattttatccacgtcttaaaatcctgtgggttgaacgttcatcgcgctgttcatcagcatcaaaggttggccatctttgtgctcttcattagatccggactttttagcgagttcttcggtgattttcttaatggaatcattctgctctttttttatggagatttcaaatggcttaatgtagtcctccaaagaattcatccatgatatttctaaaacaaattcaattctcactaagttgtaagcagcatatagcaaagcaacaaagccttctctgttaccggtttcaacgaaatatgtgagtagagcctccactacctttggatcctgagagattgctgccgtctcaatagcgtccttccatagcttttcttccttcaagattgaaagactctttgcccacttcttatttctacggtataacagggctcctattttcttgaaaaaaattagcttatgagattccaaacgagatgccaatcccaattggtcaaatttgtcataagaatcaacagcgtcttgcaaagctttataatcttcttcttcaatcatcagatcgtggtaggcttggttgacaactgagttattttttggtaagacattgatcaagaaaggcttgattaaaggcaagttgtcggatttcgagaaaattttgacagttcttggaatatctaatcttggtgtcaatgaggtcaaaagatcaactagtaatgatgggtgaaatttgacgtagaaattaatggccttgtaatagatttctaagttagaaactttgacaacaacttctttgaaataggcgtgatccaagtctttggttgatttttcgattagtgttaaagcagcattatcccattcatcatagtgagcatataaaaagaccaattccgaccagaggtgagcttgttcgacagctctaataacctttggaatatttattctggaccagaatagcttcaagtgttcgaaggtcttgtctggttcatatttggaatacaaaatggccaattcagtgaacatgcccatatgagctctttcaagtcccaaaccagcttcaaacaatgaaatcagttcttcgaaatagccgtttgattcatacctttccaccagttcatctaattcttcagcgtgaacgatcaagttcaacccacaaatttgagccagcttgaattctttcttttcaatacaagcgtcgttaaccagtttccaaactttaatgtttgaagcctttctagcagtgtcaacagcagcctgataatctcccaggtaaaccaaggtagaagcaagcttggagtaattagaaacagcagaataacatagcctggccgctttatactctttattctcgaataatttatcaccaacatgatctaagtttgcaacattggaacctgccaacaagttctcaatttcatgaatcttgtttagttcagcataggccaagattaaagcaccgtcgatctttggttctttcaaagtctttctagccattagtaaaaatggaattaattcttcgtatttaccggcttgttcggctatatcaattacattttcgtaatttgatgggtcttctgctttaatataagactcaatagcatctgggattcttaatccatctaactgagccgtaccaatttgagaccacaattcgggagtattgattttatcagcataagaagcagctctatctaaagacatgatgtcttcgattaaaacctttaaagctttaccgtacatttcatgtttgtcatagatttcaaaagcttcctccttcaaatcatgttcaatacataatggagcaatttcatcggcgtcgtagttatctaatttttcgatatagcttgaaaccttagttggttcatacttaatagcagacaataatagcaacccttgtaaagccacattttcgttgaaaggagaaggttccaatatgattttttctagcaactcaattagttccagttttaatccattggtcatgaatgcttgaacagttaaggaaacaggttcaggatcagttaattcagggataccaacggagatgaccgaatcaattaattgtcttctgtgaatattttcttgattcaaaactttgttccataaatcgagatcagaacgttccaacaaatatcttgcctggtacttgtacatgctattttcattagtgattctaatcaagtcatcatcattttgacctttttcatacgcaatatatgcaaggtagggatctcttttttcgcagtaatgaccaacgtctaaggtgtcatattggtcgttttccttcaaaaacttttcaggagaattattggaatcaatataaatttttgctaaggcattgtaaacagcttgatcctggataccttgacttaagctttgttctaggaaaggtagcaatatttttagtctatttctcttttcaacctcagtagttaattcattaatagggacttgacctaagactgattgtagcagactttgaataaatgcctcatcacagtccatatcaagtaatgcgccaacaacttgggcagtctttgaagggttaacctgctgcacgtaagtttcaataaattttaagttctgtgatttgtacaaatataaaatcatttcatgaacaaagtcgaaacggtcacaaactatgactagaggcaactggtcttctagattggcatccttcaagaaattcttgactctttctggatcatagacattgttatccttcacaattctttcaatttctctgtattgtttcattttagcagcagcttcaatgtatttgtaaaccacatctttatcttcggttaggttgactaaagaggctaagtaatagtataaaccttccgtagcattataatcttcgaataatttaatcaaagtagatggaccgatcaaatcagagaatttagttgccacctgtactacggtctggatgttagcctgaatattgttatccattaaagcttttaagcacgccaaagattgttcaacgttcaacttaccaaagtatccgactaaccaatcgataggtaatgcattggtgtggacaacgcatctcttgatatctttgatgtctgtgtaattttctaaagctctctggtatagtcccgccttttcggataaggaagcaatagttggtttgtcataatgagaaaagatgttgtttcccaatatggcgtcagcaacttgtggtgcgtgtagtagattgacttcaagaacacgagtttgcaagtgaccttggtctggggtatctccttttaacgcgtctagaagtagagaggttccttgttggatatggttttgggaaaagaatagatctgcgattttttctatgtcgatctgagaagcagtttccggattttgtaatagagatacggcaaattcagaagctctgtctggtgatgatctaatcaaagaagaaatcagcactaaaaagttaggttgatatccaaccttttggcagtaaggaataattttttcaaactgttgtaattcggcaagacaagatataacttttgcatgggcacctgctcttaagtagcaagctagcgctaaagtagtatcgaaaggcttaacgatgtcacctagttcttctgaacattctagtttatcttcctttaaccatttttcgaacaattgttttctgtcttgttgtagaactggtctagccaattcaattgtttcctctttattcaatttccctttatccaatagtgttgaaaagtaaagtaggataggagaaatggcgcctggtggtgcttgaatgtttttcaacctgttgatggtgttttggttccttaaagaagtggaagaggctgcaactttagctgcattttgataatcgttttgtaacaataaagattcaaactgtttttgaaataaatcatctgcacctggtaagccacctcttgtagcaacgattaaggccagtgccacattagataatttattcaagatatatggaacgatttgagaagtagaaatctctactgctaaaacttgaccttttttattgatgcatgcaataccgttctcgtgattgtacggagctgcagtaaaaacagattctgctgtaattctattaacgaataaattggtaccggtttccaattcgtacaaatggatgaagccatacttggttaataggtaaattatgccgtatttctcagacacctgaacagcgattgggaaatcattcgttgcatctggtggaaagaaaatatcggtagtttccttttgatattgagaaggcaatgaagcatcgtgatcaatctcgataattcttaattctccagcaccggtggtggcatttctgttaccagtaacgaaaacttgtaccggggtcgagccattaccctctagtaatatattcgtaaagatagcaacatgaccgtcgatagcttgggagatgttacgttgttttgagaataattgaattctaccggcaatacggccattttcttgtaagataccaacaactgcgaaccagtcaaggtttttgttagccacaaaattgataatttgggtattgttcaagttagcgtgtctcaaggtaagcaattgaggcttagcatttacgttaccatcaaagacgttcgaggtcagtatggatcttgcggtaacaaaacccaaagtggtttcactcaaccacctccaaaaaataacaggttcatctaaagtaaaagactttaacttgctcttagtttccaaattaaatatctgcacgatagtaccatttgctctaacggaaataaccatctgagatggatgcatgatagcagaatcaccgcccatattcttccttgtcacttcattgcctttggccaaatccacgattgcaacagagtttgtaccgtcctttgtttctctaacagtgacgaagtggtcactctcgaaagtagttgatctgaagtcaaggaattgaggggaaattcctaaggacatcagatcgaccaattcggtaaattcaatgggtaggtcactcattggttagaactttcgtgataatttatttttatagttgaatatcttctttctctctcaactctgatccggattgtcgaggtttcaataagttactctgaacaactaatcaaaatatctccttatttctgtagattccttcagttccactttttacttttcttaattctctttgtatttattcctagcgacgaaaaatgcgagatctcgaccaaaaaaagggggtagggtaataaaattaaccctattattttttaactttaaaacctataatgtgctaatattttattataaacctcctttttttgcgttcaaaccctgacacattttaagccctatatttacggtattagttgattaaactccgaagcgaaaggaattcggtcattagcggctaatagccgttggggtaaatcacctacaagcaagtacacaagagaacgttggcgttgttaagtcaaagcactaatacattggggctttaagagtgtttataaaggtctaacctgtaaaaattatttaaacaacttgaacaggccttaaagttttcctcattccgctcatcatcactaatattgctctccgtttttgaatacacacttgacactaataagtatcacagaaaaaaagaaaatataataaattagtattgcgatatgacgagacgtactactattaatcccgattcggtggttctgaatcctcaaaaatttatccagaaagaaagggcggattcgaaaatcaaagttgaccaagttaacacatttttagagtcatccccggagaggagaactctgacgcacgccttaatagaccaaatagtgaatgatcctatattgaaaactgatacggactattacgatgctaaaaaaatgcaagagagagaaattactgccaaaaaaatagctaggcttgctagttatatggagcacgatatcaaaacagtgcgcaaacactttcgcgacactgacctgatgaaagagttgcaagcaaatgatccagacaaagcttcgcctttaacaaacaaagacctttttatattcgataagagattgtcacttgtagcaaatattgatcctcaattgggtacgcgcgtgggtgtacacttggggctatttggtaattgtatcaagggcaatggtactgatgagcaaatccggtattggttgcaggagagaggtgccactttgatgaaaggtatatatggctgttttgcaatgactgagttaggacatggttccaatgttgcccagctgcagactagggctgtgtacgataagcaaaatgatacttttgtaattgatacacctgatctaactgccaccaaatggtggattggtggggctgcccattctgccacgcacgctgccgtgtacgccagattgatcgttgaaggtaaagactacggtgtaaaaacattcgttgttcctctgagagacccttcgactttccaactgttagctggtgtttccataggggatattggagcgaagatgggtcgtgacggtattgataatggctggatccagttcagaaacgtagttatccctagagaatttatgctaagtagatttaccaaagttgtccgttctccagatggttcagtcaccgtcaaaactgagccacaattggatcaaatttctggttatagtgcattgttaagtggtagagttaacatggtcatggattcatttaggtttggctccaaatttgctactattgctgtacgttacgcggttggtcgtcagcaattcgcacctagaaagggattgtctgaaacacaattaatcgactatccccttcaccaatatcgtgttttaccacaattgtgtgttccatatttggtgtcacctgtagcttttaagttaatggacaactattattccactttggacgagttatacaacgcttcctcatctgcatacaaagctgctctggttaccgtgagtaaaaagttgaagaatttatttattgatagcgccagcttgaaagccaccaatacttggttaattgctacactgattgatgagttgagacagacttgcggaggacatgggtattcacagtataacggatttggtaaaggctatgacgactgggtggttcagtgcacatgggagggtgataataatgttttatctttaacttcagcaaaatcaatattgaaaaaatttatcgattcagccacaaagggtagatttgacaacacactggatgtggactcattctcttacttaaaacctcagtacataggatctgtggtttctggagaaataaagagtggtttaaaggagttgggtgattatactgaaatttggtctatcaccttaatcaaattactggcacatattggtactttagttgaaaaatcaagaagtattgatagcgtttctaagcttttagtcttagtatccaaatttcatgccttgcgctgcatgttgaaaacctattacgacaagttaaactctcgtgattcacatatttccgatgaaattacaaaggaatctatgtggaatgtttataagttattttccttgtattttattgacaagcattccggagaattccaacaattcaagatcttcactcctgatcagatctctaaagttgtgcagccacaactattggctcttttgccaattgtgaggaaagactgtataggtctgacagactcctttgaattacctgacgcgatgttaaattctcctataggttactttgatggcgatatctatcacaattacttcaatgaagtttgccgcaataatccagtggaggcagatggggcagggaagccttcttatcatgcgctgttgagcagcatgctcggtagaggtttcgaatttgaccaaaagttaggtggtgcagctaatgcggaaattttatcgaaaataaacaagtgagtagaggtttcctgttttccttcgaaccctctgttttgcgacttttgtttcaattcaactagtgtcgccaagttttaacaaaaagttacaaaatcctagtgagaggccatcttatgtgcataacggtactctctatctatttacatatctaatactattcacataactatgacgaatcaatgacatgactacatttaccaatgtatagtagtaaaaaaattgccatctcctagaatcgaaccagggtttcatcggccacaacgatgtgtactaaccactatactaagatggcaggtaattattgagtgtttactcaatatctcagaattatatacataacaaataataaatgtgctgtgttggcacttgttggaatgaagctctaaaacatcatgatgattgtgtggattctgatgtaattgttgggattccatttttaataaggcaatatgttggaacgagagtaattaatagtgacatgagttgctatggtaacaatctaatgcttacatcgtatattaatgtacacatcgtatacgtttaagtgtgattgcgcctattgcagaaggaatgttaaacgagaagctcagacaatactgaagctgtgttaaagacctattagctgaacatgatatggtaggtacatatatgaggaatatgagtcgtcacatcaatgtatagtaactaccggaatcactattatattggtcatgattaatatgaccaatcggcgtgtgttttatatacctctcttatttagtataagaagatcagtactcacttcttcattaatactaatttttaacctctaattatcaacacaataatattaggtatgtagatatactagaagttctcctccaggatttaggaatccataaaagggagtctgcaattctacacaattctataaatattatcatcatcgttttatatgttaatattcattgatcctattacattatcaatccttgcgtttcagcttccactaatttagatgactatttctcatcatttgcgtcatcttctaacaccgaatatcataatatactagtaacgtaaatactagttagtagatgatagttgatttttattccaacagtttatcaactagtagtcacactaccaatatattatcatatacggtgttagaagatgacataaggtatgagaagctttcatcgaaggtagaggaagcagaaatacaaggatttataatgtaatagggtaatggaacatataagggaggagaaatgatggtgatattaatatgcagaaatatcgattccattttttcaaaaaaatagtgccaaactattaagaagtagcgaaacagcaaaggcatatttccacatttcgcttttagcaatatacataactatggtggcaagataccatgcaactaataactttgccgcaatgacacctctatttctacttgttgtcgttttacctcttacttgtttgaacattgctgttctaagacctaacaataatagtcctaatacaaacagagggcatgctgttataagtataaaatgtttgctgtaactaatggtgggggaagattgcaaaaaacgaaggatatcagttccattcatttccagggatttgtgttgatatgtggggctatgaatgcgttgaagttttcaacttctgtgaaggagttaaaacaaccactaaacaatctcgttcaaaagctctaattacttgtatattattttatacgtttatgtctatttcaatgcaattacgtgaaaaataaaagaacgctaccataaaaatgttaaaaactggttaaaaatgtcaaaaaatggtccgaaaactgaaaaaatattcgtgatacagtttgcataaaaaaaaactattgtgcgcgattaatataacctactagacttaaatgacgacactttaatatgaagttcagtagtgtgaattaaataaaacagtcagttcttgatggattgtaccctttaaagaatttatctttatgtcgctgttactacgaaaagcgtgtgcgaggtattataactatttttctgtattttttatatatttttatttgccaagttaaaaatcagtcatctcaaaagattcatcgatttcagtgttcggaaggctagtatacttcttctttttcttagttttcaatttagatcctgctttgttagaagtgctacttatgggtgctccgccttctaactgctcatcttgttctaaatcatcttctgccccgagtccgctttccagatcatctgcccatgaaactgtcttattgggactgtcatgttgtctattatttggatcaactaaaattgtgtgacgcgcttttctcctcactcttctatcatacgcataaactcctaaaaccactatcaaaaatgtaacgatggtaactactaccgctttgtgtttatacattgaaatctcttctgcaaattcttctacctcttcctcttcttgttcatattctgaagatttatgtctactatcctcgaggccttgattactttgtttttcattattatcgtcttcatcatcgtcatcgtcatcatcgtcgtcgccctcggagttgtgatcgtcttcatcgtcgtcatcattgtcgttatcatcatcgccatctttatctttattgccttctttttcctttccttcctcattctgcgcttcctgttcttcctcttcgaggttttcttttggcttatcaccgctttcagtagtagcatcttgatcactatcgtcgtcagtagtaatcataacatttttcccattgttgtcaatgatcataacatcgttcgagtaaatatcgacaatgcctctactcactaaacttttatcgaagggtaccatgtgagaagcattataaacgctaacaaacgtcaaatttctatcatacttcacgtatccgctaaattcttcgctgtcgtctgtactcttcgatttatggatccaatcgaacgaaacagcatcgtcgctaaatccctttattccaccccattttagattgtctatagtatctaatacgcccttgttattacaaatcaagtctttgtcaccattgaacaagacaatctctattccactttcaagtagaccaggtaataaatggatagatggctttgaaataggattagacaatttagttccaacgctattagtgcattccttccaatgatcaattttatcagaatcaagatgcaacgaatcaataacaccaggtgtgctgaagaatttactgacaaaggaaatatctttcggccaattcataccacaagatggataactatcttttaaattgaagttatacatgttcaagcaatccgctgttcccttttgcgaagattccctggtataagacaatagaaggtttaaaatattctcacattcctgatacgaaaaatgggctgcctcatctgtactggcagagtttatcagattctggcaattctcgtgtgcgttcgttaagtgtttgaaattggggttgctttcatcaatcagtttcttctccatagcaaacggaaggtacgatagggactgtgtattggggtcaatccaaccgttaccaatcaatagcgccttcaagtcgtatgtatccccgtcgatctttgaaaatttgttatggttcaaaattgcattggcaaagaatggtatgtattggccagcgtaactttcacccgatagtatgattttcctagtgaggtcttctggaaaaatcttgaaatagttctccagaaaatccataaaatgcttggtcacatcttctaggtcttcgtcaaatttgtttttgtcgattttaccttcgtctttattttgttcgacagaaaacccagtaccagtaggttggtcgataaataaaagatcgcctttggatatccaggacccttcatttagataaagtttaccgtctgaattcaccctaaaagggccggattcgaccaaggcaccatccatggaagagcaaccgggtccaccatttaaccatataattaagggacggtcgacattgccattagagtcgttattggtaaacttccaaaaaaagtactccaagtcagagctatcctgttcatccgcatcttcggaacgtaaaggaatatggccagcatgcatctgtggaatatttgaagggtctggcacttcagataaccctggcaacagctcatatgccactttgtactcctcagatgacggaagggatactgagatccttattaaagcagacatggctagccacgttccgagccacctattgtaaaacatctattcaggtctttatctctacggtattctatagccaaggtactctttaaccaaagtatgcttcagcaagctttttcaaatagatgggagttgaagacaatgataagaaatcgcttttcttaatgtttcctatattatcaaaatattccacttttttttctttttccacattgtttttcggttccgggctgcagtaagcaaatataaatgttggtgacaaaacttgaaagttatagccaaaaagctcgcaattcctcacctaacaaaatgatcctgttggaataaaaatcaactatcgtctataaactagtagtcacactaccagtatattatcatatacggtgttagacgatgacataaggtatgagaaactgtcatcgaagttagaggaagctgaagtgcaaggattgataatgtaataggataatgaaacatataaaacggaatgaggaataatcgtaataatattatgtagaaatatcgcttcccctttgaggattcctctaccctcgaggagaacttttagtatattctgtatacataatattgtagccttgatcaacaatgaaatgcctacaatcatcttaaaattcaccaatctctcagctcttatttaagctttgttgagacgagagttagttatccgacaatactatacaagacattaacatcatttttcgtgctgttagggtggtgtcttttcatttgttgcaataaatgataagtagtttaccgtccattaacatgtgcattaaataatagcattatgtgaacataatgtatatttaactaaaactattatcgaagaaatccgaagaactcatccttgttagctcagttggtagagcgttcggcttttaagcgcatttgcttaagcaaggataccgaaatgtcaggggttcgagccccctatgaggagttcttctttatttttttcccggttcactatttttccaagattaaacatggctcatatacaccatccaaaaatctcttaattaacctataaccattgttctccttcacctcattcaagaatctggcttctgaattgccattgatagaagaacagtactaaattgcgccggaataatgaagaacatccgggttaccttagatgtctttttttcctttttttatcacatttttcactctgcactttttcactttctcgaggtccaatctatgactaatattaagcgcatttcatttgaagatatgtgtatcgcaatcttttttcttatcttgtagaccctcctatacacatctctagactatatatttggtttggttatatctttaagaacttatttctttttcttatttttccattccactaagttaaaccctgcagttgatacagacattgaataggacaaccgatcgttactatcatgactttacctgaatcaaaagacttttcttacttgttttcggatgaaaccaatgctcgtaaaccatccccattgaaaacctgcatccatcttttccaagatcctaacattatctttttgggtggtggcctgccattaaaagattatttcccatgggataatctatctgtagattcacccaagcctccttttccccagggtattggagctccaattgacgagcagaattgcataaaatacaccgtcaacaaagattacgctgataaaagtgccaatccttccaacgatattcctttgtcaagagctttgcaatacgggttcagtgctggtcaacctgaactattaaacttcattagagatcataccaagattatccacgatttgaagtataaggactgggacgttttagccactgcaggtaacacaaatgcctgggaatctactttaagagtcttttgtaaccgaggtgatgtcatcttagttgaggcacattctttttcctcttcattggcttctgcagaggctcaaggtgtcattaccttccccgtgccaattgacgctgatggtatcattcctgaaaaattagctaaagtcatggaaaactggacacctggtgctcctaaaccaaagttgttatacactattccaacgggccaaaatccaactggtacttccattgcagaccatagaaaggaggcaatttacaagatcgctcaaaagtacgacttcctaattgtggaagatgaaccttattatttcttacaaatgaatccctacatcaaagacttgaaggaaagagagaaggcacaaagttctccaaagcaggaccatgacgaatttttgaagtccttggcaaacactttcctttccttggatacagaaggccgtgttattagaatggattccttttcaaaagttttggccccagggacaagattgggttggattactggttcatccaaaatcttgaagccttacttgagtttgcatgaaatgacgattcaagccccagcaggttttacacaagttttggtcaacgctacgctatccaggtggggtcaaaagggttacttggactggttgcttggcctgcgtcatgaatacactttgaaacgtgactgtgccatcgatgccctttacaagtatctaccacaatctgatgctttcgtgatcaatcctccaattgcaggtatgtttttcaccgtgaacattgacgcatctgtccaccctgagtttaaaacaaaatacaactcagacccttaccagctagaacagagtctttaccacaaagtggttgaacgtggtgttttagtggttcccggttcttggttcaagagtgagggtgagacggaacctcctcaacccgctgaatctaaagaagtcagtaatccaaacataattttcttcagaggtacctatgcagctgtctctcctgagaaactgactgaaggtctgaagagattaggtgatactttatacgaagaatttggtatttccaaatagagaggtaaatacgttggaagaatatatataaggtgaaaaaaggacgtacgtatttttgtattgcttaaatttcgaagtattttttctttttgtaaaagactgcaagtggaagccaaaatataatattttgttttttcattaagagtacaactttatacaacaattataacttgatttgagagccaagttatgtaagatatttttctcccacaaagagaaatgcacacgataggaatttacaacgtgaacgatacttgaaacgaaatatgaaaatccgcaagagtgcactgaattagctggaatcctgtggttccaattgatccaaaacctcacagtttggatgaataacataaacagttttattattttcattttcctcattctcaagatctcttaaattgtgtctggtaccatgaatctccattaaaatcctatctttgaccaacctttttatgactttgaacgctaatcttctctcttcccaatattctgctaacgaacccaaatcattttccttctgtaataaataccaatcaactatatccacagctgttagttcttctgcaccctccctatctacttcagcaatctttctaacgatcatgttcatcatggacacatatttatcatacgtcaccgttgttttcttcttctcgcttgtacctggacgagctgtagcttcgctttgtccttcttctatatctgctggtggctcactcgtaattacacctgacccagtcccatcatcattgtcatcattgtttccagaagcggcgtgactttgactctctatgttatcaaattcttcatccatttccacatcatccacatcaacacgaataatactttgccttaaaagatcgtaagcttctgcaatgaatgatggagtaatttcatcgacacaattagccctcgcaatagcttctgataatctaatcatactttcaagttgcctaactgtgattctataactcgatctactaaatccctgggcatcatcctttctcagttccttatacttctcgactaaataggaacgggcttctttcgttaatattggtttaaaagtacgtgcatatttgatataacgacgtagttgttctgcactaaatggcggctcaatggcttcgtctcttttcatgtgtaagtcaacgatatgagatgccaattcggtatcaattttttcgttacagtcatcaagaataacaaaaaataaatcaaatctggacatgatcggtgcggtcatatttaaattacccctcagtgatagtttcctattgtatcttccacctaccgggttggcagccgctagaattgatgttcttgcatttaaagtagcgtgaataccagctttagcaatagagatggtctgttgttccatagcttcatgaatggcaacttgatctgaaatatccattttatcaaattcatcgatacaacaaataccgttatcagcaagcattaaagcacctgcttcaattgtataatcacctccttcctcatctctcacaaccgcagctgttaaaccagcagccgacgaggccttaccggaagtgtaaactgatcttggtgcaaatcccactacgtattttaaaaattgagacttagaagtagagggatcaccaacaacacagatgttgatatctcctcttaacttaataccttctacagtactcttatgaacaccaccgagcatctgaagcaagatacccttctttacggcttcatggccaaacacagctggagcaatagatctgaccaatttatcataaatatgttcatcctttaccatttccttcagctcatttatttcatctgaactcaaactgttcaagaatacttcttgatctctttcattatcttggtatacattattagcttgtaaattagcagccatctgtagttcagtttctcggttgttagaatttgcatcagggctacttgcaccaatgtttgatccaatactgataacatggcatgccagaaagctaatcttgtatgtcaaatcacgaacaccaagagagcgtaaaccagtaacaccactattcaaaccttcagtagtcttcgaaatacctctagtatctaatgttgaacttggcttcacacctggtagccccaattgtgtaacatcaggtactacaatttccacacccgtaaatttgcaacggtcacctggcttggctctttcgacactatcacctcgaagaatgacgtccagcgtacgcggcatggagcctgtaggtatttcgttagcattttcttgaattctgactttttgccaatcaagaaacctggatcttgtaacatttaatgtccaaaaggctctattttcgcatgatgggttcgggcaaaatgtcggttcagtgtacttgaaggactgttctacgttatctacgatagcacggcacatatcacacgtaaagcttgccttgtataattctggacggacctcagatgttcttgtcactgtccctgatatactcaatagtgaaccaatcttttcagatcttatatcacgaattctgtgaactgttggtagattgaagaaactgatttgaaaaacacgttccgtctgttcaggtgacgtagaagttgttattgacctcgttgccatggcagatgtcccattccctggtgcggctgatgatccagaatctcttggtagactcgacccattcatatcatcgtcctgttgctcatcttcatccgcttgaccttcgtcaccttcggatctcttcaatgagtcacttgtgtttaacaattcaggtgcatactttcttactactcttcttaaacccttttgtaaaaaagccaaaaatctgtaatattgttctgagatagccatagctagagcaccattttctctcatggataaatgctgataatctatataaatggtgtttaggtcatatattttcataaattcaatttgagctctataaactttttcaacttcaccagtatcagtggattgaacggaaaagtcttccaaaaactgctcgaacgcttcacggactttttcaccagtaacgtcatcaactttcttaacgtgattcaaagctctacttttgaagcttctggcaggttcatttccctccatatcattagtcgcggaaccatcggtttgcaacctttgagaactaaactgagtggaatcgttaacaaaagggcctgtttgtgaattactgacatgcggttgagaagaacttgggaaatgtaacctagagcctatttgcgaatcgagtccgctactgcttccgaagccagcacctatcgacgatggtggcggagaggagttggaaggtctattactgcttggtgtgtcagctggaaaaggggatgacattgaaaaaaaccagttttaacctttggtaagtctatttttcctatccaccggtggcgaagtgtaagatactcgctgtaaatcacttaagaatgaaatattttgttattattgtagattaaagaaagaaaaaaaaaaagcttcaagaaaggcctattaggcgcttttcctaaaaaggaaatttaatagacgaacttagatgacaataccaaatagcgaaggaacggcaaaagaataggtacacaaatgttatgagaactggaatcaaaacaagctattgtttgtcgacgaatagtaatgttactagtatattatgtgcggtgataatatgatataaatcgcgaaaagggtaaacccagtaaaaactgaaatgcaagataaataacgtaatggggtgatgtatgatatcgtataaaacacaagaaaggataacagcactatcatgcaaaattgcttatttctggtatattctggattccgaatgacacttcccttactggaaaatcgaattcaagtgaccatttaaatggtcacctatttctcaggatgaccgctaattcttctcatcagggtttcccaagttgttagcaaactgtattgatatctttttgcgggagtgaaaccaactattcagctcagtatcggattaatctctccacttaatgctacggagttcttccaaacattagtactggtgccagtatcagcaccacatcaacaggtgaactcaaaattacattagtcaggagcagtacacccgttaatcgtgggaatctctgtactgagggtcaactacgtatcgcggaactaggggtccactagtgtatgcgactgcgattcatataacactttaacgtcaaaaccgtatacagtcctcatccgccttgggggccagcatattatatataaaaactcctgaaaaacacttacccagaggtacgataatgaatgacgcttatgtgatttatggttaacgcagtacccaagacaagtatgcagcgttaactcccaatcaaagaaaatatagtggattctaatctgacgaactacggacagtaattggtatttttactcattagtgactttggtaatgccctatatttcactagaaggtgtcacagtgtcacaaattttacatcacagttccctttcgtaagatcaagaatatggctgactatagtggacatcttcttacaccgtatatagtaatatattgctaatatgagcactagttgattcttgttccaacagtatattccaaacatgtgttaatcacgcgttgatacaatgtggctcggctacaaatcagttattaacatcgtgagctatgtttccctgaaatggggacgttttccaacgaattagccttgttggcgcaatcggtagcgcgtatgactcttaatcataaggttaggggttcgagccccctacagggctattctttttttgttctatatgaacagagctatttcccttctaagagtcccacataaaagtgctctggggaaaaacggaccacagcatgtcctgtggtacttgtttctttcaagtttttcgtatgtatttcccattttttgattcgctacaacctgtatttgttttatggcgcgcctggaccatatatatgtatatatttatttacatgtaattggcacaggggaaaaacagtggaaggatcaaggtaaaaagtatgaaaccgagaattattcgcgacttcaggttatccaatcgtgtatgtaatcgtatgtaggcaaaagtaaatagatatgaactacattttcctgctttacttagactagagatgtgacctcaaagaatcttctcaagtagtatatctggaaaagagagtttgcaataacgacgcccaattggaagatggaccaccatttaacacgatcgttggtcgactctgcagtatttctatgcgtcctttctctaataacaatataactttgttcgtccttgacttccctggttaatttggacaactttctgacagcactatccaatgtattggtgtttgggtcgtccaaatccacatataccaccccatgaatgttgaaagtcacgtcttttgtctcgataccggtgttctcgttcaagaaacagtattggaaatgtcccttgtatggagcagacaatgtgatttcaccgtgcgacgtgtccctaaccgttttcaaaacttcatgtctttccggcccgtagatgataaagtcaccagtcagctggctactggattgagggtttctatcaccgaactggaacgaaatggagagctcgtcacccttactcaagtcttcgaagaagcatctacggccataagctggaagaaggacattatgggcggacgccgagaagaacaggaagcaagcaatgacaaacttagtagcaaatgaggccatccttatgcgtgtgtatttttgtgcggagggatactattaagattgcagtttcaccaagtatagctttttatttcattataagtttcgtgtcaaaatgtttaagcgacccgatctctcaggctgttttgcacgacttttctgactttcctcgcgtcttttttcatgaaaattggattacccggagtgatgattttctcacagtgatttttcgtccccttttacaatagcaaatgaagctgttttagcaatatttgtagaaagatatgtcacaagagggcaggcaaaatgtcatacggaagagaagacactacgattgagcccgacttcatagaaccagatgcacctttggctgcttccgggggtgttgctgacaacataggcggaactatgcagaattcaggcagcagagggacgctcgacgagactgtgctgcaaacactaaagcgagatgtggtggagattaattccagactgaaacaagtggtatacccgcatttcccctcattctttagcccctctgatgacgggataggggcggctgataacgacatttcagccaattgcgacctgtgggcgccccttgcgtttatcatattgtattctctatttgtatcgcatgcgcggtcgctgttctcgagcctatttgtgtctagttggttcattttgctggtgatggcattgcatctgagactcaccaagccacaccagagggtgtcgctgatttcgtacatctccatttccgggtattgcttattcccacaagtgctgaatgccttagtctcgcagatactacttccattggcctaccatattggaaagcaaaatcgctggattgtgagggtcctgtcgctcgtgaaactggtggtcatggcgctgtgcctgatgtggtctgtggccgccgtttcgtgggttaccaagagcaagaccattatcgagatatacctctggcactctgtcttttttggcatggctggttgtcaactattttataacactagttacatatgtataaaacccaatattcatggacatagaattgcctatctcgcgagccacggcagaaagttctgaaaaaaaaaaaaaagaggacgctcacaggggctggcgtgtggctaaggcagactccgtggagtgtaagagaagttcaaagcaagattaggctttctgatgaattggtagcgcagagtctggcaaagtctatttcaagttcacagcgtccgtttaccacaattgtttgagaactcttctccttcctgtgcctatagccacacttgcaaacattacatggtgaaggcgctttagagacttttctgttttactatatatataagataacatagcgcgcgtgcaaaccaaaggacaagtaacaatctgcacctgctttagcgtagtatgcctttattacaaccatccacttgcttctgctaccctttgaagcttccgccattaccactgacttccgattccaacgagtttgatgaatgcgccaggaaaaggttaacgctggactatagaacaggttcagcggtgacgctaacaaggtctaatatatttgtacatggtggtctaaccatcccgttgaacctgccagttgtaaattctatgcaattacaaaaggagcttattctcttttttgcaaaggaaaaaaacaacggtagttcttttaggaatttaaacgagtggataagtaaggagacgtttttcttagacttgatgtctagaacctggtacagagtcaagacctcctttgaccaaaggacagaggaattattaaaggcagagagttctagcgccaaagcagataatgacacaaacgagattagaacggacattaagaaaggtaaatcccttgaatctccgctcaaggagaggctattccattccttatgttatttagatggctgtttatatatatttggtggtctcacagtgtctcctcagagcggatatgagttgattgctaccaatgagttgtggaaactggatttaaacacgaagaagtggtcgcttttgagtgatgaccctcaaatagcgagaaggttcaaccataccatgcatgtaaagaacgaaaataacgataatagagacacgaaattaataattgtcggaggtcttaataacatggatcagccggtcaagaaaatagacatctataacatctcacagaattgctggcatccgaaaaccatacccaaacaaccgatggaaatcactacaaatgtcaatggcataccattagcattatcaaaggatcagaatttttcgattttagttgaaaataatgaggccaacgttccagcgctggcattctatatgagaagtgatcaaatagacgaatatctcggaaaggattcatcaaagataaaggagaattcgcctatagtggcgttgccgctattgtctgaatcgcaaggtattagaatgccctcaaacccggcattaccgaaaaaactattgaatgttccgtatgagctattagcaccgacaggtgactattttggattcaatatcataatcggtgggtttcatccaaattaccaatcctctaactttcattgttttatatacgatattaactccggaaagtggtcacgagtccgtaccgcctgccctgactgcgatatcaataaacatcgattctggagggtatttgtttggaaatcgcatcatcagacgattttgttgggtaccaagactgatgattattattcacccagtgtacaaagattcgaccatctttccacttttggattaccgctggtaaatatttttaacaagacgatccaattaccccatcacaagatctcagcttcgtctttaccaatacccatagaaaattttgcgaagcataaggatactccattaaaaaaggtgagcttcacttcatcagctacctcccaatttgaaaactacattagatatatagctccgcccttggaaatgtcttctatccaatctgtgtttccaccgtatgccatggttctaggtaaagacgctttagagatttacgggaagcctctttctgattttgaatttattactagtgaaggtgactccattggtataccatgctatttgctgaggaaaagatggggccgttatttcgacatgcttttatcccagagttatacaaaagtttgtgctgattatgaaactactgatacgcaatctacactaataaaattttcaccacattcatctagaaacagttctaaagctgtgaggcaagaaggtagactctcttcatcgggttcactggacaattatttcgaaaaaaacttcccaatctttgcgagaacaagtgtttccgaggcccagaacacacaacctcaggtagcgaatgctgatgcgaaagctccaaatacacctagtacgtcagatgaaccaagctcttcctcctcttccgatttatactccactcctcattaccaacgtaataatgatgaagaggatgacgaggacccggtttccccgaagcctgtatcaaaatcaaacagtatctatagacccattagaaagacagaaagttcatcaacaacgagttcttcaaacggtatgattttcagagtacctttcaaggaaaaagcggctgtaacgtcaaacactgaagccctcttggagtcaaacctttcacttcaagaattgagccgaagaagatcatcacttatgagcatcccgtctggtgaacttctaaggtcctctatatctgaagcggaacatcaacgtcgtgcatctcatccactcacttcatcaccgctctttgaagatagtggaaccccttgcggcaaacaactgcaacaactgcaacaacatactatacaaaatcctcataaccatttgtcgccccggaggttttcaagaagtgcaagaagttcaatttcctacgtgagttcttcttccgatagacgtggaaattcaatttctagcaggagcacaagcgatagctttggaactccaccagttttgggcgttttgaatgtaccattacctcctcaaacaagagaacctaatgaaccacctccaccatgtcctgcaatgagtaccggctcaaatacaaggcgaagcaacaccttaacggattatatgcattctaacaaggctagcccgttttcttctcgtagatcgtcgcatatcggtagacgttctagtacaccggaaacggaaaacgcattctctgcaacaccaagagcatccttagatggtcaaatgttaggaaaatctttgaaggaaggttctacatcacagtacacacagccaaggatgaactctttcccaaaggctaatgaaaccatacaaacacccacatcatcaaacaatgaatggagccgtcaatccgttacttcaaatacagatagttttgacagtttgcaatctaattttgcgttagagttggaaccacttttaacaccgaggtcactttatatgccttggccaacctccacagttcgagcatttgcggaatttttttacactgggcaagtaaacagtaaatggcttttggcaccagttgctcttgatttattagtaatggccaagatttatgaaataccattactgtataaattgatccttgaagttttatattcgattctggctaaaaaagaagaaagtttatccttaatatgtacttcgttaatggagacctttcgcaccaaaactctgaactcctataaaggtgatgaagaaaaaacaaatacttatttgacttcaaacgataactatcaggaactgttgaaattaaaagtgtcgctggagaatatcgacaatgggtattatgacccagatttgttacgcaaacagtcaagagcacagtcttcaagcacacaagaaagcagtggtagtgcaaacggcgaaaaaactgcaactggcgctggctctctggagacttcttcaaccaatgtccctacagtatttgctggcggtcccagagatagccacaattcagtaggctccattggttttccaaacagtatgaatatacaaggctcaagaagatcgacatcaggattttctccacgcgttaagatgaaatcgagcttaagcaaggaaatagatcccaaaactttttatgaagagtacgaaccaaaagagggcaaaagttttgatgataacgatgatcaacaaaccaacatcggaagttttaaccttcatttgtttgatatgaattatggttccatcagcagcagtagcactaacagcattagtagcagtgatttagaagagaaagaagaacaagagcaacttcaagatttattggaaatagaaagagaagattctgctgagatcttagacgcaagattcagaaacaaagaagatgataaagtgacgaaggatatatcaaatgacaagaaacgcaattacttaccgcatgaaaaaaataacttgaaagccaaggaaggtaaggaaactagagacgtaagggaggaggaggaagaattcgattttggtttgggaatgctttcgctcaataaaataaaaagagaagccaagcatgtcgataaggtggacgattctgtagaccctttatttaaatcatctgctttccctcaaagtcccattcgagcatacgggtctaccacaagaactagttcggcttctggaaagccattcagggacaatcgttcatttaatgcattttctgttttgacattagaaaatatggcgtctgcaaatgccctacctcccgttgattatgtcataaaatcaatatacagaaccactgtgttagtgaacgatatcagactaatggttcgttgcatggattgcattgaattatctaaaaatttacgagcgctcaagaaaaaaactatggaagatatttcgaaattgaaaggcatctctaaaccgtcaccatagaccgctacgtcccaggatagttactcgcacatataaagttcttaataatccaagaatatgctgctatacatctcaaaacggattgcttccatatgggcgccacttttctgtttctttgctatcaaaacagttggcaccaaaaagctactcattgcaaaggtttattgcttatgaaatattgctttgtgaacagattcaaccgaaattacccggtgaatatgactatgtaagttattagtataggttgcatttgctgtattcgttgataagacaacatcttgtatcatactagtttccgcacactagtatttcgtctactattgactttctgataaggttatctggttcctgtatttgcagtttatcgaagcgggcagaccaggtcagctcaggacaattcaaattcagataatgaggcacagactaatcataacacgaaaattgaatacatcccacgatatagcataaccaaatgtcggaacataactagcaatacaatttttacatcgggccgaatccgtcggagagtgataagacggagttaaaatatctctcaaaaccatggaacaacaatatgtgtacatatataaagcttttgagtgaaaagatttctttccactatttactgtcaattttattcaacacgaaagggaattaagtgcacataaatacttcatttcttgataaggaagtataatattgctcctaagaagagtttgaaatgagcgatgttctatctcaatataaagggtgctcagtcagagatttacccacacccaatttcgttattaatgaagaaaaatttgataagaattgtacgacaatgttgaacaacgttgaaaagctcagccaggaatgtggcgtaccaatcaaatttcgtgcacacgtaaaaacgcataagacagcaaagggaactttgaaacaattgggccacggacttcattggctaaacgcactacaagagccatattagtatcaactttgaaagaagcagaagaacttcttaattatcaagatagacaatgttcggattatattgacgatataacatatagtttaccctgttgcgttccagagtttattcctcttttgagaaatttgtcaagaagggtgaataattttcaggtttttgcttgataacattgaacacttggagaatttaaagaatttcggtaggcctgcttccggcaagaaatggtcggtttttatcaaggttgatatggggactaagagggcaggtcttgctttcggactctccagaatttttgagtcttttaaaaaaactgacttcctcagaaattaaagaagtaattgagccatatgggttttatgctcatgccggacacagctactcttcaacctcgatcaacgacactcagaatcttttgatggaagaagtgaaagcagtcaattctgccgctaaagttttgtgctctgtggatcctcagtttgatccttctaaattaacactttctgtgggcgctactccgacttccaattctttgaaactcgataataaaagtacccttgttaaattcattactactcaattagttagtacgcttgaaatccactgcggtaattactgcatgtatgacctgcaacaggtggcaacaggctgtgtccaagatcacgaattgtctggttttgtattaggaacagtactatcatcttacccttctagaggtgaattgttgagtaatacaggtgtaatgtgtctaacgcgagaagcatcctcaataaaagggtttggaatatgtgctgatttggaacatgtgttaaaatccgagagtttcagtagggaatggtatgtagcaagggtctctcaagaacacgggatactgaggccaataagaaactggaacgaaactactccattaaattaggcagcaaaattgccgtccttcctcaacacgcttgtatcacaatgggacaatttccatattatttcgtggtaaacagcgaaggcattgtcaacgatgtttggttaccttttcagaaatggtaagctctcttttgtcgttggttatcactctcatcaaagcatctctgtgtctatgtaattgtgtatctatttataaatagtaactaagaggtaaggttgtacacaggttggtctaaacaccctcttgttaagcttccgcattacctgcgagctggtaattgtaatacagatttatttgttgatataatgctatgaaatttcaactaccgtcattgagcttctcaataaagtcgttacgtacgaatgaaaaatttgaataatttaaaccttcgaaaagatctttgagttgtacttattaaacctgaagtagatcattaagacaaacaaagctctgactgacaccaataactcctacagtgatgacagctatcttaaactgggaagatatatcccctgttttagagaaaggcacccgcgaatcacacgtgtctaaaagagttccctttttgcaagatatatcacaattagttcgtcaagaaacattggaaaaacctcaattatctgaaattgctttcgttttattgaataccttcacgatttacgaagacaataggtctaaaagtttggtaacttcaatattgcttgacatcttaaatctagagccatgtctcctagaaaactttatccgattcatttccgacgtggtcatcagtaatccggctaccaaagcagtcgctgattaccttaatttgttagattggattaattctttcttgatttttgtgtcgcataattctaatttatttgaagagtacattccaaaattgttggtcgcccattcttatgcaacgttcggtgtggaaactattcttgacaatcaagaagaaggcaagaaatcccaagataagcagaaccagcatagaaagagaattcgttattgcattttccaaacaacggtcaaagcattccttaagtgcttgaaggataatgacgacagtatttccttcatgaagatttcaattaaaactgtactggagagctactctaagctgaagataaccagtgttggagtagttatgataatgggtgcactaactcaggctgcacttcagttattatcgaggcaaccagctctgcactccgttttaaaggaaaattctgcagagaaatattgcgaatatttgggcaaagaagtgtttttaggcaaaaacccaccatcttccttttgcttagagattggtttgaagccatttttaaaagaatttgtttcacaagagttattcattaagtttttcatccctaatattgaaaaagcagttttaagatctcctgaggttggtttttcgattttatctgagttatatgctggtgtttctcctgaaaaagtaaatctcttaaatgcctttgcttcctcgaaactgattaatcaatacttctcgtcatttaaaagctcaaaagaggtagttagatccgtctcgcttcagtctatgataatcttattgagaaaaatttccaatactgacactaccttggaagatttgaccaagcttattgacgaaatatttaagaacatcaaatcgaacttaaatgcagattacaaatcacttatttccaaaattctcatagaaatacccttaacgcactatgaggtttcagaaaaaatctgcaaagggctgtccccatatattggtaaagaaggtaatgaagcagccttgactctaatgcttaacgctttttttgttcattattttagtctgggcaaacctattgaagacttggataaaattatatcagctggttttgcagataaaaaacctgctttgaaaaaatgctggtttgccgcatttttgaacaattccaatgctgcctctgaagaggtgattttaaactttatagacggttgtttggaatttgtgaaagactccatcatacattatcagactcacgggcatgcatgtattctagcatcaattgaatttacaaacaaaattttggcattggacaatactgagctaaatgatcgtgttatgcagctcatagaaacccttcctgaaaattcttcgataggtgatgctatcttaactgctgcattatcaacagagctatccatcgaaaaccgtattcatgctgttaatttactacaagaattgttctacaagaaacccgaatttattgggtttagcgtgattgatgcaattgaaaggagaatgcgtgtccaagaattaatacctcaacaaaatacatcctttaaatatgtcacttctgtactactggccattacgtctgagttacctgacaaggaagcctcgataaaggtattaatcaatgctctggtcatagcgcaatggaatattttcaacattaagaatggctgggctggtttagttttacgtgcaaggcttgatccagctgaagttgtcaaagaacatgctagcgttatcatggagaagattcttgaaatcacaggtagttgtgaatggatagatacaatttatggtgcatgcggtttgcaagcagctgcctatgcagcatttattcagcctaatgagttcacaccgatcctttgtaagactatcgaagcagatttaaccgcggatgatttctcacgtttatctgaagaggacttcgaaatttttgcaggagaggaaggtgttctggtggttgacgtcctggaagaaagcatgaataagaaactttccaataaaaattctaaagagtacgaaactctaatgtgggaacaaaaaataaggaaggagcaagccaaaaagaatgtgaaaaaactttcaaaagaggaacaagagctcgttaatgaacagttagcgaaagaatctgcagttagatcacacgtttcggaaatttccactcgtttaaagcgtggtattagattggtatctgaactttccaaagctgcttgcttagtccaaaatggcatcgctacttggttccccttggcagtcacaaagcttttgtacctatgctcggaaccaaatatttcaaagctaacagaggatgtaaataatgtgttcttgcagctttctcaaaatgtctccgagagattaggtaatatcagacttttcttaggtttggcgactttgcgtgtgcacaatgctaatggcatctcgcaagattatttacaagaaccactggttgaattacttacaagagttctttttaggatcaagttcgtctccaaccaagcagcaatagattccatcagtttgacatatattttaccattgttgattaatgttttagaaaagggtaaggcgattgcattaaagaatgcggacaagcctgttgttaaggctgagtttgttgaagaagatgaagaagaagaacatctgttactggccatggaaattatttctgtacacgctgaagcttttgaggatccttccattccgagaatttccattgttgaagtgttactatctcttctatctttaccctcaaaagcgaagattgctaaagattgtttcaacgctctgtgccaaagcatatctgttgcaccaaatcaagaagaccttgatatgatactatcaaatttactatcaccaaatcaatttgtccgttcaacaatattagaaactcttgataacgaattcgaattagaaccttttatgaaatattcacctgaagttttcatttgcagatttgattcggatccttccaaccgcgagattgcagatttcatttgggagttcaacaaatttgtagtcaacgatgaattactaaaaagcttattcccactattcaatcaggatgatagtggcttgagattatttgcggcaaacgcgtacgcatttggtgcggtaagtctgtttacctctgaagagaactcctcgaaagattacttaaatgatttgctgaacttttataaagaaaaggcaaagccattggagccaattcttgatcaatttggcttggttcttgtttctgcgagtgaacaaaaagatccatggcaaggaagaagtaccgttgctattacattaaaaatcatggctaaggctttttctgcagaggatgatactgtcgttaacattataaaatttttggtcgatgatggaggtctagtagacagagagcctattgttcgtcaagaaatgaaagaagctggtgttgaattaattacgttacatggctcacaaaactcgaaggatttaattcctatatttgaagaagcattaagctccagtacggacagtgccttaaaagagaacgttattattttgtatggtacattagcaagacatttacagcaaagtgatgcaaggattcacacgatcattgaaagattgctttcaactttggatactccttctgcggatattcaacaggctgtgtcggcttgtatagcaccactagttttccagttcaaacaaaaagttggtgattacttgggtatcctaatggagaaactgctgaatccaactgttgcttcttctatgcggaaaggtgccgcttggggtatcgctggtttagtgaaaggttacggtatctcggctctctcggagtttgacattattcgcaacctcatcgaagctgcagaagataaaaaggagccaaaaagacgtgaatctgttggcttctgctttcaatatttgtctgaatctctaggaaagttttttgaaccatatgtgatagaaattcttccaaatattttaaagaatttaggggatgctgttcctgaagttagagatgcaaccgctcgtgccactaaggctataatggcgcatactacaggttacggtgttaaaaagttaattccagttgctgtttctaatttggatgaaattgcttggagaactaagaggggctctgttcaattgttgggtaatatggcttatttagatcctactcaattgtcagcttctttgtccaccattgtcccagaaattgttggtgtattgaacgactctcacaaagaggtgcgtaaggccgctgatgaatccttgaaaagattcggtgaagttatcagaaatccggaaattcagaaattggtgcccgtacttttgcaagctatcggtgatccaacaaaatacactgaagaggccttggattcgttaattcaaacacaatttgtccattatattgatggtccttcactagcactaattattcatattattcatcgtggtatgcatgatagatctgccaacattaagaggaaagcatgtaagatcgtgggcaatatggccattttggttgataccaaagatctcatcccatatttacaacagctgatagatgaagtggagattgctatggtggatccagttccaaatactagagccacagcagcacgtgctttgggtgctttggtagaaaggttaggtgaagagcaattcccagatttgattcctcgtctactagataccttaagtgacgaatcaaaatctggtgatcgtctcggttctgctcaagctctagctgaagttattagtggcttgggcttgaccaagttggatgagatgttaccaaccattttagctggtgtaaccaattttcgtgcttatatcagggaaggattcatgcctttgctgcttttccttcctgtttgttttggatcacaatttgctccatacattaatcagattattcagcctattctttccggattggccgataatgatgaaaatattcgcgatactgctttgaaggctggtaaattaattgtcaaaaactacgctacaaaggccgttgatttgttgttgcctgaattagaaaggggtatgttcgatgaaaatgacagaattcgcttatcttctgttcaattaaccggagaactattgttccaagttactggtatttcctccaggaacgaattttctgaggaagatggtgatcataatggtgaattctctggtaaattggtcgatgtacttggccaagaccgtcgtgatagaattttagccgcattatttgtatgcaggaacgacacttctggtatcgtacgtgctacgacggttgacatttggaaggcattggttccaaatactccaagagctgtgaaagagatccttccaacattgactggtatgatagtcactcacttggcttcatcatccaatgtattacgcaacattgctgctcagaccttaggtgatcttgtccgtcgtgtaggtggtaatgctttgtcccaactgttaccaagtttggaggaatctttgatagaaacatcaaactcagattcgagacaaggtgtttgtattgctctttatgagttaattgaatcggcttctacggaaacgatatcacagttccaatctaccatcgttaacattattcgtacggcattaattgatgagtcggctactgtcagagaagcggctgcattatcttttgatgtattccaagatgttgtaggaaaaactgctgttgatgaagttttaccatatttgttgcatatgcttgaatcttctgataattctgactttgctttgttaggtttacaagaaattatgtcgaagaagtccgacgtaatcttcccaattttaattccaaccctattagcccctccaatagacgccttcagggcttctgctttaggttctttggcggaagttgctggctcagccttatacaagcgtttatcaattataatcaacgcactagtggatgcaatcataggtacttctgaagatgaatcgaccaagggtgcattagaacttgcattagacagggtattcttatctgtgaatgatgacgaaggtcttcacccattacttcaacagattatgtcactactaaagagtgataatatagagaaacgcatagctgttttagaacgtttgccaaatttcttcgataagactgttcttgattttgatgtctatattccgaactttgtctctcacgcaattttatcattagatgatgaagatcaaagggttgttaatggtaacttcaatgctttgtctactttgttgaagaaggttgataagcccaccttagaaaaattagttaagcctgctaaacagtcattggcattaacaggcaggcaaggtcaagatgtcgctgcatttaagcttccaagaggccctaactgtgttttgcctattttcttgcatggtttgatgtatggttcgaatgatgaaagggaagaatctgcattagccattgctgacgttgtttcgaagacccctgccgctaacttgaagccatttgtgagcgtaattactggtccattaattcgtgtcgtgggtgaaagatttagtagtgatatcaaagcagcaattttatttgcacttaatgtgctattcattaagattccaatgttcttgaggccttttatccctcaattacaaagaacatttgttaaatccttgtctgacgctaccaatgaaacgttacgtctccgcgccgcaaaggctcttggtgccctgattgaacatcagcctcgtgttgaccctctagtcattgaactggtgacaggtgccaagcaagccacagatgaaggtgtcaagactgcgatgcttaaagctttactggaagttattatgaaggctggttccaaattaaacgaaaattctaagacaaacattgtcaatttagttgaggaagaaatgttgggtagcaatgacaaattggcagttgcttacgctaaattaatcggatcgttatcagagattttgtcgaacgacgaagcccacaagatattgcaagacaaggttttgaatgcagatctagatggagaaaccggtaagtttgctattctgactttgaattcctttttgaaagatgcaccaacacatatattcaatacgggcttgatagacgaatttgtaagttacattttgaatgcaatccgttcccctgatgtttacttcggagaaaatggtaccattgctgctggtaaattacttttattagaaggagaaaagaggtctccatttgttaaaaaggatgctgcagaaccattcaaaattggcgatgaaaacatcaatctgttaattaatgagttgagcaaagctgtcttacaaccagccagtaattctacggatgtaagaaggttggccttggtggttataagaacactagccagattcaaatttgacgagtgcattaagcaatacttcgatgtagtaggaccatctgtattttcttgcttgcgtgatcctgttatcccaattaagctcgcagcagaaaaagcatatttagctttgttcaaattggttgaagaagatgacatgcatactttcaacgagtggtttgctaaaatttcagatcgcggtaacagcatcgaaactgtcacaggtactacaattcaattacggtctgttggggactataccaagagggttggtaaaaggttagcaaatgtcgaaagagaaaggattgctgccggaggagacgcggaaacaatgtttagtgacagatttgaagatgaaagagaaatatgggctgtcggaggtgttgaattaaccactgatatttgaagaaaattcaatgtggtaacctcgttactttttgtatttgatatattattctcgttatataatacataccacataatgatataaaagacaaagatattttgaagtcttccgctgtgcataagggttatttatatatctattgctcccagcattgtagctaataagggcttgataattattcgtacccggattcataattgtcaactaactgccaaacccagcgctctaatagtggcgagacttgccaccacatcatatcgttacgatctgtattggcgattcctaaacaccaaataactgtcgactttaaatagcgtctcagaaataacttataagagaggtttattattagaactatcaataaaattagagcaataattttaaacggtttgatacaagttatctctttattagacataattgtccagatgtattacatgaactgagtgacttgctctaatgttgtagacactgatgtccggtttaattaagaaagattttggaagtttcacgatatcgataatgctgcgggagaagctttcaaattataagaaaaggcttttttttgttgttttcagagtagtttggtgacttgtccgtttcagaagtgtctcgaatacggagtgcaccttccaaaaatgtttctgacggcatcgaagagccgaactcttatacaatacatgtcatttttaacaatgatgcaaataacttttaaggccttaacactctacataatatgctaaaaacattaaaaaaaaaaaaaggaaaataaaaaaaaaaaaaaaaaaaaaaacgggagattaaccgaatagcaaactcttaaactatgaaaaggcaatcaatccactgttttctttttccatttcttctagcctatttgaactgtctgcttctgtttcttcattcatttcttgaatgattttatcctcttcttctgtcagggcacttatatcttgtgtcggtatgcattcagcatccattctgacacttggtgctccttgcaagtatctgatattttctagacatcgtattctaatgtcttccagtagttttttactgtttttgttttcgtataagtcatctaacataggataaagtgaataatccggcccgaatgagtcccggaatgggatatcttcggggatgtcttctggtagcaagacatcatttaaaattcctgtctcgtaggtccaaagccgtgatacatttctaggtgtataacctccaccgcccactactagcattggtagaccaaatgatttgacaaattttacgcattctccatgtgcctttatatttaaattgaagcatcctaagcgatcatgacctaaggaatccgcaccgcattgttggacaataagtgttggtttgaaagtcattattagaggatctacaattgacttgaaaaggtttatatatgagtcgtcatctatgccatcttctaggggtacatttaatgcgaaatgttttcctttgtcgcaaccaatttctgtcagatcaccagttcctgggaaaaattcgccattatatttatgaaaagacaacgtgaagaccctatctgtggtgtaaaatgcctcctggacaccatcgccgtgatgtaagtcgatatcgatataaaggattcttgggtgatatcgtaataagttcaaaatagaaagcacaatatcatttacatagcaaaacccagatggactattcttttttgcatgatgaagaccaccagaccaatttatcgctatgtccgattgattgttgattagtttcctggtggcgtcaaggctcgcaccagtgtatagtgttgtataatcatataaattttgaaaaataggacagtcgtctccaatgttaaaattttcaagtgtgcctctgggcagtttgtttgcattttctggtgaaaccttcgagagaaaattcacgtagtcttccgagtgaaattgtagtaattcgtctctggtagcgcttcttgtttcataaaggtccataatcttgtgcaatccataagaggaaactaggtgatccgttagcattaaccgaaacggcttcattggatgcttaacaccataatggtaatgtgaaactttggagttaaaatgatacgataccctgggagaataagcagaattaaactcaaataatggttcgttctcctttgttttcacatcataactaaatgttccagacatgttgcgtgttgttattcacttgatacctgattttaacgtacttgagtaatctggcgtcttttctataactgtacattggcgacacacctaaaactgattagaatcgtttcaagatgctttcagttcaacatttagtaacatagtaggaatatcacgtttaacgatgccccaaagaacatcgagaatcctctatatagagtataaacagggcattctacattggtatagaggtgccttaggtatatagtggtaccggtcacataaattgacgggaatatgcgtctttaggcggcttttggcgtacagtattgttctttctttcgtgcttgtgaaacttgttataaacaaagaaagagaaagatctccccggcattctggaagatcggtaaccgctggagctataggaaagggagatggataacagtaaagaaaacggaccatataagttagcattgggggttttcgaaaaaaataagaattggcattcagacttgaattcataaaagttgtaagcaggctatgattaacgataaactagtacattttctgatccagaattatgatgacatcctaagagcaccgctttctggacagctcaaagatgtgtattcactgtacatcagtggcggatacgatgatgagatgcagaagttgagaaacgataaagacgaggtcttacagtttgaacagttttggaatgatcttcaggatattatatttgcaacgccgcagtccattcaatttgaccagaatctattagtggcagataggccagaaaaaattgtttacctggacgttttttccttgaaaattctctataacaagttccatgccttctactatacattaaaatcgtccagttcttcatgtgaagaaaaagtgtcgagtttaacaacaaaaccggaagctgattcggaaaaagaccaactgctgggtagactgcttggagtcctgaactgggacgttaacgtcagcaaccaggggttaccacgtgaacaactgagcaatcgcttacaaaatttattgagggaaaaaccatcatcttttcagcttgctaaagaaagagccaaatacacgaccgaggtcattgaatacatcccgatatgtagtgactattcgcatgcatctctattgtccacctcggtgtacattgtcaataacaaaatcgtttctttacaatggtccaaaatatccgcatgtcaggaaaatcacccaggattaattgagtgcattcaatcaaaaattcactttatccctaatatcaaaccacaaactgatatttcgttaggagattgttcctatttggatacctgtcataaattaaatacgtgtcgatacattcattacctgcaatatattccgtcatgcttgcaagagcgagctgatcgtgaaactgcgagtgaaaataaaagaatacggtcaaacgtttccattccattttatactctgggcaattgctccgcacattgtatcaaaaaggctttacctgcacagtggatccgttgcgatgtgcggaaatttgattttagggttcttggaaagttttcggtagttattgcagatcctgcatggaatatccatatgaacctaccatacggtacttgcaacgatattgaactattaggtttgcctttgcacgaactacaagatgaaggtattatttttctttgggtgacgggtagagctatagaattgggtaaagagtctttgaataactggggttacaacgtgataaatgaagtttcatggataaagacaaaccaactgggtagaacaattgttacaggtcgtacgggtcattggttaaatcattctaaggagcatttattggtgggcttaaagggtaatccaaagtggatcaacaaacatattgacgtcgatttgatcgtatcaatgaccagagagactagtagaaagcctgatgaactgtatggtatagcagaacggttggcaggcacccatgccagaaaactagagatattcggaagggatcacaatacgcggcctggctggtttaccatcggaaaccagttgacaggaaattgcatttacgaaatggatgtcgagaggaagtaccaggagtttatgaagagcaaaactggaaccagccacactggtactaaaaaaatcgacaaaaagcaaccttcaaaattacagcagcagcatcagcagcagtattggaataatatggatatggggagtggtaagtattatgctgaggccaagcagaatcctatgaatcaaaaacatactccctttgaatccaaacagcaacaaaaacaacaattccaaacactaaataacctatattttgctcagtaaagcgttaaataatccttttaaacattaatagcattgcataaaaaagatggtcataaaaaagactgcagcgggaagtaaatggtttcctggtctgtattagacaaactttggaatagagaaggatatggtttatgtccaataattattatccgagtccgtgtatttttttacatcaactggaacaatttattacccggatgtttaaaaattgttgtcgcctggagaaagctaatactagttctggccatattttcaaccattaaacactactaatgtaattacttgacttatttgctcccactcttggtcggttctttcccatggcgcattctaccattctttttttctactccaatcgttcttactggaaactgtgggaatagcgaagaacgactattatttgctaatacagagtaagctatcctgctgaataggtagacgatagtagtaacccaacgccgctatcctttcgattataccgctatgaatgtagtgatatggtgcggtattgacacaatatagtaatttcgggtaattttttttcccaccaatgagaggcggtactgggagtatcggtctaagagaatcgaaaaataacccccagctgggatgtgatcacgatgagtgacgggatacattaaatataacaaacatacacgttgccttgaacgttttcactacacatcgcatgtgttttatctagatttaaaatcatattactacagttctacagttatacaaataacaaacaatagaaaaatgtttagacagtgtgctaagagatatgcatcttcattacccccaaatgctttgaaacctgcatttggcccaccagataaagtggcagctcaaaaatttaaagaatcattaatggccactgaaaagcatgcgaaggacacatctaatatgtgggttaaaatctcagtttgggtcgccctaccagcaattgctttaacagctgtgaacacatactttgttgaaaaggagcatgctgagcatcgtgaacatttgaaacatgtgccagactccgaatggccaagggattacgagtttatgaatatcaggtctaagccttttttctggggtgacggtgataagacattattctggaatcctgttgtcaacaggcacatcgagcacgacgattaattaattgattaagtgagaataaacttttcgaaaaatttttatttatgataattttactaattcttacttatttcttttatattcgataaaaaaaattcaaaataaaaaaagattaatcctttgataggaactaaaggtactaggtattttgggcggcgaagcatcattccgttcttaaacatctatatatatataattatattgcaaatgtataagcatttaaaaacataaacatgcacctatgaagaagaatttaagacgttttatttttatgttccacgcgttttggtgaagtgatgaaagaagtcctgataaagggatgtcggattaataattgatacagtgtttataagatagctaatcagaaaaaaaacgaaagaaaatggtataagtctcagaataatgataataaaacacgcttgaagtagaataaaaatataagtagagaagataaaataaaaaaataaagatagaaagattttcaatgaggggcaaatctaaatctaaaaaatttgaattcaagttcaatttaaatttcaattaaaacagtagtagtatgtggggaagatatgggataaaaaaaagtaagggaaaataaggaattattataattataatgcggaaaaaatgaataaattattagttgctgcaacagcaatactattttctcttggatgccatgagaaatgtaaaatattcttcttgaaatcaatatcgtcaccccaatccttatttcttgcagacctttgcgctagcgaaccgtatcttttgttcctgaacgctgttttgtcagcttgtaacacgatttcattcatttcggttcccgagtcctccgaatttgctccttctcctcccgctatactgcttctagagctattactacttcccaccatgcctgtgttgcgtccgttactcctacgcttgtggctgttgccactactactagaatctttattttgtatgctgttgtggatatttttattgctgttgctattaggtgcgttgtgttcatcaaaagttttgactatgccattatcattatcaccagaagttactacattaggatagatcatgaaattgttattgtaagaaccagtcattacacttgaactatcaccactaaaattaacttcaaatttatcgaaaatcgcatcgttttcataggtatcactcaatctttccttcaattgctcatgtatgtttatggttttcaaaggcttattatccatatttacgtcccaaattttgacagttaaataatctctggatgcaatatacctaccatttggactaaattttatgtcggaaattgacgacgtgatttctgtaaaaaaattatgattgattggatccaaatattcttcaaatgttttggttttattgtcacatagggaattttgtctcatatcacacaactttattgtacctttggaagaagagtacatgaataaattacattcttgcggatgaaattcagcgcttgtgatcacttcggtaagttcttccatattggttggcttgatatctacgatgttgaagctctgatctggtatgtccagattccataaattgattctcaagtcgtcagcacttaaaaatgtttcctgatcagaattcaacgatatcgaattaatgtgataggtatgtgcattactatatatacgctttggggtggcagcaatgattttgtcatgctgtgataattgaggcagtttcagcgattgtaaagataatacagccctcacggagcctcctctactgttatggttatcgggcttgccttttttcgcaaacgtaaccccttctgttaagttgttctggcttaccaattttatatttttctcataaactttccaaagttttatagttttatcatttgtgctcaaaagaaagtgtgatctttgagttggtcgtaaccatttgatttcatttatcttctcttcaatttctaaggattttaaataatcaaattctgcgtcatgactttgaaactctgttaaaaacttatattcgcaatgtctactattacttctttcaaaaagtaccacacggccacctttatcaccagtggccagataatttccagtatagtcaaattctacagctgtaattagatccgcctctgtcaccacaatatctgctttatcaccaaaacattggctgaatttaaaatcaaaattgttttgtgccattgtgcgctatattatatttctttatgcgtaagatctctccagtttgacctcgatatgttggctagattttatgaggtttacagtttatagaaacactagttttccctttcttaatatgttggtggagtgggggtaatcgtattaagctgccttattcaccctctgataggaataaaaatcgaaacaggacgaaaaaagggtgaactaaaatatagaagagagcctaattgacgtaatcgaattcttctagaatgcgtttgtatattcaattttcaattcttccagtctcttcgtggaaagttctctaacgtaatagtcttgtcttgtgcaaactccctttatctttgacgggaaatgttaggcaaaattggatggaaaagagaaaaaaggaaggaaaaaaacaaaaaaaatctacttagttaaggatctattgacgtgcgcggggggagtatatgccaattgtctcaaaaaaaaaacgtttatgccgtgccggaatagaaatagttactggtcgttttcctatctgatataaatctgagtaaaacgattattgtctaacccaatgcaatatatacagatagcattccgctcatagttaataattaacttcagacagtttttttcaatatctcattaaagggaagaaagggaggcgaaaaaaaaatcaaaaaaattatacttcgtatcaaattatattcgtggaaggtgacgatagtaatatttgatgttgaacatacttgaaacattaacatatttaatagaaaactattgtaatggttattttttattgattagaaatagtagaaaaatttacttatgtttcacctatattaatcaagttataaagccttcttggcggcatcagcaggggaaaccttgttttctctgttgaatcttggtctttgaggtggagctctgttctttctgtcttctctggatctgactctgacaattctggcgtgaatagcacaagaaacacagtagtgtaacttgttgtaagtctttggcaaagcgtattcagggtagacagaagcttcggacaaatctctgacggcagcggcttcaacaatgtttctgatagccattctcttgatagccttatcctttggaatagacttggaacagttgacacatctgactggtttgacgtgacctctacctttcttgtttctaccgttggaagctctcttctttggcattttgaatgatctaattaaatattcatcacgagtattgcaggtttgcaaagagttaaaataattagttagtaacttctcaatttttttaaaatgatcgtggcaaaaagggaaggagatatttacgtaacatttgaaattttctcggtacaatattcttcaataataagtacattgcatacgatgggcgacttccttctttttctttagttagtgtgaactcatgattggcacacttctagtgattaactggtttcctttcagaaaacaagttacatttgccatgttttaataatatcttgtcactattactttctcccaattcaaagatctcatcgttcttcccttctctactttcacacttttgtgtcgttaacatactacttaagactatggttcttttatctgtaatagcgaacaaattaaatcatttactataacgaacattaaatctagtaggtatttcaaataccaagtaatccctcaacactcaatgagaacgaagcggtgtaagctgacacttcgagttccgcctatgttactggatatgagccctccccccacgaaggttttttccttccagagccgagaacatctcccaaggagaacgaagcaataccggtaagctgcttaccgtcggggcagggaagttcaattcaactccctgtgccgagaatttacttttttcgaaaaatcgacgtctttaaaaaaagaaatcagtatgtatgggtgggtgtatggatgctgtaagcacagtctagaatcttttggaagtaacttcgcaacaacctctagctagccatctctgacagagatagaaatagtaatcagttatgacatgaatagtactaatattaataagaatttttaaataaaaatatatctcgaccttttctcgatctttttggttatgtattttttggctcttcattatagatagagcaaagcgttcgccttaaccttcctgcaaagaactttcttgtggaactttgttaacatgacgtgtgtaaaagctcagacctggtaagaatattcgctaggtttccaaaaaaaaaaatataaataaagaagaaggtaaaaagtaaaagagaaacagaagggcaacttgaatgataagattagtgatggtggtcatcatttggaacaccaacagggtttagtttgtaaacagaaccacattcccagcatctggcgacttcgttaacagttggttttaaccacataatagtatgtgaaccagcgggagaacccgtacaaccgacataacgataatcatcataagattcaatgatgatcggatctttcatggtacccttcctggacgaatctaatggtttggtgtcgaaaacatcgataccctctaatttacccaataattctaacctagctaaaccagtttcttgatctaggtctgttggaacggtaccctctttagcaccaggaccaatcaaagtttctggaccattaacttctgctaagttttgggcagttttcaccacgggtttttgctgaagcagatatctagagctacacaaagttcttgtggctggcttgaaaaatcttatagattgacgtagtgaaagcattgtgcttgttatctatttgtatggcaacatcaaaatcgaaatgggtgagtattgttagtatactgtttcttcagggagaagaatacgttgactaaaggaaagtgacagggaatatttcgcatcgaattcttcattatatgatggacaatttggacaattatgcaattatcgtctcaagccaaatagaaaagcagggaacgagttaaacttgcaaataaattttttcttaaagtcaaatccagatttgttttctcttagttcttttccgtttcgttcgatctgttaaatatcttctttcctggtagttcttctcctacatctcatgtatttttcaataagaggattataacatacatttcaaaataatcttatttcctgtttatgctaatttttacgcaattagcgtgcctaagtacaaaaaaatgttttgtaaaaagtatgaaaaaaattctaatcttcgtatatctttctttcctgtgtttatacttggaagaagcgaagtattttatccttgagtgtgtcttattttctcttccctttatttgctactaaccaagatgggagatatcgctttttcgaaggacgcctttggaatccgctgatcttattggtggacagtcagctgacagaaaacttagatcgtgacagcaaattaaacgatttgtgctactgttcaaagtgtcagtatatcactcgatgatttcaattgtccaccaggcttagattttcatgtgaaaagataatgtgtacaaaaaaatatcctccctgagcgtaatttaacataccatgaatctacctgccaatattatctaaactaaagtttgccgctgcaccgtagttttaatatatacttatgtcatttcaattaacgaccaaatttacgtagctctaagtatctacaaggagggtatacaacacctgagaacgccatacttaaccacattgcgacatcaccaccatattcaccaaatttggcagcaattgggccaatccaataggcttgcgccataccaactaccacaccagcaactcctacaataaacgcaaatgttgctgcataaccgtgcgttaaaacctcataatcttcccatttgtcccaattgtaacgatgtttagtcaccttatgttttctttttaacaaatggatattagtaactgcatctttctccacttcttttgaagatccaacaagttccggtccatttatttctcctgtaactgtaggaaactctttggtgtacaaatgtaagaaaaaccttctgaatactaaattctcttcgaataataagataaagtacatgctaatccagtagcctatcattggtaggaaatttcccaaaatagtactaaaatgattacgacctattaatgcgcataccaaacaaattatagtacaaacaatagaccagaaccagcgagggatttttgcacaaaacacactagaaagttggatggagaatgctgccgaatacgtattgatgatgttgttggataccaaactgaataccagtactaccacgcagaactttccgaagccgttccaacgctgaaaacctgcccaaagtagaccacccattccatgggaatcgtactcgactgaccaaggcttatacgacatggcaacagaagctagtaagagacctaagattccgacgaaacaggtaggcaaaaatgttccaaaaaacgttaggcaaaaaatttgaatatatggtgtatcttctgggaacaatatataatagtctgctgtaatagacccccaagtagccgtaatactatagcataatgaaaaaaaactcatccagttgccctttcgggtggaagagtccaaatttccctttgaaacgtatgcattgacgaagctgtatttatcacttgatgaaatgtacagtagtaaaaatgctgtcaggacgggtacggataagtaagtttccactttaatgacttgtttgataccgaaaatggcaactaaaaaggagcatacggtcactatgacaatccctacccataggggtactttatcattagaaatagcagctaacatttcacccccaaccacggaattaaccacagaccaacccatgacaccgataatggaagctaatgcaactaatttaacaaaccaccatccgaacaggtatctagctgttaccatctgtctgcaaccggactgcggtcccatgatcgagcaataggcagcaattaagcaaccaattgttaccgatattaaactggaggctacggattctctaaagcttaaaccgaaaagcagagggcctaataaaaacgacgacatggaagacaaaccacctgtggcactcaaccatagccccgcgacatgcaaaaattgtttctttgatgttcctcgttcatagggagatatcctctgaataccggtagactctactcccattgcgtccactttcttagaaagccatgccgccctgttgataattcttctcaaaatggacggacttgagttggccttttctgtggctatgtttaaagaagaagctgcggttccttcttcgtaaaattctattacatcagtagtatgctttgtatgatcttctttgcgctttgttgtgtccatgttgtccctattcatctatgatcgaagtttttcaagtcctgttctttgataaatactctataaagctaataatattcaacagtaatatttttatactgagaacctcaacatctgttctcttttttaatggccttctcttagacaccatcaaagcagcctgacgcagaaaatttcaggtgagataaggtgcggccgaacaaatccgaaatttacttacacgcaagtacgagtcatacacctacgggcactgtactacaatccattgtcgaaacaaaaacggcacttaatgttgacttctttttgaagtcaaatgcatacgaaaactcgcactgctcttttttcttggtgtgttgacgtatatgtatatataggtatgttaacataaggttcttacgtctcttactatcaaactacacgggagaaatgctcatcgcttgcggcttccccagacactacccgtaagattcttgtcaatgccagttcacaactttgctcaaaaacatcctttgtcgcactacccaaatgcggagtaattgaagtaagtctatcagaagatctgattttttcatctatttctggttctttattaaagacgtctaaaccgagatggttgattcgtcccgttaccaaggcgtcagaaacagcccgcaagtccaaaattttacctcttcccaagttgactaaaattaggcctggattgcagtgttccaaaaatttcctgttgattaaatgttctgtttgtggagttcccggcaatgtgaccacgattgcatgaaactggtatagttttgcatatattgtttcatctagcaaatgaaatttccagctttcgttttgactcattgtgcaatcttcgcttcttttgcaataatgtatttccattcctagcccgtattgcaacttgtaggctacttgctttccaatacttcctaaaccaagaattaagcatttctttcctcttggtgattcagcaaacatattccccagttcatggccaaaagcaaatccgctcttttctgcagctttcgcccttgcagttaatgtatttccagtttctctactaagtttttggtaataggagaactttctaaagccctccagaatgtgccacaaggcacaatctgccacatcattaccgacttgatgaagctttaaatcgtctatcaatttttcattttcatcgtcttggtagttgtataatcgaatttcatgcttgcgtaatgtatccagatcccatccgtcgtaacctcttgagcaaagcacgatacattttaaatttttccttggaaatgacttgtgttcgatgatacttcgagtcatcccaccgatttttttgaatgccggaaacccagcataaatggcacatattttgtcttgttcatgcctttctaaaaagttaagaaatgcttctttggtgtccagctgatagcgcaagatcctgaacttctctttgaatgccttggaattaagtgtggctgatgtttcgcacggatctgcgatgaaaagaatagtaggctttccagtcgttgcaggagaatcgcacattttttgtatgctcttttccttctaaatctgctgtcaacccattgtcgagtgaagttataaaagcacagctatttctatattccttttacgaccgccattacacacgttcattgaggcaaactttcctccttcgcgcgtgcgtttcccaagggtagtagtaagagcttacggaacagcccgaaaggctgtaaaagtttaatatacttactgttcttgaaattctgtctatatacttgactatttaaagttactatctttggatttgaaccttataaaaaaaaaaaaaaaaggtacatgcatattttcccttacaatttcgaactcttaatattcaattctgagtcctttctgatgagatcttgattgtaaaattcttcgtaaatacttaaaggcttatgcaggtcatcgatggtagtgttcacagctaggttcttattcaatttgttgaaaagatatttgccattttctcttacttctataatatcagcgtcaaccatcgccgctaataaatctttcttcaaatctactatattttcgataccgcagcaaagacgaaccaaatcttcaggaaaatctctctctttccttaattcgggatcaatggaagcatgggacattttgcaaggcatagatagaagcgaatttacacacccgaaagataccgtcacagcccatatactcagttttttggaactgaccagtctctttgaatgttcgaaggaccccgtttcgaaggataacacggcacctgggccattattgaacgatttatgcagcttgaaatccgggttggagcgtaatccaacaaatctagttttcgtagccttgtttgttctggtaggtttgaatccgcatgaattttctagccaatgagccaatatcatagcatttctctgctgttgatataatctaactcctagagtttttaggcccctcacaagtagccaagaatccattggggataatccagctcctgtagaattaatgacaaagtaaagcttcgaggctatttctggtgttttgctgataataacaccccccatcaaatcgtgatgaccattcaagtacttggtagcagattcgtatacgacatcgcagcctggattcagttgaagaggattacaattgagtccactcatcatagtattatcaacgacaactgtagtgtcgggagatatgcatttcacaaaacgtaatattctagggatatctacaaccttgcaaagcggattggtcggagactctagaagaacacaatcaactttatctaaagactggaaaacggttttgaacttttcaaaatcggaagtgtccacatgaacagagactgcatgactctgttgcttgaaaaaattcagcagcctttgggtgcctccataaagatcatcgccggctattattgttggcgtatggttgtcagtgccgttaagtaagacgagcccacgcaggatgacgtctagcgccgtcataccactgctcacagctaatacgttttcctgtgggacacgataaagcttaccaatctggtgttgaaggacacttctggtcgggtttcccgatctggaataatcgtagttctgtgcatcttcattattcaagtccactttgaaggtagtcgacaaatacaccggtggcacggaggctgaatgttggtcattttgagagccggtatttaccacaactgtatctaatctcttgatcggcatctttttgcttctatgcttttgttgtttgcttgatattttttgtttttaatgaactgtaagcacacagagctatgggatgtgtggcaatgactgtatatatatgtatatatatatatatatatatatatatatttatttatttatttatttaaaatatagctacgtatgcgccagttgtttttatcagctttgcttctggccacatttcaaccaggtctcagaggatatatggccagaaggcccctttacacacttttgagatgcgatgagtcttccaaggtaggagcatatgcctccaacagacttcggcccgaagcatgctgtgctcacgggaattatattgtgtgaagcacatgccacactttccaaaaaagagtcagaatgagtcagccggataaccaaacgcggactgtggcgccacggaaaacagtgtggcaaatttatgggcggctaatctgcaagctctatgcctggaaatgtagatgtaataatcaagacacttttgttctttcgtgtatagtgcatgaaggttaaacctccgtaaattccttgaactcttctggaattccaaattcttttcttatctgttctggcttcaaaaagaatttcttgtataaataatcaatgagaatctcaatgttatcagtagttttctccagatgcactttttttaggcggatctgttgtttattctcttgtatttttgctgcatcccatctaatgctttctattttttggagactattactctttttcttaatttcatcctgaattttttttctcttttccagtagagcctccctattgtatgatttttggcctaccgtaaattttttacgccttccagttgctagcgttttgtctagttcttgtttataagtggcaatatcacactttacttcctgtatctttttttttatcaactcgcttgaatcatacaatttttgcagtgtctgatttttaaagcaccagtagatgttaatattaccacatttttccaccgaaatgacgccgtcttcatcaatcatttgttgcactaaatctttaacgatcatgggtgagattccgcattttttaggtatgcttttctctaattccttgatgttgtagaatgtgtacgtctcttgaaaaaagttcagaatccggttctttttctcttggagtgatactgtctgtctctttggcccctaataataagaagagggtagcacgcacccgtctataagttagtgttcagtcctgtgtaccatgatggttttattagacataccattgttgaatgtttatgatactacacataaagtttccgccgtttagtctatatcgcaaagaataacggtgggacgggagatcgccttttatatgcaatttcgtgatctgggcggttattttactttttttcgacgcataaaaaagcaggaaagatggtaaattcggttcgttattcaagatttttagagccagaaagatatttgagcgtgccttcgtgagaagaggcttaggttgagacgatgatgctgaaattatggcaagacacgaattcttcttcaagtttcccttgtcataataagaagagaaaaacatacctttatgtcggttgcaattaagaaggttgtatagagcatctcaaatgctgcttttactttattaaacgttgaccaaataatacggcgcttttgtttcgacaacgacacactatgatgcaaagcggatccgggtaatcgataaatgggggcacccggaaattattgtaagttgaagaaagttagtgttgatctctaaatgcttcacaaaagggtggaagaagaacattttctcttgatcaatcattaatatagatggaggcagcgttctgtcaatcacagattatagtttatttatacttagtcaaaaatgaggtttaggagttcttcccatagcttaaaacatgttgacagagaattaaaggagttgattaattcgtccgagaatgccaataaatgcggtgaatgtggtaatttctacccaacttggtgctcagttaatttgggggttttcctttgtggtaggtgtgcctctgttcatagaaaagttttcggtagcagagacgacgatgccttttctaacgttaaatcactatcaatggatagatggacaagagaggatatcgatgaattagtgagtcttggaggcaataaggggaatgctcggttctggaatcctaaaaatgtcccttttccttttgatggagatgatgacaaagccatcgtggagcattacattagagacaagtatattttgggtaaattcaggtatgatgaaataaagcctgaagactttggatccagaatggatgattttgatggggaatcggacaggtttgatgaaagaaatagaagtaggagcaggagcagatctcattctttctataaagggggccataataggtctgactacggcggttccagggactcattccaaagcagtggaagcagatattctaggcaactggcagaactcaaggacatgggtttcggtgatacaaacaaaaatttagatgcattatcgtccgctcacggaaatatcaatagagcaatcgattatctagaaaaaagttcaagttcaagaaatagtgtatcggcagcagcgacaacatcaactccgcccctgcccaggagacgtgcgacaacaagtggcccacagccagctatttttgatggtacaaatgtaatcacgccagattttacttcaaattcagcatcttttgtacaagcaaagccagcagttttcgatggtacccttcaacagtattacgatcctgctaccggaatgatatatgtagatcagcagcaatacgccatggctatgcaacagcagcaacagcaacagcaacagcttgctgtcgcacaggctcaggctcaggcacaggcacaggcacaggctcaagttcaggctcaggctcaggctcaggcccaggctcaggctcaagcacagcagatccagatgcaacagcttcagatgcagcaacagcaacaggcgccattatcttttcagcaaatgtcgcaaggaggaaacctgccacaaggttatttctacacacaataaaaataagatacattgccgctgctccgcattacatatcatatagagtgacactaagtaattaaatgacactaagtaacgaaagatatctgtaaacaacgactatataccagaattagtcatattctctattgtattcaccctacacagccgcattacacagctgctccggacgttttacgctgcacatcaatgactaataccactgtatttgatccacacttagcgcaaaagtcacctgggtggcgttttccgctcgcgctccgccggtgagagcgagaaaaaaaaaagggattgggcggtaatgtaaggaaaacccactagttaaaatcaatgagataaggaactctctttttttcccgttaatcatcttttccttgttcgtttcgtgtatctgtaatgaatcttatcggagtaactattactggaaagccataccgttaaagaagcaagcatatcattcgtattcaagcatctgtttttctttttaaccgctcggctctgatttcttaaaccatttcccccatcagcatcagtttgtgatttgtaactatatcgatcgtggaatcgatggaattctaagcgtcatttagttggcaacaaaaggaatcgagcatctcataaaggagcttatattattaatatcttcctgatcgtactatttttttttagctttttattttttaggccgaggttaattctagaacgccacatttcatcacctttaagttaagtaccaaggccatcttttaccctttttagtttctggggaaacagagaacagtactatagaagataaaaagatataatacaatcgtagtaatagtacccataataaaataacatataatataataaaaacataaggcaaaggagataggagaataatcattgatatctccacaaaacgaatttgaagctaccccatattttcaaatctcttttacaacaccagacgagaaattaagaaaatgggagacattaaaaataaagatcacacaacctctgtgaaccataatctaatggcaagtgcaggaaattacaccgctgagaaagaaatcggaaagggttcgtttgccactgtatatagagggcatctgacatccgacaaatctcagcatgtagccataaaggaagtatcaagggcgaaattaaaaaataagaaattactagagaatttggaaatagaaatcgctatcttgaagaaaatcaagcatcctcatatcgtcggacttattgactgtgaacgaacatcaacagatttttatttgatcatggagtactgtgctcttggggacctaacatttctgttgaaaaggcgtaaagaattgatggagaatcatcctctactaaggaccgtatttgaaaaataccctccaccgagtgagaaccataacggcctgcatagagcgtttgtcttgagttatttacagcagttagcgtccgctttgaaatttttgaggtctaaaaacttggttcatagagacatcaagcctcaaaacttactattatctacacccctaattggatatcatgattcaaaaagcttccatgaacttggatttgttgggatctacaacttacccattttaaagatagcagatttcgggtttgcaagatttttgccaaacacgtcattagcagaaactctttgtggctcaccattatatatggcaccagaaattttgaattatcaaaaatataacgctaaagcagatctgtggtctgtcggtacagtggtattcgaaatgtgctgtggcaccccaccgtttagagcttccaatcatttggagttattcaagaaaattaaaagagcaaacgatgtcataacgtttccttcatattgcaatattgaaccagagttaaaagagttgatatgtagtttattgacatttgatccagcccaaagaataggatttgaggagttttttgctaacaaggtagtcaacgaagacttgtcttcttatgaattggaagatgatttacctgagttagaatccaaatcaaaaggtattgtagaaagtaatatgttcgtttctgagtatttatctaaacagccaaagagtccgaacagtaatcttgcaggtcatcaatcaatggcagataatcccgcggagctcagtgatgccctcaagaacagcaatatattaactgccccagccgttaaaacagaccatacacaagccgtagataaaaaggcttcaaataataaataccataatagcctagtttcagatagaagctttgaaagagaatatgtggtggtagagaagaaatcggttgaagttaattcattggcagacgaggttgctcaagcaggattcaatccaaatcctattaagcacccaacttcaactcaaaatcagaacgtcttattgaatgagcaattctctccaaacaatcaacagtattttcaaaatcaaggagaaaatccgaggttactgagggccacatcatcttccagtggaggtagtgatgggtctaggcgaccatctttggtggatagacgcttgtctatatcctcgctgaatccatctaatgcattatcaagagccctcggtattgcatcaacgagattgtttggtggtgcaaatcaacagcagcaacagcaacaaatcacatcttccccaccgtacagtcaaactttgttgaattcccaactttttcatgaacttactgagaatataatattaagaatagatcacctacagcatccagagacactgaaattagataatactaatatcgttagtattttggaatctctggccgcaaaggcatttgttgtttactcttatgcagaagtgaaattttctcaaattgttccattatcaacaacattaaaaggcatggctaactttgagaacaggcgcagtatggatagtaatgctattgcagaagaacaagactcagacgatgcagaagaagaggatgaaacgttgaaaaagtacaaggaagattgcttatccacgaaaacttttggaaagggtagaactttatctgccacatctcagttgagtgcaactttcaataaactaccacgttcggaaatgatccttctatgtaatgaggccattgtcttatatatgaaggcattatccattttatcaaaatctatgcaggtaacgtccaactggtggtatgaatctcaagaaaaatcatgttctctaagagttaacgtgttggtacagtggctaagggaaaaatttaatgaatgtttagaaaaagctgatttcctgagattaaaaattaacgacttgagattcaagcatgcttctgaggtagctgaaaatcaaactttggaagaaaaaggtagttcggaagagccagtatatttagaaaagctattatatgatcgtgcattagaaatatctaagatggccgcacatatggaattaaaaggagaaaatttgtacaactgtgaattagcttatgcaacttcactttggatgttagaaacttctctggacgatgatgattttacgaatgcctatggtgactacccttttaaaactaacatacatctaaaaagtaacgacgttgaagataaagagaagtatcatagtgtgttggatgaaaatgacagaataatcataagaaagtatattgatagtattgcaaacaggttgaaaatattgaggcagaagatgaaccaccaaaattaagtgatgcataatatggttttcttattaagtacaaatgacctgctatattttcaagtatcttcatgattatgttatgctactctcgaaatgctttacgagttcgtcattaaagtattcaaattttattttccctttgtgttttgttttgtttttatttctacgtgatttttttcttgaaatccagctcttttatacctggatgggttttattttgatgtttaaatgttaattaaggaaattattgaattccttcggtttcggtgtgtttttttctttttaagtttttttttgttgcgtttagtacttgcctttggctatacatatccttttaatctaatttttatttcttcaaaatttgattctttaaccttttgttctatatatatatataaatgtatgtatgtatgatttgattgaggaggctttaacaagtcattaatatctttattatttttacttgttgagttcattaaaattcattttataatttgttgttacaaacagtattttacaagtcataataaacgttcaaaaacaaacacaatattaaaagaattggtattaggatccgacatgacaattaacttagatccttctatcaagtttctaatcatatattacatctattaaaataatttacatatatcatgctaaagcttataaagagacattcttcttctcgtgcgctgggcgtcgctagcctcaaatacaagtgatgcgtctgcttctattctaaggtcatccttgctgttagatttcccttctaccaggtgggcttttatacgttgaggtacattaccgacaggcgtaagagtagagctcaaacttgcttccgtactctcaaagggatattctcctacaggagacatagttgtatattgtggaaactcacaagaattcactcttaatgaacttccactctcacctatcaagcattgttgatcaccgattgctggggcatcctgaatactgatctgagatgcaaaagcggtggatgatgtgaaagaggaaaaggacgaataggatgactctctagaaccgatgttgtgatatgctgagggtgataaggtatttgcgtcgtatattgatggagaatatgttgaatttctgtcagcaccagtcctaaggttattgtggtcaaaattttccatataaacgctatctaaagaggcgaatgatgaattcactggtaggctgaccaattctacccttttgcatgaagagggcggtgaaactttcaactcatgaaacgtctccaaattggtcaatacggatgctgcatcgcttttaccataatggcacataaacggatgtaccttgatgtctgctagttttatccgtttgtcaggatctttttgtaacagcttcttcaataaatctttggcatcagtgtattcttccattgtgattcccgaagtggcaccattcaacatttcctcataagatggaaattctaagggtttattgataatactgtcgaaaagttctaatcctgaattggcgttgaaaggcaactttccaaacaacaagcagtatatagtgacccccaatgaccagatatcgatggcagatgagcaggaatactctttttcagtggagcaaagctcaggtgcaaaaaaagcaggggtccctaaggctctagattttaaaagttgttcatgcgatgattgtatattagtacttccggtggcagttgacatagcaacgccaaaatcggatattttcaccgttccgtttgatgaaattaacaggttcgatggtttgatatctcgatgcgttatcccttgggaatgtaaatactccagacccgatactacatccaacactaccttcctcgactgttggaaagtgagtattgatggtcccactgcttttatctccattttgttttctggacaccatttaacgggtccccttgagcaatattctaatacaagataaacctttgtgctctcagggtcattcaaaatttcatacaattccacaacgttttcatgatgacatcttttcattacttcaatttcttgattaacccttggattttctactttcaattgaagagaatacccgcttcttttttcgaatctattaagaatttttattgcaaccaacgcacctgtcccgagatctcttgctaatttcactttgccgtactgtccattacccaaagtggctaaaatttcaaagttgttaaggatttgtctcttagttaagggattatataatagtttgacttttcttgtctcttttatacgactactactattgctcgcattattatataacagagatgatcgaggcagcggctgaacaggttctttaagtagtaccatattcttcaaagcttcctttttatatgcagaatatgtgcgcagcaatttcaaggcgtagagtacgagtcactagaggctcgagcattatataccacttacaagtagtgtttcttattggggacacctgtcctaacaatgtatggctttatataccgcgcggataagtaaggcacacccgctcttcgtataatacccgcacaaaagattcagggaccgggtatgctcaacgaaaaaaatagccaagattgttgcgagtcctcatcaatgaggacatacagagaataaaaacagccatattttgcttgctgaaggacgttgtgcaaaccgaagatatcagcggtagtctttataggacccgttggtttattatatacaaagggatctttaaaaggtccggtgcgaggggacgggtggagatggaagttatcaaccaaatgcaatttatccgaagcgcaaaaaaaataaaggtgctccgatggaccttagaaaggaactccaaaatgctgtgatggaccggcgagggcggtaaacgaaactaccacattgcataagaaacaaaatgtacggccccttctacacaatctatttatggttttcgtcttgacctcctaattacttaattaatgattacatttcttaaaagcacaaaaataaagtagctacccttcttaagccatagtagttaaagcctcaagtgcattgataatctcctgaccctaggtcgtctttcgcgtgggctatcgccacctaaggaaaggattaaatggagcaagtattggaaatgtaaagaaattgcagaatgttctgattacttttcatcacccaaagagtccatactaccactaccaccaaccattgccggtgagcggtttcttgctcattaacatgacgtacaagggaacggaatgtcccttgtacgttgtaatgtcttttgctctcgtaaagaagcctatacacgccccttccttccgcccttcggcatccgctgccaactgggtgggggctcaatggatctctttactctggcccttagaagccttctgaaattctcggcttaggcatcgaacgatgaagaaactaactaaaaatatacgccatttttttggggagggggggccgcactgaaacgcgaaatgccaaaaaaacgcgaaacgccgcagtaaaaggtcagtaccgcgcaaaaaatacaaaaatgacaacaatattggcctttcttttcctaaagcaattaactggaaagcgaggttctaaacatctggccaacccctaaatttttaataattccgaagcgggatatattgcatctggcaatctgaaaagcaatagaaagaagcggcctagtactgcatagtgagtgataaaatatacatattaaggttggggaaatggtacgcgctttcaagtagctagaaagatctgaatgttctgaagtacggtttggatttatacgcggttatttcctggactagcttagagccaattaatactgacgattgcctctttttctttaccgtttatgtatgctgtatgcccttttcatgtataaaagaagggtaatttaaaaaagtttataatcatccagattccttattttttttcttctttcgccaggtgttttacccagctaagactaaccttgtggttcagattacactagtattgccgtccgatattacaattctgaaatcagttttcttgtgatcattctttttttctctcttgccattcttaaacgtggcctacaagaactcttcttctttcctggttcgcatctgtgttaaacgtatagattttcttacatagaggcctaaaaagcataataggtggtttcctttcaatatatatctgaaacattgaatatactgaacacaattcacatttcaaaaccttgggtactgttgagtcaacatcaagatcagcctatttcataatttactttatcttttcacacaaaaagagaacaggtaaaaaagaacagatctgctagccccgagaagatcattgacacatcattgattggcaagttaagtaataaaagaaaggtaataacatcaagaagtcaagcgccttgaaattactagatttggactacggatcagcaaaagcctgctactacaaccgccacttttactattccttaagataaaagctaaaaaaccaaaaaaaaaaaaaaaaaaacctcctcaactcctctccaacacatagtaaagcgaattctacgcaaatttataaatcaattacgatttttccagtttctcttatggtatgtattatctcttaattcccaatatttttcttcgccaatggagcataagctttaacgggatcttctaacaacaaatagcataataaccaaaaaccagcttcagtgggatcagcctatcgacacgccttttttagcggtctaacaatctccgtttatgtcgtatggaatttctgatacttgaccctaccttatttctcgaatatgcctataaggattttctcgaaagaagggcttcgggaaagaggcgcctcaggcaaaaatgagcaaaaaaaaaaaaaaaaagaaaagattcgaagatctatgaaaaatttatgcagattcgttgagagttataaggattttactctttatggttataggtttcattctaaaatcaagcataaattttgtgttttgtcttcctcttttcctgtcctctttttttgccatcctctgtcgccattgaagtcgaactttatagatagatttactcttgattctcacgcatctcaggccacctggacactgtacatggttgtgattgttctctttctcagttatcgaaattgatcctaggcttatactccaaaatcggctctgcacacgccttatttttgtggtttcactttactaacacaacattcttttattcaatcagatcaataacgaaccatttccatctgccgactcagcatcgattttaactacgtctacatcaaataactccttaatgtcttacaatcatcagcctcaactatctattaactccgtccaatcactcttggagcccgtgacccctccgcctttgggccagatgaataacaaaagaaaccatcaaaaggctcattcgcttgatctctctggttttaatcagttcatatcatcgacacaatctcccttggctttgatgaataatacatcaacatcgaattctgctaactctttttccccgaatcctaatgctgctagcaactccactgggctttcagcctcaatggcaaatcctccagccattctaccattaatcaatgagtttgatctggaaatggatggtcccaggagaaaatcaagccacgatttcacggttgttgctccttcgaactctggtgtcaatacctccagtttaattatggaaacaccatcctcttcagtgactcctgctgcatctctcagaaattttagcaatagtaataatgctgcttccaaatgtggagtggataattcgtcatttggtttgagtagctcaacgtcttcatctatggtcgaaatcagcgcactaccccttagagatctggattatatcaaacttgccactgaccagtttggctgccgttttcttcaaaaaaaattagaaacccccagtgaatccaatatggtgagagacttgatgtatgaacaaattaagccatttttcttggaccttattttggatccgttcggtaactatttggttcaaaaactatgcgattatttaactgccgagcaaaagacattattaatacaaacaatatatccaaatgttttccaaatatcaatcaatcagtacggaactcgttccttacagaaaattatagacactgtcgataacgaagttcaaatcgatctcattattaagggattttcccaagaatttacttcgattgagcaagtggttactttgataaacgatcttaatggtaaccatgtgattcaaaagtgtattttcaaattctcgccatcaaaatttggtttcatcatagatgctattgtagaacaaaataatatcattaccatttctacccataaacatggttgttgcgtactacaaaaattactaagcgtttgtactctacaacaaattttcaaaatttctgtgaaaattgtgcagttccttcctggattaatcaacgatcagttcggtaattatatcatccaatttctgttagatatcaaagaattggacttttacttattggctgagttatttaaccgtttatccaatgaattatgtcaactatcttgtttgaagttctcctcaaatgttgtggaaaaattcattaaaaaattatttagaatcattactggatttattgttaataacaatgggggtgcctcccaaaggactgcagttgcttctgatgacgtgattaatgcttctatgaacattcttttgactaccattgatatattcacagtcaatttaaatgtgctaatcagggataattttggtaattatgcgttacaaacgctattagacgttaagaattattctcctctgcttgcttacaacaaaaatagtaacgcaattgggcaaaacagctctagtacattgaattacggtaacttttgtaacgatttttcattgaaaattggtaacttgattgtccttacaaaagaattacttccaagtattaaaactacatcctatgcaaagaaaattaagttgaaagttaaagcttatgcagaagccacaggtataccattcactgacatatctcctcaagtcactgcaatgagtcataacaatcttcaaacgattaacaacgaaaataagaacccccataacaaaaatagtcataatcataatcataatcataatcataaccatgctcacaataataataacaataataatcaaaagagtcatacccgtcatttttctttaccagctaatgcttaccatagaagaagtaacagctctgtaaccaataatttctcaaaccaatatgcacaagatcagaaaattcactctccgcaacaaattatgaacttcaaccaaaacgcatatccctcgatgggagcaccttctttcaattctcaaactaacccaccattggtaagccataactcgttacaaaacttcgacaaccgccagtttgcaaatttaatggcacatcctaattctgctgcaccaatccattcgttctcatcatctaacattaccaatgtgaatcctaatgtttcaaggggatttaagcagcctggatttatgatgaatgaaaccgacaaaattaatgctaatcacttctcgccatactctaatgcaaatagtcaaaacttcaatgaatcttttgtgcctcgtatgcaatatcaaacggaaggtgcaaactgggattcaagtttgtcaatgaagtcgcagcatattggtcaaggcccatataatcaagttaatatgagccgcaacgctagtatttccaatatgcctgccatgaataccgctagaacatctgatgaacttcaattcactttgccataatacttttttttctttctttttctttccttcttactgtacaaatattttacgcagaaatcaaagacaaaagaaaaataaaaaataaaaaataaaaaattcaactaagcaatgacgtcctactaaagtcccaaaatttgagccggaaaaaaatggtaaagcaaactattgccatctttatattttgtattctgtttccgaacacgtatccaaaatcctcccactgcctttgcagggttagcattgctccctaccaaaatgatctaatttttttttgaatcgttttttgtcaacgattatttttgttttaaattcctcatcttctgaacttacgcccaactattatttaattcattcattcattaagcaatccatacgtccattcattcattcagttttctttttgtctattactgtcattttattttcaaatccaattgtcctttaggacactaatgtgttaaaatatccattcgctcaagcatttttaataaataggaaaataccgtttgtttttctttgtcatttgtataaatttttctactggttcctgtcttggttggctttattatatttaggtttaacttgtactaacaatgatacatatttgtatattttattataatatcatatctaactatatctaaaatcgttgaactattcagaatggaattgtacaccaagaagaattatgctataacaccataaggtcattacatttgggttttgactgctaattagttcgaagtcggcgttaaaatttaaagaatatttatacatatgaatatgtatatgaatgcaaagtatgctaaaatatttataaagcaaaaatctcggtgggctaaactaggtcaaagcagatgttatgaagatattggccccattgtagggatcatcttctctccgaattaagatgcatattttttgagaaagtgcttcttcaggtatatcgtaaggtgaagtactgctctcttcacctagaggttccacagcatcaaacggatttacgtaccttgggggtatgaaagccgaatgtaggtggatagattcaaactggaagttttctaacctacagtagttcttcatacctcctattggatagagggtgatatttccaccttcggatttttcgtagtcaagatttccagataaagtggtacaaaatacttcaaaatcaccctttccgtccctagcgctagttgaaccataaatgaagtagcgcccgtcatccgatatctcgagtatttctgtatccttagtcacgtttaagaacttagttttaaaagatacaaccgggatttcggtcagaatgtcctccaggaacgtatctgctataaccagttgttgcacattctctttgtctgccattccagatataagtattaggcctttattattcaatgcttttatggaaacaacagattttagggaatttctgataggttgatttcgactttctgatgtcataccgttggtcttggagtactgtaatgtcatgtttgtaatattagtgaagactattgccattgaatcaccatttctgtaacctaaataaaacacaccggtgttcgttttttttaaaggtgataaagcatcttcttgtagacaaaatgatagggaagtaatgtcactcctacttttgtgttttcttgagcttttggcaggagaaaagatatagggatttggaaaggtttctggaatcaaatcataaaaatgacaacgataatttacggtaataatcaacgtgtctccaacaacaagagaatcatggacttggcaattttctttgagtttgacctgacgaattttgagcagttttaaggaagaaaagtcttgtaaaaagatggcaaaagtatgcacgttagatctggtattaacgttgtgataaaaataatggctcggcccttccttgatggcaactgttctctcaagtttcattgttttgaacacatcagttggctcggacttatatttcaacataggatttaattcagccatggaaaaccccgtaaagaaattttcttcagaaaaattatccagggatgaaaatcctgcgacatagcccttgtttgttgcaaatactaatttactatgaaaacatccttcttgagttaccaataaaatacaatttgctaatactcctatctgtatcctgtgtggaaaattgagtgattttacgttagcagaactatgtgagtgatgaccttcagtgagagaatgcgatgcatactgcatatttaaaccaatcatgtacttttcatatgataaagggcgaaaagccctttccaacggattcagaagactaagcttgtacttttgtaatgtttgctgacgtttttttttaatcatagaaaattttttatcgtaattttcctcaacacattgtcgctttatattatcttttctgtactggttcgtcgttcccgtggtagaaatgctttgattttcagatatgcgaaaataacgtcgacgttctctatcataataaaaccctggtaagttaggtgtcatttgtttaacgtccgttaacttcccctttctgctttaccaactgctgcttatttattcgcccttttttgttttccattgttgttcatctcattgcctttttttatttttcagtttttcccatatgccaacgaggaaaaaagccctttcaaccataccaaaaaaaatgtatttgaagtaatgaataaagaatgatgatcgctggcgtttaacatctagcatatatctgcaataatttatcactccagaagaaacatccatcgtcaacaatttgatttaattgttctcttttgaatacatattctctctcgtacggtgggatcttgttattgcttgccattaaaaacctatattttgtctttcttctgatgatttcctgggatttctttttgtcctcgttcccttcctgagtggagggaaaatccagtcttccaaaacctgggggggattttgatctattcctcaagttatcaaacgcaaattcgtagtccgaattttgcgattctataactactgacaatgatctgtgtttagaatcctctggctttccaacttgggcataaaatcgctccaattttcttcttcctctcttaaccggggcgatatcttcatttggtctaaagtcttcgagaatccaggctcgctttgttaaagggttcgtattgaagtcaaacaggaaattatccttaacatttttgtataaatttggcgatgtagattcagggttctcgagctctattcccaatagttttcttgttttgttctctttatcattatctttttcgtggattacagtatcagagcaatcttccaaatcgcttaagttgttgaggccatttaaaggcgaactaaactccgaaattttccgtttatgcctattaggtggcatagtaaccagcggtaactgcacagtgtgtttattttcattacgatagtgaacctctgctgattctttctttatgtcctcatcaaactgagtaaggatgaaatcttcagaatcttgctcacctggccccgcagacgtctgagaggattgttgaggagcatttttttcgtgacatagaatttcagccagtttactgttaggttcttcgagaacacatttattccgattttgcagtgcttgaacacgtttcgcgattaaggtagtcacgtcatactgcacatttagtagttcatcgagactgagctccttgagaatggataagcttgactttagatacacattttcttcaccagtcaccatctcacatacaaacacctaatggcttacagcatggatggaaatgcaggtatgtgaacgataacaatgtttgcaaacgtaaacaaaaaaggtattaaagcttaaaagctttttttttgtagaacgcgcttagaaaatggcataaagaaaatggctatttgacttgattttgaaagttgttctcaagactcgaatggtggaagataacaacaggacgtttattacatggcattgcatcagtatttatcagagacttatgggcccacgaaacccaaaaataagacgaaaaagaagaagaaagagtcaaaatcagacgctaactcagacaaaacttctttgatagtaaaagaacggctaagtacactgcaacaagaacaggagaagtcaggagttgcttcattcagcaagtttgacaaacaaaaaagcaagaatatatggaagaacctggaaacaaacgagctttcccatgcaataacacatccttccgcatcgtcaattactggcaacgaaagcaagaacgatctaaaggaaatcagggctcaagagccacttgtcacagtagcagacaaatcgaaaacacgaaaaaccatatacagagacgctcaaggtcacaagattcaggaagattccaagatagacgattctagttttagtcgatctaaatatgaagatgagaaagccgcggaaagagagcaatacctgaaaaatttgaatatgggagacgtgcaaaagcttggaataaatgtagatgcacatgataagaagaaaaatcaaactgcctcgagtctgacgatagaagaccctgcaataacatttacacatgacaaagaaagaactgtaaaaacatctttactgggccgcaagctttatgataagccagcacctgagaacaggtttgccattatgcctgggtcaagatgggacggtgtccacagatcaaatggctttgaagaaaaatggtttgctaagcaaaatgagatcaatgagaagaaagtgcaaagctacaccctacaggaggattattgaaaatgagataatatataactatgcggaaagctttgtgtaaaaaataccctttgacaatccccatttgttataagctttttcttaacaagatcaacgattaaatacaaatacccctctttatataggtctcagatatactattaaagtaacctcgaatatacttcgtttttagtcgtatgttctaagtagattcgtcttttttattatcacggtcagcagcattgctttgtgactttggcgattgacattcagtagagtttgtgccagaagaaggtttaatctcgcctttcctactgttctttgtttctcccccaatagttgaaccattgctgtgctgtttaccattaatgaattttttcaaatcttggctttccttttcattgacaacaatacgacttccttgatctgaaacatttgtcataggaggtggaggtgggaaggaaatcggttgtccaaacccatgtggtgctggtggcggaatagacattccattcatattagggtaaggcatctggtgagggtgtaatgggtgaagaccattaggatgcgtcataaaacctgggggaatattgtacggcaaaccaacatctgcaacatcattcgctccaggaataggacccccaaccacattcattgggtgaggtggagttgggatattcaaattactgcctataccatcagaatattgatttgcaacggcattgaaaatagatccagcaacagttggattatcaagcggtgctttttcaaaattggccaaatcaacttgcacgttttcactgcttttctgagctggtctttttaacaaaactttctttgcgggtttggaatctttttgcgatcccatgctcttgttgtctacactttcagaattcttttcattggtatcctttttgataaaattcaataaatcatgtgccctttcttttctcagtttttcttcagattgttgctttgaaggagtcttgtgagcagttttggtattattgttcctattgttagattgctttttcttttccaaagcctttttggaagccttggagtgataaatgaactgcctgttagtaatattcaataagaaagaggcatcaagccctaagcctctattcgtgcgcaacctgccgccaaaattattaccggccacgatttcatgatcaaataagacctgaattgataatgatgaactgagagtagtatagccaacaactgtaccctttgagaaaattggtaccttaccagaatcttggatataaacaacacggtcacccaaatcgaacttttgactacgtaagagtgcaaatgatgatcttggattcaaaacagcctcacgaggaactttggctaactgttttctttcatgaccttcgatgttagctgcgtatttcatgatatgatcttccacggcagcaatcgatgtcttagttaaggagtcagactccaaagataccgcgataaacttcgatgagacatactttagccattgtttgataccatctaataaattcatggcatccttagtggaagtatcggggaaaagatcttccaaaactgggatatcattacctaccttggacaacctgaaaaaaaaatctgggaaagtttgtctatactctttcagtaaatttagagttaaatttgagtattcccagcccctagggttcctcctcgcgtaacctaaaaccttttggtgtctagcttcgaacttaaccgggataccaacattgatatgcttcccagtagcgtcagtaatcatgaacttggaagtaatcttagacaaaaacaaggggtgtaagtgcatgttcttggacacaatataagacggataatatttaacggcttgatgatccatttgtaacctttctttgccgatggtgggctcactatccaaaaacttcttttctacagtaatttttagtctgcggtcactgctgtaaccgtcaatagtagtttcaccaccataggcataatcacctaagaaaataacttttgaattcaatggaaattcctcttcaataggaatgggtcctctttctttatatctttcatcctcgttgacaacagattcaacaaccagttgcaatggatagtaatctggggtagggctaaaggtcttaatataaccaccatcagagtctctcaccaaaccagtcactggaaagacggtagcaatggcttccataggtcctattttaacagctttctgtttagcatacatccttagcattgaattcttcaaactattgaaaagttttttgtcctgggtttccgcaggcttcgttatgaatccgaactttttcttatcattggactcctgatattcatagatagtcttaccatccgttaaagagaccaatttggattctcttaaatatggccatcttgtataaatcactttgtttaaatgcctcttggaaaagtcctccaaagtaacattattcgttttgtatatgtcagttatttgtaagaccattgattgttgtttagaaggttgttggaaaaccattgtctcattgtactccagtgaactagtaaatggtaaagacaataacgtggggaaacccgccagcatttcggcaccgagtttagcattaggtaataaaccataccgaatctcggagctgtccaatgggatggtgatgtactctttttcgacacaatgattgtgttcaatatcagaaaaaatgccgcccaacggactcttataaaggttatcaacttgaggattaaaggaatatatcaagtccttgccaaattgatttctcgttttttcttcaggtgataacttgcgcaaataaggttgcatagcctcaatcaaccttttttcatctacaaacgatatcaaaaccacagcttcccaatcagctgtcttgccgtttttatcaagttgaacctcagcgggatagaaatcgtggattggcgactgttcatcgtacattaatggcctaaaggcgggaggtatcagatttttggacctttccggtaaaactgccattagttgctggaatggagtaaatggtttgctcaaatcaaattcaatgtcttgatctaaacccttggctaagtcggagattcttggtgcataatggtgcggatagtaccacgaccaagatggacatcctctataataataatatagaacccattgtaaaccttcaacgtagtctttagcaagatctctcactttttcttcactgtctgtcgtaaattttaacttgtcgtgataatactcatgcttccaacgttcaaacctttcattataaatcgttttttcagtttccaattcttctttgtcctccacgatgatagcattttgatatttttttattgttttcctgatagaattaacacgattttgaaattcttcttctgtttcatcaggattaatagaatcaagatccatttttagcgaataactacctttggatttggaatgcgttataaaaagacccaaatcaaaagcgaattcttttaaaaattctaaatgatctttcatgtctaagtccttaggtaactctaaagttggaatttcttcatctggtaaatcaggcgataatttttcctgtaattgctccatcaaccatggttttatacttccaattaatttcttctgttgttttaccagtaattttttaccaaccctctgtcttttcctttcaccctccaaagaaatattctctaattgcttgttgaaccactcaacgtctatatcatccttttcgaaatttaataactcaaattgagacagataatttaaccagacacctaatctctttaaatttattttaccatgttcattaatgtagccatcagtatgtaaaagagcttctttgaacgtttgtaacaaaacgggaaatgctcctttgttaaggtgcaaatctggcaaattgggcaagaaatcattaccaatgacgaacatgacaagaataaaatcatccaaaatacgttcaaaattgtattcaaattgcatttcatcggcaatttctttgaattccaactccatgtattctcttaataaagaaagatgtaataagtagaaattttgatgttcaagcgattttttttcactatttcttctaccaaatgtcacttcttctctcaataacgcaaaatgtggcccatgagtagacaaacccagcataatcaaatctgcgtcaagaccgtaaatacaatgtctcgtattctggttgaaatccttttgggattttaaatgccttataaagttcatgatcttgtgttcaccttcacctggaacttcatggccagaaaatatgatttgcacttccctccatttggaatcgttagaaatcttgtcgtgaataaaatattgtaagtttttggtcaatttggccataaactccgtacctggagtaatagaattcgaatcaaatggctcacccttaggaatctcgtcaccattctcaatagccttcttcaaggctttttctgcatccatagcggttctgaatctacgagctctttgttgattcatcttggcacgaggggccacaccatcaatagccatgtagaaaatcttcttgggcttgattgtttgaaaaaggtgatcgatatacgtacagatttttgcaaaaacctcttcttcagttaatcgcttggttacatcatcgtcgttaccatgcgtacaattatgtaaaatcgaattcatatccaggtataagttatcaaactcaggaatctgtgttccctcaataagctgtaaaatcatgggccatctttctgagatgtacctgaaaaattttggaatacccataccgtactgatatatatttgttgctgctgttgttacaagtgttgattttttttctccttatagtacacgaatcgtcctaggattagtcaattgcttattgtgaacccgattataagtacggaagaagacagtatcctttagaaaataaactattaacaggaacggaaataaaaggcagagagaaaataataaaagaatcggttcgcttgtgcgaacgccaaacagattttataataacggaagagctgctgaaaaaaaaagcaagctgcaactgttatatttgcgtagataaactttacaaccggtaattggaagtcgtaagtacttagtttgacgttttcagtactcgttaaactactccttaaattgctttctaacctcttcttgtttgtctctgttgttacttgctctgcggtggcgaaaagacgagcaaaggaggttgtatatatcactcaacacggaatgtattacagctttctcaaataaatgtagttgaaaaagaccattaatcgtgagaatagttactgatcaggtgatgagacgataaaaacagtaattgagagggttttcacgggtagtgggcacaatgtttggattaaataaagcatcttcgacacctgcaggtgggctctttggtcaggccagcggagctagcactggaaacgcgaatactgggttttcgtttggtgggactcaaactggacaaaacaccggcccaagtacaggtggactatttggcgctaaaccagccggatctacaggaggattaggtgcatcatttggtcagcagcaacaacaatctcagacaaatgcatttggaggaagcgccaccaccggagggggccttttcggtaacaaacctaacaatacggcgaacactgggggcgggttatttggcgctaattcgaacagtaattctggcagtttgtttggttccaacaatgcacagacgagtcgtggtttgtttggtaataataacactaataatatcaataatagtagtagtggcatgaataatgcaagcgctggactatttggctctaaacctgcaggaggcacttctttgttcggtaatacaagcacctcttcggcccctgcgcagaaccagggcatgtttggtgcaaaaccagctggtacatctctattcggcaataatgcaggtaatacgaccactggtggagggttatttggctccaaaccgacaggagcaacgtctttgtttggttcatcaaataacaacaacaataacaataatagtaacaacatcatgagtgcgtcaggcgggctatttggtaatcagcagcagcaactgcagcaacaaccacaaatgcagtgcgcattgcaaaatctatctcagctccctattaccccaatgacacggatttccgaattaccacctcaaatacgtcaagaaattgaacaactagatcaatatattcaaaaacaagtgcagatctcgcaccatttgaaggccgatacaatcgatcatgatgaattgatagattccattcctcgtgatgttgcatacctactgaagtcagaatctgcaacaagtcaatatttaaagcaagatttgaagaaaatatcctcatttaaatcgctaatcgatgaggaccttctagacacgcaaactttttcggtgctcttacagcaactattaactccgggaagcaaaatttcttctaatgacttagacaaattctttcaaaagaaaattcatctctacgagaagaagttagaggattactgccgtattctctctgatatagaaactgcggtaaatggcattgatacagatttatttggcgccccaaataaccctaattctacagctatcacagcagatctaggttcatccgaagcagagaacctactgcagttgaagacaggcttagctgccatagtctctactgtcattgaggaattcacactgtttatggatatcgctgagagaatcgccgtgttacatcaaaaaacgaaaacactggcatcattgagcatatgagtaaatcgccctgaaagtttatatagtgcgtataacaagtacaaatgtcttgtacaaatgtaatttatactaaatgcaatagaatataacatcaatcacagtttttcagtcaccataatggcgtcttagaggccgaactaacttttcttcgtgaaaaattttttgcgatgagatgggaaggaaaaaaagtaatattgacatcttcaattgagagatattacctgcaaaaaggtacatacgatagtagaagttatcgaacaggcaagccaccatggatatttttagagtattaactagaggagcttccgtgaagaaagagtcaggcccaaaggctaaggcagcagattacagcgttataaatggaaatgatgagaatcataaggaagataataatgaaagccagatcgtgaaagaacttgatttctttcgaaacaagagaatcattagcaaggtagaggatgatagagagaagacaaccgaaaacgattctccaaacaaagaggagaagagcggcaatgatgatggtctgataaaaccagtgattaccaataccgttgaggcatccgcgttgagaaaatcatataagggaaacgtgtcgggtatagatataccacttccaataggttcgtttgaagatttaatttcaaggttttcattcgataagcgtttactgaataacttgattgaaaacgggtttactgagcctaccccaattcaatgtgaatgtattcctgttgctttgaataatagagacgttttggcatgtggtcccacagggtctggtaagacgttagcattcttaattccgctggttcagcagattattgatgacaagcaaactgcagggttgaaagggttaatcatttcgcctacaaaggaattagcgaaccaaatttttattgaatgttttaagctatcttacaagatatttttggagaaaaaaaggcctctgcaagttgcactcttatctaaatctttaggcgctaaattgaaaaacaaggtagttagtgataagaaatatgatataatcatttctaccccattaagactaatcgatgttgtgaaaaacgaagctctcgatctctccaaagttaagcatttgatatttgatgaagctgataaattgtttgacaaaacattcgttgaacagagtgacgatattttgagcgcctgtagagagccatcgttgcgtaaagcgatgttttctgcgaccattccatccaatgtagaagagattgcacaaagtataatgatggatcctgttagagttattattggccacaaggaagcagcaaatacaaatattgaacaaaaattaatattttgtggtaatgaagagggtaaactaattgctattagacaactcgttcaagagggtgagttcaagccaccgatcataatatttttagagtctattacaagagcaaaagcgttatatcatgaattgatgtacgataggattaacgtagatgtgattcatgcagaaagaacagccttacaaagagacaggattattgaacgatttaaaactggtgaattatggtgtttgatctgtaccgacgttttagctcgtggtattgacttcaaaggtgtcaatctggtcatcaattatgacgttccaggatcgtctcaggcttatgttcacagaattggtagaacaggtagaggtgggcggtcaggtaaagctatcacattctatactaaacaagactcagtagctattaaaccaataataaatgtcatgaaacaaagtggttgtgaagtatctgagtggatggataaaatggctaaaatgaccagaaaggagaaagaaagtataaaaaacggtaaagcgcataaagaaagaaagcagattactactgtgcctaagatggataaggccaaaagaagacgtcaacaagaaatgattgcagcatccaaaagaagaaaaaatgaagaactttcaaaaaaacatttctcgaaataatataaacaaacgtgcgtatgcaagacatgtatatatgattagtagttttttttatttactttcattgatcaattacgtgaccagctatacatttcttcattacttcttctgggcattctatttaaatcgatatttccaaacgactttgtcattgctgcataacccttttgataactatcgtttaaccccacacctctgtaagatttcgattccactccattatgtatatttcttccagagttaaaatgctgcttgtaatctgaattttttctctggaatagaagttcattttgattttcaaatgacataaaaggttttgtttgatgtatattgttagggtggaaaaaatagggtgttccaccagttatggagttttgtagttctgctttttctccccaaaaatttgatgtattggacgtgaaatcataggtttcctcgaaagactttccgtttcttttcaatcctaatgggggagaagggcggttatctattggcaaaagtggatttctaaaatccctaatggaaggtaaattttgactttcaggttgattggagaatctacgaactgctagctctctatttagcaaagagttttcttgcatatgaaagaagtttaaatcattcaaaagttcccccaaaattttgagctcatattcttcatccaagtcaatatctctgtattccaagaatttcttttgcatttgaactgcgtcgtcaaaaaatggaacacttgacaagcaaatgtcaatctcttttttaatgtatgtaagcaagttggtttttagaaaactcacctctaattgtgttttggtaaacgctgttgtggcagctgaatactcggttggagctgaatttggcctctgtcccttgtatggtgaagtggaaatattcaattccatgaccggttcctttatttcttctaatccgcttgtaaaatgaaagggctgcatgtgtttagttttgtaaccttctgtattacaccaaaaactttcccaatttttaaattgacactctttcaagcttggactagagtccggagccagttttaagccatcattaaaatcgtccgtgtgttcagatctttcgtgtatatctttattttcatggaatatgttgcttgcagtccccattttagatgacttttcttcatctttttgggacttctgttttactggactatttcttttactttccttactagtattgccatcttcttgagaatccatgttaggatacgcaggcaaatctgaatggatgttatttggaaagttttccttttctaatccatttaaaagagtgccagctcccatcactcaaccaattcagctctttccttgccaatacaacataaccgggaagagtttcaagtttgacttccaactaaatacctaatgttttattgttgttatttatatttcttgtgacacaaaagagaacattgatgtcatttgagccttatcgttggaaaggataaataagcggtttaaaaggataaaagaagcgcaagcaacaaatctcaacacaagtgtaaaccatatgaatggggttaaatgccttcttctttgagatataaaaaggaagtagaatttaatatattagacatttttttgatttgagcctaaaaaagatagccctgtagggggctcgaacccctaaccttatgattaagagtcatacgcgctaccgattgcgccaacaaggctatttcgttgaaaaattcaggcttcaaaattattatatgtatcaaaaatatttttttgagaaatttcaaatcattatctacgctagccttactattttttcacccagaagatagtaacctcatcgcacatacctattgaagctgataatatttgaagcgagagctttattcttctcctcaaattttttttttcttctgcgctgttaacttaccactaaacctgtttccatttttaatggtagtcctgtttattattccatttttagaattgtatgtaccttggacgacattttttggcaatgacatcgaaagcactgtttgataccaagatcttaaaagttaacccgctatcaatcattttctcccctgatgcgcatatagatggttccttaccaacgataacagatcctgaaacggaagcagcgctagttgaagcggcgaggataataagagatacagatgagactgtggcttttccaaccgaaactgtttatggtcttggaggttctgctttaaatgataattcagtgcttagtatatacagggccaaaaataggcctagtgacaatcctttgattacacatgtttcatccattgatcaacttaacagaaaggtctttaatcaaccgcatctatcaggtacatccttgtttgataacataccctcaatctatcgcccattaatttcaagcctttggcctggcccattaacaattcttttgccagttccatcttcagagcatagtgcattatcaaagttaacgaccgcagatcagcctacgtttgcggtacgcatacccgctaatccagtggctagagcactgattgccctgagcgatacaccaatagctgctccttcagcgaatgcgtctactaggccatctcctactttagcgtctcatgtttatcatgatctaaaggataaaattcccataattcttgatggcggagcgtgcaaggttggtgtagaaagtactgttgttgatgggttatgtaatcctcctacgctactgcgacctggcggttttacatatgaagaaattgttaaattgggtggtgaagcttggtctctttgtaaagttgagaataagaaaacagttgaaaagggcgaaaaggtaagaacgcctggtatgaagtatagacactattccccttcagctaaagttgttttactagttcctcattgcgaaggcgatggcattcttaagggcgttgataggatggaaagattaaagaggttaatcgaaacggaattaaaagccaacagtaatataaaaaaaattgcgattttaacttccctaaaattacgtgattccgacttacaatctaagatctttaatgaacccgatttttcttcgaaaactttcatcatcgaaagacttggccaatctggtgaagaaatacagactaacttgtttgcagctttaagaaaagtggatgaaaatgataaagtagacctaatatttgtcgaaggtataaatgaggaaggagaaggattagctgttatgaacagattgcgaaaggcggctgcaaataattgtatacagttttaaataaaactgtgattaacttttgaaaatcataaccactgattacggagattttatatctagtccggaaaaagaaggaaagaataaaattttatattgctttgtatatacgaaaagtcgcccatacatgtttatcttagtatccgttgtaaatatatgtacatatatacatctacatatgttcccattaattagtacatttacctcaatagggttgggcgtcctcatgaaagataaagggaaggaaggaaaaacgataaaagcacaaaatgtgacatatcaaacatttgagaaatacgttgagtcttcttcattctttttcctcgtccacaattttctcaattcatcaacgatgaaaacgctactgctgatgagcaataacaatagtatatcagagataccaagtttctcagttttaaagatactttggaaaaatggtatatatatagcgcacatttgacctaacagagacagtccaacggcgtagttgaacattttgttcgtgaaaaagccgatttcgaagattgactttgtgttatgtctgcaggccaaagcattaaacatatcaaaaaaaacaaaacaagtaaatgtcatagtagtatctctagcagttactttaccatcttcggccatctctttaacaaaaatgtaaactgtcccaacgatgatacaggccgcggtggttagtaaacgtttcattacatcatgggtcaaaattttatcggtacgttttcttggaggttttttcataacttcatgatcaacaggttccacacctaaggattgagctggtggcccatccattaaaatatttatccaaagaatttgcattgcgttcagtggattgggtagtttaaacgctgtagatagtgcaactaatgatagtgcggcaacagaagtagacaattgaaaagtcaggaaattctgaatattattaaagatacctttaccctcttcaatggcagttaaaatagtactgaagtcatcatcagttaagaccatatctgaggcttctttggctacatctgtaccaattctacccatagaaacaccaatatctgaaagtttcaacgcaggagcgtcgttaacaccatcaccagtcattgctaccacatcacccctctttcttaatgcacgaacaatgtttaacttatgctcaggcgtagcacgagcaaaaatattaacgtggtcgatgacattggccagttgatcatctgacatttcatctaatttatcaccggataaaacggaaagctttggatcaataactggaataccaatttgttttgcaatgtttactgcggtattctcagaatcaccagtgatcataataatatggacaccaccttgtagtaattgttcgatggcaaatttaacgttcggtcttggtgggtcattcataccgattaaaccagtaaaggttaaatctttgattaggtcttcggttagaggagttgatgaatcagacaaagttagtttagcaaatccaaagacacgcaaaccttcagatgccatagaatttgcgcactcatttatcgtagctttttgggcttcagtcaacttttcagtttttttaccctttgatttcaaataacttgtggagtactcaagaattctttcaaatgcacctttaacataaactgtacacttattgtcgacagggttgagaatcttggttgccattaattttcttttcgagttaaatggaagttcctgaactttttgaacggtgtttctgatatcaggcatttcaaagtttgccaattgctctaaaagagctacatcagtaggatttcccagaaatatggcatgttcttgagagaaagatgcattattacagagattaccgatagttagagtttccctaacgtcttcagtcaaatagtttttcaaatttccattagaatttttagtcttcttatttttgtctaatgagaggacgtttagcttattggacatactgtccaagcaccaaagtttagatacggtcatgtggtttgaggttagtgtacctgttttgtcggagcagataacgttgacagagcctaaagtttcgacacttggtaaccttctcacgatggctttacgcttggccattctcagaacacccaatgccaaagtaacagtgacaataattggtaacccttctggaatagcagcaaccgctaaggataccgatatttggaacatttctaaccaagatctaccttgtatgataccaactaaacaaatcataccaataactatgaagctaaccagtgacaagtcctttcccaatttgtccattgttaactgcaatggagtcttcggtttttcaatattattcatcatttcaaaaacggcaccaaaggatgtgtttgtacctgttcctacgacgatacccttaccatgaccttccttgactaatgtacccatataagctatacaagatctctcagaaatcggtacaattgaattaggctgatcgttaaaggaagatttttcgatcgtttgtgaggttttatgtaccggttcattttcaccagttaaattactttcatcgatggataaatcgattgcttcaataattctaatgtctgcggggattctgtcacctattctgaagtgcactaaatcaccaggaaccaaggtggaagccagtacatgactctcttgaccacatctcattaagtgacattcagcaggaaccaatttattcaacgcttctagagatttttcagacctatattcttggacaaaaccgacagtgacaactatgaaaatggccagtgtgatactaacagcatcatcaatgttacccataaaaagagagaccactgcggatcctattaaaagtagaatcattcgatcctcaatgaaatttgacaagaacttcttgaaaagactttcatcatcttctacggttatttcattggggccataaagtgatctcctattgttggcctcgttagatgatcgtaaaccaccgtttttgtcagtgtccagtttttctagagcttcgtccacggataaagtacaatactctaaagaagggcttggtttcgaaagggcctctgctgtggcatctagtatttctctctcacggtttgagtcctcgtcaagaagactcgcattaaatggattgtcactcataattatcttatcttttacttacacttaagcttacgtctgtgctggccttgcttcgtcttgtcttgcccagtcgtaaggatattattatagttactagtattgttataaatgggaatggaaagaacggggcgagcaaacactattatgatggtgtagaaaaagaggtttttctattaagtgcttgaaggaagggctatagtgtacgatggcctagggaacaagatctcgatataacgataggtagggtccacactgttaacaaaaaaagtacttctttaaatagagaatcttgtcttgatgtaacaaaatgaaaaaaaaaaaaaatgcaactagaatgtagaatacaaaagtttaacgatcggctttgctgttaagtggttatctagggatgagctgaacgtgcaattgataccaaccgatccttgctaggaacgcaactcttttcacccaccttccaccactacgatcgtgaaagaatatttgctaagaaaatcgccaaaacgaggcgaagtcgccagggtgcgcgggcacgcagggtaagagccgcaaggcctggttcggtaagtattaagctgtggacgaaatagcagtagccatggcgatgtaatttattagacggcggcttgataaaagaggactgataatcagtgtattcacagaatggtcgtaattaacggggtcaaatatgcctgtgaaacgtgtatcaggggtcacagggcggcgcagtgtactcacactgatggtccgctacagatgatcagacgcaagggaagaccatcgaccacatgtggccattgtaaagagctgagaagaaccaagaacttcaacccatccggtgggtgcatgtgtgcctctgcacgacggccagctgttggcagcaaggaagatgaaacacgatgtcgttgtgatgagggtgaaccttgtaaatgtcataccaagaggaaaagcagccggaaatcaaagggagggtcatgccacagaagggcaaatgatgaagcagcgcatgtcaatggtctcggtattgcagatctggacgttcttttgggcctaaatggtcgctcgtcggatgtagacatgacaaccacattgccgagtttgaagccacctctgcaaaacggagaaattaaggccgacagcattgacaatcttgatttggcttccctcgatccgcttgagcaaagccctagtatatctatggaacctgttagtatcaatgaaacaggaagcgcatatacaactacgaacacagcactaaacgatattgacattccattctccatcaatgagttgaacgagctatacaaacaagtatcttcgcataactcacattcacaataatgcatctggacatctatataaatatacatatacatatattggcggttgtttgttctcccggcaagctggcagtcgggccgagattcggataaatttttccattcgtatacatatacatagatatatacaattataaaatttgtccaaggctgcacaggatacgtaaccatcctaaagttttaggttttttaactttttttctgtctcttcaattgtcgaattgcttattctatcctttctggagttcgtattttcatcgttcaaatatatagataacctttcatcactcacttccaatatacttttctgatcgttactttgtaaggacgtcagccgaatgatgtactccagtagtgtgatcgacgaatccttgtcctccaatttattttcttcttcttcttcttcctttcgttcttctccgtcttttccttcctcttcgtcctcctcttcatcttcctcttcatcttcctctatcgcttcatatccgcttaccgcataccaagtaatgtcatcgagtaatcccttgtctccttcactgctctcattttctttgtcatcgctccggtcaatcttcaataccaacactggagaatcctgttcttctaatcggagaagcttaccggaaacactgaaaaacagcttcttaatatggttcagatctatggcaagttcctgtggtgtgtcttctttgtcatcatcctcatgatatctaccgtcattgaagtcttgttctattttcataaaataatcatactttctgcctgtagagttcaatctatatatccttgcttttgcacgtttcatatcctctttccaaacaattcctgattgcccattgttttctgaagttaggttatagaaaatagagaatagtgtaacctcaaatgtaggccccacttgaacttttagaatctccttgtcacctgttcctttctcattactcttcattgccttttcatactttctattgttctcgctaacgaaatcggaggcttttaataataaaccaggagaaagttgatatgggagtgcgctgttcaagttggcaccagaagtggttaaagaaagattaatgaatggagtgatttcttcgatcctcaatagcaagtcctttatatagttttctaccgctttaatagcttcattctgtgtttttgcgctcctggaaccctcaactttctgcgtcatttcgttgatcttctcatcaaacctatcaatctcttcttttaaatccttggttaacctcagagtgatttgcaaattcgtgtttcccctcgccgctaccagctttattaggtcaattgcactggatacaatagccatgcggctttccagtttaaatttcagttgatctattcttctagcatcatccttaggaatctggacgacaaagttcgttattgtctttagcgcatatgtggatgctatcgatattccggattttatagcaaatgtaacggcttgtgaacctgctttggcaagaatttcatccattctcttcagatattggtgttaggtaatagttaaagttaatccttctgagagtgtgaaactgtatcagatttttatttccctgacagcgtgagattttcttgccataatcttttttggcagtttcggctggcactttaccacgataaaactgaagataatgaaaaatttaaaagctagcacaagtataatatgacatcgctcaactttttttacccttaagttatacgattatacttttttgattgaaatacatagagatatttaccaatttggccccaattttcaattgtttattacgtctaaatatatataaccatgcccatcatttaaaataaatatgtaatgaccccccgacgatcgaattctactttttgtttttgttttataagtacatgtatgtaagagatcaatgtgaaatatattgaaatgcaaaactgatatcattgtaatgatgctcgttttttagtagatgatcatttgttttttccaatgcgtcatggttcaaatgattccaagttgtcgcatcaccatataacattgcaggggctctctttaattgtttaccctgagcattacaacgtttacaatggtatgtttcgtgtgtttcacatatcgtattctcatttttttgaaacaactgtcttaaattgtcagaactaaacaacctttcaacgtcttctttcgcatcgaccacgcatgaactcaaactcattttcatagattgtctttgaaagattttttcctctatggtaccagtcgatatgaatctgtaaatgaaacaatcctttttttgaccgtctctccaaacacgtgccaaagcttgttgatcagcagcaggattccaatccggatccatcaaaattaatcgatttgcaccaatcaaattgataccacacccacctgctttagaacttaagaggaagatgaactcttggccttcaggatcgttgaacctatccaccaatttttgtcttttgttaattgacattgtaccatccaaccgtacagcactgtagtgcttatatctacacattttttcaatgaggtccaaggtttgggtatagttggagatcaaaacaatcttatcatcggattcggtctttatcttatggagaaatctttccaaaatggaaaatttagctgaatattttgtttgtacgtccctggcttttgaacccggcatattataatcgtcaggtagttccaaatcatcttcatcgtcaaattcatcttcaaaattcaagagattagggtgattacatagcttctttaaaataccaatagccctcaggggctgagacccaccaacaccttttactacttttttcacttctcttgacttaattaatttattgtagagctcgttctgcaacggcttcaagtttacgaaaataacgtgctcatacttgcaaggcaaatatttggccaaaatatcgttagtacgacggataataaatttggagacaatggtagatagcttctgtaattgcgcctcgccctttgtgatttctttatcagtagcatcagcatcacgccctcgcaaaattggattctcaaaatttttcctaaattctgctctggaacctaataagccaggattcgaaaaactcagtagagcaaaatattcggaaagatcgttttgaatgggtgtaccagataatataactcttctaggacaactgatgctatccaaagctgtgaatgttaaagagtcaccgtttttcaaacggtgcccttcatctgccagcattaaacccacattgcagtttttcaattgatcaacatttcgacgtaatgtttcatacgatatgattaaaacgggcttaacaatatttcttccctgtgcctgagcccaggcatgaatagcttgcgaaactgttgtattaccaccacccattgaagattttttcccatcaaccgctaacggagttagagtattgggacccaaccattttatcaattcattagcccagttgttgactaaagaagatggacaaacaatgatacatttgtcgataagtcttttaccctgcgggccctgtcttaataatgtccacataagtgctatacactgcaatgtcttacccagccccatttcatcggccatgatgcagccgtaggcccctctattgttttgttcagtcttttgagattcagtaagtgccttctcgtcgctctttaagggatcttcgcttgaagtgttgaacgcctcagcttctaagtaatctttcatgacaagccctgtgacacaacggtataagaatctcaccccttcgacttgatggggtcttaaaatcttggccagttttggatcaataaccacagggacactagcaaatttcttcttgttttccgcagagttttccgaatcaccgagtagctcacgtaacggtttgtttctcacaccatttgtcatcaaagctggatggcgtcctattctttgtgtgggtctttcttcctggctattcttttccttgttaatattatccttttcctgtgtgcttttgatcattttctttgattcttcttccttgttatccatagatgtgtcatggacaatcatttcaccgtcaacggacgggtcataaagcactatggcaaattcgtctgtagggtcatgtagaggtcgaggttctggagtaattttttttttcattcctaacgttaatggcagactgtgtctttgtacatatcccttgattggcacagtgaaagatcttctcaaagtgtactggatatgactcagtcttgtcggatccttggccaacctttgagcactaagagcatccttccgtcgtttagtcaactgagaaaaacttatgtcttggctgttgtactctgcttcgtccgcatttatatccaagccggaataacatacagtcgctgatcttttcctcaagctccttcctcctacgatattatcagacccggtggcgattctaccagcagcgggcgggatgtgcgtgttcttgtacgggaccctgaacggtttcgttagtcggttcaccgagtcttgtacgttaataggcctaggtaccagtctcggccgttcaccggctcctattccatttggtggtctgtctggtaatctgcgtcttgccatcagttataaggaaatatatatggtaccttgaaatagagctaagttctgagcgtttgatttttctatactttcgtagcagctttagtgaagaaagagaaaagttgctgctctagattttgtatcggctattacgtcaagtgagaagagttttggccttcgcttcagttagatcttctattatttccttttttttctttttgtttgtaattgttttttatttttttttttgcgcgaaactttgctatattgggtaacgcgtaaaatactttttattattgcagtaaggcggaagggtcttcccctttgcatgttaaatagcatacatggcaccactcaggtccagaacgtgacacatctttgcaccacttgtgtattttcaagatgttaaatttttgatacataagctttatcatgcaggtgcagtagacgcatttgcgtacgcgttgagtagtaatgcaagaacgcaacaatttcacgctttctacttaagaggacagatcttcgagcagaatatttttctcctagcgcggctttcagaatcttcttaccatctgcaggacatcacatgcaagcacatgaagctggaaccacgcaccattaaatgtaaacctacagacatagctagcacagaaatgctactttggaaacctcggttgcatcggctgacctcggctgttcagcaacgtgagctggttgttgttattgttcatagaatcctgtattttaccagtgtagctttgtccgcccaccccacgcttttggccactagtatgtacgtatatgcgtgggctctatatcattgaaaacgaattttccacgcaaaacccacttcacaccataaaggccttatgacgatgtacattcttcccctcccccctcctcccgaaggaacccttatagtgatcctaatacggtataacgtaaaccggagttgtcagcagagagaagcgaataatatgttttgcgtggggttcccacgagcggcaggaaccgtagcgcattgaaaaatgaatcatcgatcatctttgggtttcaagggttcggacttcgccaaaggtccgaatacttccaccagtatttctctttttccctttccagtctcgttcttcgccgaatccccgctttcccatcatgatcgtttctctgtttctctctttccggaacaggctcttttctgaccgccagttcgtgcggttagttctgtggatcttgcaggcacttgccggtttagccacacttctccgctgtttgtgtcgaatttccctcgagtatgagaaagactggaccacaaaagagggaaaaaaaatgggccgattttaaaccattataggtcacagaaaaactttcttacgacggtggtttttcaacaatacgtttcttgagcaggagaggagctttgttcttttgccttagttttttttgtctttttttgtgagccatcctgctgtcgttgccatacatgacagatccacatttgccttgttgtttttagtttttgttccttgcaccatataaaagcgtcacttgtattttccttactcatctaaacttcaagctttttcgtcatagtaggtttgtgatctcggcaaagaaaaaaaatttttttgccgatctttctggttattgtttcaggtatctttatgaaagtattagtgtacgcactggatttttggtaggtctataaaagtgcaacacataatctaaatcattgaggtcatcgtatgtcaaaagaagatgtccacaagcattacagtaagaaatagagatcgatcgctaccaccgctattgctccccaatgtttccctgctagaaaaagatatacggcgtaaaggcacccaaaatgtgggcatcaccgatccagaactcttgtcgaccacttggacgaggaagcgggcttttccgactgacgagcttttaggaggctataagagattaaagcctgctgccgctgacagtaatgagtgcgctattggtattgccacggtgacgccgccgccaacgctccccgtaagtgcgattgttccccctccacaaaattacactccaccattgtttgagtatcatcctcatgctcttgcttccatggtcaatgaagacgctaatgcgtcatgcactcaaatgtctataatttcgcgctcaacgagcaactcgacaacctcctctgccacatctactagttcaatttccaagagacaaagaagtggcccaagttgtgacaaatgtcgtttgaaaaaaataaaatgtaatgcgaaaattgagattttgcttcaagacgatactataatgccaatgatctcgaacaagttgcggtacgtcttgactcctgacgatattcggctatatcgaggcacgctgttgcggaatattgccataccggatgatgtcattgagggtacaggctcacgcaagttgattaagcatattgataagttggttttgctcacaccttgtttaccatgcattaagaaaaagcattcttcttcttccactaatttcccaaaaaatgataaatgtactttttcaaaaggctttaccagagctgacataaacatttcatccaaaatctccttaaaatttaaggataaaaccatttacgacataacctatgatgactataaaagcattgatttttagacaaaggcatctctaatgaatagcatcacaaaacttgcatttagcattaacatatatggatatatatgtacacacagaaaacgtataaacactcatgtataaccctacataataagagtatacaatgatactagtcataaaaagtattgtgtgtatagacgtgcgcatattttcaaaatattataaacctgaacaatagacagaataaagtatgcagcgcaacgacaacgatgatggacagcgaaaatttcccgttcgattgtgtctccgtattattattactcgatatttgagaattcaagaaataagacgactgtgcccacccaagagccacaattgcccattgaattgcttgaacagtcctcaggcgcttggacatatccaatatattcaatataacacaaacgggtatccagatcaagttagcgtacccgtaaacggaaatcaattcaggaacacttttgaagcttctattgcgctccgagtgctcatctctattcaatacttgcatggtaataaatggtacgccgaacgtgtacccgtaaaatagccaaatagaatgcagtagcttcttaaactgactggccctgtcgatgtcctcaccagtcttgacgccctcaattacgtcactgataataaaatttaaccccctactcatggtaaaattgatcattaccaccgtggcagtgatccatacagcaccgtataaatcagtgttatcttcgttactttcggaattatgatcgtttctaaacgtcagtaccgcggacaatctctttttgaactgcgtcaaatcgatctggaagtatttagaatagtagtttatcaatcctggcctcaatccattacgcccaagaccgtcgttgtcattctgtcctatcacttggtcgtacgctggtgggtccatttgaccctgtaatggtgcggattctgccttactgcccgttgtgttataaaattcgctaccctttccagcagtcgagttattcatgtttgggctatcaggtacggtggcatcatcaaatgggttgggctcgttgccaaaatcatctacaccctcgagatcatcgtcaatatctaaaaaactgctattattggacggcatttttctgcttttgtcgagtcaatcctatttgctagtatacaatcgtggatgaagcgtaaaaaagaactacagaaccaatgcgtttggatccaatgtggtcgctgcccttggccccttttaccttgagcgtaggacgttgatacattttcactgcttgagaaattaggtataatacacagccgggtaaatagcgtttaattgatcgctgctccgtaataccgatatactgttacgttatgtattgaaaatacagtttaactattatttgtagggatactactatggggtctcaaccgcacttaaaggcgctaaaatattttgacttttccttccttatattgtagacgtgttatttaaaaactacattttccatatctcgtcgccagaaacttctaatttggtaagccttccaataaatatgaaagaatcccctctcataacgttggttaaaagacattccgagacacattttgccaatatcaagtatgggtattatgtgttgataatatcattggtctatctcattggattggctcttttgagagctttcggaaggagaaccccatccagatcgtcgtcagctttcaaaaataagataatttatcggttgtatgatatagatcctgcaattcacttaggtatattgttttttgcagtcttgattccattttattaccattactctttgactacccaatctacggtctatctcaaaagattagggaggttgagttacgccttgatcccgctgaacctattcctcactttaaggcctaattggttccttaggaaaaattgcacctacactgattttataccgttccataaatggttttcacgtattatcaccgtgattggtttgcttcatgggattttcttcatcattaagtgggcgatagacgataatgtctctctaaagcaaaaattgattctgaaaactttcaattttgcgggattcataatatcaatattggtactttttttacttatttgctcgattgggccaatgagaagatacaactatcgtttgttttacatcgtacataacctggtgaacgtggccttcatcttactcaccccaatacactctaggccaggtgttaagttcccatttcttctactaaactgtaccctattattcattcatattatcaatagaatagtatttgcgaaatccttgatgattttgaataagaatgcgaattattcaaaaacaaatttagtccatgtaagattgcccagggctattcttccagattattttgaaccagggtcgcatattagaataagcccttacagaagaattaatcccctctattggttgctaccatcgcatccatacacaattgcgtctttggcagaagacaattcaattgatcttattataaaggaaacctctacagccgagccaggtagccagatagagtctcttcgtagtaatccaaaatcctttcatttagatcaagaaaaaacctatactttgattaatagttatcctccctctgtacccgaagaatgttattctcaaggcacgaatatagctattatatgtggtgggtctggtatatcttttgccctaccactatttaggcatttttttaacaaggagaatgtaaaatacttgaaaatgatctggctgataaaagattactctgaatatgaacttgttttggattatctcaagacaaatgggttgacttttgagaaaaaactctcgaataataagaggatttcagtatttattagtggagaatacacggcggaaacacggttagacgaaattacgaccaatatcgacgatgaaaactcagaatatgaaatgggatctttcaacaatgaagacgaagacctttcgatttctaatttcaattcagaaaatgcggacagcaatgacaatacgccagagacaagtcatagccccacaaaagagaatggaagcatgatcgaggtaaaatccaaacacagttttactctttccaacgaattgaagagcttcaacaatgaaagtgcacaagtgaaccaaaatgaaacatggttgttttcatgtggtcctccctcgttattacaattgtctaaaaaatattgtaacgatgaaaggatcaactttgtctgtgagacttacggattatgaggggaaaagaaaagaataataatgtcttacgcaatatgctcggaaatgatattccacgacattagatgctaatttatagtatatagaaaacaaaaaatacatatctgttttttaatgacctttagtttatatgctttcttgcgcggctattagaatacacttgacaggttgtacgcattattaatcggtaaatggagatatattagagatgatcgttttaaaatggaggctgtctgcaaaaaaattgggagctacattagcaaaaagcttcttttcttgttgttctcggtttatatttcaagagggcagtaggaaaaaggatcgaaaagctcggcctgtggccatgtcctctaaaaatcaaatataatttactggccaacgttatcggctctttttgatatctatcatctctttagctattgttatctggcaactgattcaactgatatgaacaattccataattactgatgatgaggttagagagttttacttaaactgctcttctcaaacaattattgaatctcttctcagcttgcacgagtcattgagattatattctcaaaaccatgagatactgctcaataggatgttcaaaaaattggatgaaaccaatgcagactctaacatatcccatatattcatgcctgttgtgagcaaggatttttcaggaataaaaattcttgtgaataacaacaacaaaaattttcaaggtgtgataaatgttattgagcctgaaacaggaaaattaatcggatgttttgaggctaaacaaattaccgctataagaactgcccttgcatcgtgtatcggtttatataagcaactctcatgttcccatgataagttgtttagatttgaaaatggcacttgctatttaacatgttttggtaccggtctccaagcattttggcacatatacatagctattaaactaatcatgtcagggattgttggcgaatctttgaagttagttgaaataaacatactatatcacaataacatgatgagtttggatcgtttgaaatcattgaaaaacttatttggaagtaatataaagatagagcttaatcagtatcaaataaacgacatcagttcagaaggtaatggcgctgtttctaacagtgatattatctttggttgtctacctactctagagcccaacttgtttttgaggcagttgctaaacagtaaagcttctgtggagcagaaacatacttatatctcattaattggaagttacaaaccagtgatgcacgaatgcgataaggagttgattgataagttcaaatctgataatgaaagcgcttgcattttggtagattcaagggaacatactttattggaatctggagaattaatcgattccaatatcgctccacataatctcatcgaaattggtgaattagatactttgaaaaacacagttttgaatttgaacgaaaagggctgcaaaagaactatcaccttgtgtaaaattgttggtctagcggttatggacgtggcgcttgctaaggaattcttaagcttgagaacaaaaaacacagaaaacaaggaataaattgcatcttggcttctagtttttttatattcaaaagggttcttaagtgtttttaaatatgatactttttttaatatcttacgatccggaagagatttttgatgtttacatatgagccgtttgatagaaattttgcaattttttatatttattaaaagaataaaagtaaagtgcagaaagaaaacaacatcataaaatatgaaagaaaaaaaaaggcaatgttagtgttatgaagggagaaacaattaccgtatactgtttgcaggtgtctatcctccacggtatagcacgttaggaccatttattcgcgctacggatatagagtttaaaatgacttaattacatgaataataccataattcttataaccgtcatcaatctaacgaaagctaggagcaattttcaacatgtatttcaagaaattagcaatagaaaaagaattgaacagatatgaagatttttgccatattttaaagagaggctggtgacttttctctgtcgatctgtgcatagccaatattaaagttatttttcattaacgcgcatatggaaaatagacaaatgtcatagggttatagttcttagatttactattctctatttgatgtcggcgaaacaatgttcctgttttttaaccatatttatgttccacctcgatagccgctgattattaaaaagatgtaggcttgtatggaaattttcgagactccatttttggacgaaagcaatgaaaattatatacagaatattccagaagatcacctcaaaaatccaaaaatatgatcagtgatttaacaagaaaaccgaagatttctattgttccttcgaaattttttcagttttatgttcaatctctatgtttttcttaaaatgataaaaggtcgtccagcttggtgaagcttacatttaaattaaataaattggtgtgactgaatagaatagcgtccttaataactagagattacattgtagatgaataacaactaattaattcaaaaaaagtaatcgttaactatttccggaagaaacaaaggctcattatcaaatttgatgatcacaaccaatgtgtatttaaataaaggccaatatctcacggtctgttgaatctaaactaactattgaaatattcatttgttcagaaaaaaagatcattaatattacatgtactgatatgctaacaatccaaaaatgcttatactacatattgttgtacaccatgggtaccgttaaatgacagtgtaaacaattgcagaaggaaatgttacactagcggttaaacaatactgaattaaagattttttagttgaatatgatatgacagttatatacgtgagcaatataagtccccacattgagtgtatgataactaccggaattactatcatattgttcgtaagcaataataaatcaattagtgtgggtgttttatacctctctcatatgagtatataaagatccttatttaattttgattatactatcttctagccttcaattatcgacatcgctcacttgagcagttcatctaagaaaaaaagaactatagctaaataacccagtattatttgtttcgctgtaggttgttgcacaagggtttcttctgtgaacattttgaattgtacgcttaagatgataatacctaactgattccaacctatattagtagaaccgaaacatacaaataagtggttgtttggccgagcggtctaaggcgcctgattcaagcaatatcttgaccgcagttaactgtgggaatactcaggtatcgtaagatgcaagagttcgaatctcttagcaaccattattttttatctttttggttctgtgatcaagctacccgcgtttgaagccgactaaagacgagaaaaattagaccttcatttttgcctgtttgctgcatgtaaaagaatgttggttgaacatgtcgtttaagagaagaaatcgggtacggcgctctggcttttaaaattgaagaaattggtgttcttccggttaatactttgaactcggcttttcttaacatgtaataaagtttgttacatctcccataattaagtttctggaacacgcattgttctatttttagacgggagaccagaacttcctgatatatgaccgctttttagtgactacgtatactttctttctgcaattacgtgtaagaaaaaattgattttttatttttaaattcacggaatttcagactgtgaaaactttgtagttccaactcactttgctatgcaagaaaataatgaggggaaacaaaaaaaaaatgagagcggagaaaagaacaatgcagctcaagtatgaagaagaaagtcacagcaacggaaataaaaatcaaaattgcgaaaattgacaatcttgacaatcgaagcggaaaaacaatggaaggtccagatacctgttgaccttaaaaatgcagaaaaatcgcctttatacggcgacattgtgaaaaatgacgttaaaatcttgtacataaaaaaagggaattacaaacttgtagtgttttttttttttaggggacttgcatgaaagttaaattttatagaagtaattaaatagtcgatttcctttcctgtgtgtgacgaatctagatttttttcatgtaagagaccccgccctgcgagaggggcaaacaattctagcagaaaaaaatcagtggaaaaaaaaaagaaattccggatatgatagaatatttcttcgagaaaccttttggatgaggagtgcccttccatgaagaaattcttcctgcatcagcaccttcccggcaaggcatttcattttttttttccgagaagaagatttttaagtgggctaccccacgctttcggtgcctatggtagctgcatgatcacacaatgcactcccattaagagtttgtgaagtgcatgagattgacatctcggcgtcccttagtttcctgtcggattttcagttatatggagtgggtgaagtcattatccgaatattcgcggatcattgacgtataaatacttcatactacttcataccagatatttcctacatgttgaaagtcaattgaaaaaaataaatcatcacttaactcttttccagtgacacatcgcaaagattactcaaataatcttcctaaaacaatactaccagcatctatttcatgcagcaccaagcacagaggctacatatcatataaaataagtcatcatagagaaaaaaatgtcagtaaacccagaatttatagccgatggcatcgatttttatccaacaacgcccgatgccgcgtatttcaatgccgctgatggtaaaaataaagttaacaggataaatggtaactcagaaaatttacaccactcctttgcatcgggttgccgtagatcatctctttcagtcgactttaatgttacctcgtccgattcagaaaaaagtgaacagagctgcttggaaaacaactctcaagaagacgaatatttttgtgacattttttccactgaattaaaattagatgaaacttctaacaagtcaaccgattattccagttcaaatcaccagtatcctgaacaactggagttgcacaattataaactgctcaataaaattggtgaaggggcattttccagagtatttaaagcagtaggcatcaacacggatgaccaagctcctgttgccatcaaagcaatcataaagaaaggcatttcgagcgatgccatcttaaaagggaatgatagaatccaaggttccagcagaaagaaagtcttaaacgaagttgccatccacaaactggtttcgaaaaataatccgcattgtacaaaatttatcgcattccaggaatcggcgaactactattacttagtgacggagttagtcacaggtggggaaatatttgataggatcgtccaactaacatgctttagtgaagacttagctcgtcatgtcattactcaggtagcaattgcaattaaacatatgcactacatgggtattgtgcatcgtgatgtcaaaccagaaaacctactatttgaacctatcccattttatggccttgatggggacatgcaaaaagaagacgagtttacattaggtgtcggcggaggcggtattggtttagtgaagctaatggacttcggactagccaagaaacttcggaacaataccgcaaaaactccctgcggaacgatagaatacgtcgcatcagaagtattcacctccaaacgatattccatgaaagttgatatgtggagtattggctgcgtactattcacgttattgtgtggatatcctccgttttacgaaaagaacgaaaaaacattattgaagaaaatatcgagaggagattacgaattcttggcgccatggtgggacaacataagttctggcgctaagaacgcagttacccatcttttggaggttgacccaaacaagagatacgatatcgatgacttcctaaatgatccttggttaaattcgtacgattgtttgaaggattcaaactcaaattcttatgccagcgtgcaaagcatactaaatgattcattcgatgagagagcagagaccctacattgtgcattaagctgccaatctgaaaaacaagatgacaccgagttttccagaagtgaaagctcggaatacatatttatgacggaagaagacagaaacctacggggcagttggatcggtgagccaaaagagtgttttaccttagaccttgcaacatcttctatataccgaagaaggaagaacaagatattcttctggtaaactcttatccagtggaaaacgcacccagcatattcgaaaatatatcaactgtctcccctttttatactaataattaatagcattcatattgaaataataaaaaagatacgtttaatatttacgccagctctctagttacagtttcctaacgcatacgtcatcaatttgttaagatcggcttcgctctataaaaatgtcggccgaaattagcataggattttccgcggttccgacccctatcctagaaacacggaaaaacttgcgaataattccggaatttattctatgcaactttatgaagacaaattactataaatgaaccgctcattcagaaaaactatgtctcgagctcaatggatcttactacatagtttataaaaacagtaattgtgcattgtacaactgtgctaaacagacttaaaaaagtaataattatgactactgataccactgttttcgtttctggcgcaaccggtttcattgctctacacattatgaacgatctgttgaaagctggctatacagtcatcggctcaggtagatctcaagaaaaaaatgatggcttgctcaaaaaatttaataacaatcccaaactatcgatggaaattgtggaagatattgctgctccaaacgcctttgatgaagttttcaaaaaacatggtaaggaaattaagattgtgctacacactgcctccccattccattttgaaactaccaattttgaaaaggatttactaacccctgcagtgaacggtacaaaatctatcttggaagcgattaaaaaatatgctgcagacactgttgaaaaagttattgttacttcgtctactgctgctctggtgacacctacagacatgaacaaaggagatttggtgatcacggaggagagttggaataaggatacatgggacagttgtcaagccaacgccgttgccgcatattgtggctcgaaaaagtttgctgaaaaaactgcttgggaatttcttaaagaaaacaagtctagtgtcaaattcacactatccactatcaatccgggattcgtttttggtcctcaaatgtttgcagattcgctaaaacatggcataaatacctcctcagggatcgtatctgagttaattcattccaaggtaggtggagaattttataattactgtggcccatttattgacgtgcgtgacgtttctaaagcccacctagttgcaattgaaaaaccagaatgtaccggccaaagattagtattgagtgaaggtttattctgctgtcaagaaatcgttgacatcttgaacgaggaattccctcaattaaagggcaagatagctacaggtgaacctgcgaccggtccaagctttttagaaaaaaactcttgcaagtttgacaattctaagacaaaaaaactactgggattccagttttacaatttaaaggattgcatagttgacaccgcggcgcaaatgttagaagttcaaaatgaagcctaagtatcacgctaattgaagttttttttgatcactccaataggcaaatctatagatatataaaaaatatagacaagacttttttttacattgccagttttcttttttcctttttagtatctattcaaatgggcgaccctattgtctaatttcattagcttcatcacaaaaagtgccacgaattcatatagcgcgagggtaatccctaccctaactcgtttaagggagacatagaatgaactccgccatcatgtgctcaagactagacgaagctatattagaaggacaggaggaggttttattttaaccagttacttcatttctaatatagagattaaggctgcaaaagagtttcaaaaataattaattatgtcatctgaggatatcatttatgatcctcagttcaaacctgttcagggaatctacgagaatagattaagacaatttattgatactggtggggattaccatgacttaaatttacccaagttttatgataagaagcgcatttcattagatcatgatcacgttaaggtttggtggtaccaggtttcttttgaacgtggatcttcccctgtttcccctgataagaggccatcttggaaatctattattgaacgtgacaagaagggtgaattggagtttagagaagcgaacataaatcagccctttggacccagttggtctaccacttggttcaaggtgaaaatctctttgcctgaagattgggttaaatcaaacgagcaactacttttccaatgggattgttctaacgaaggaattgtcatagacccaaagactctaatccctgtgactgctttttcaggtggtgaaaggactgaatatgttttaccgaaaacatcggatgggaaacatttcttttacatcgaagctggtaataatggtatgtttggctgcggtgcaggatccactataaatccaccagatgataatagattttttcatttgagaaaagctgatatcgtttggcccgatctagatgctcgtgcattgtatatcgatttttggatgctaggggatgctgcaagagagctacctggagactcctggcaaaaacaccaggcaagacaactaggcaatgcagttatgaatctttttgacccgaatgatcgttcaagtgttcgtaaatgtcgtgaattactacaaagggaatactttgactcctttttagaaagcagtaaggtttacgaacaaggtgaatctcaagttttaacaaatgtttatggtatcggcaactgtcatatagatacagcttggctatggccattcgcagaaacaagaaggaaaattgtgagatcttggtcttcccaatgtactttaatggatcgcttcccagagtataaatttgttgcttcacaagcccaacaatttaaatggttattagaagatcatcccgaatttttcaataaagtgttaattccaaaaattcagcaatctcagttttttgctgttggtggtacatgggttgagaatgataccaatattccctcaggggaatcgctggcaaggcaattcttttttggtcaaaggtttttcttgaagcattttggtctcaagtcaaagatattttggttacctgacacctttggttattcttcgcaaatgccacaactttgccgcttatctggtattgataaatttttgactcaaaagctttcctggaataacatcaacagttttccgcatagcacgtttaactgggcagggattgacggttctcaattattgactcacatgcctcctggtaatacgtatacagcagattcacacttcggtgatgttttgcgtactgccaagcagaataagacaccagaatattacggctccggtttaatgttgtacggaaagggtgatggtggtggaggaccaactgaggaaatgctgcaaaaaatgaggcgtattagatccatgaataacagaaatggtaatgttattccaaagttacaagttggtataacggttgatgaattttatgatgacattttgaaaaggactaaccaaggccatgatttacccacatggagtggtgaattgtatttcgaatttcatagggggacatacaccagtcaagctcagaccaaaaaattaatgaggttgtccgaaattaaactacatgatttggaatggatagctgccaaaacatcagttttatatcccgattcgtataaatacccttccaaacagattaacgaactttgggagaatgttttgttatgtcaatttcacgatgttctaccaggatcatgtattgaaatggtatataagtatgaggctgtccctatgttgcacaacgttgtgaaagaatgtacttccttaatagacaaaaccgttcaatttcttcagagtcagagtaaggcagatttggttgagatgagaacattaacttggtcaaaaccagaaaaggtttctgaggagtgctcgttgaacggtagttacacgtcctctgtaaccgggtacgatgactatatagtccttgccaatgggaagttgaaagttatcatttgcaaaaagactggggtgatcacaagcattacggatgaaactttgggggtagaatacctggacacggaacatggcagaaacaaattgggcgccaaccagtttgttatttatgatgataaacctttgggctggcaggcttgggatactgaactttattccgtcaaccaatacaagtatgtaacaaagccgaagaaagttcaagtttcctgcaacacaaaagagaaatgtgctgttgaggtcatttttcaaatttccgaaaaatgcaaaatcaaatcagtgatatcactcaatgcaactgcggtcactgatgctaaattaagtaaagtagacatttctacgacggtagaaaactgggatgctagaaacaaatttttaaaagttgaatttcccgttaatattcggaacgattttgcttcgtatgaaactcaattcgggattaccaaaagaccaacacattataatacctcatgggacgtcgctaaatttgaggtttgccatcacaaatttgctgattattctgaatacagcaagggtgtttcaattttgaacgattgcaaatatgggttttccacacacggtaacttgatgagattatcattattaaggtcaccaaaggctccggatgcgcatgctgatatgggtactcatgagataaaatatgctatctatccacatagaggagcactatcaagcgacactgttaagctcgctcacgaattcaattattgcttcaaatacaaactccccaaagatattggcatgaattttgatgacatcataagcatttccggagatgagaatgtcattttgtctaacataaaaagaggcgaagatgatagtgctgtcaagtccaactattcattaaatccaagggatgaacaaagtattgtggtaagggtttacgaatctcttggcggggaatcttttgcttcactaaataccacactaaatttgaagcgtattgagaaggtcgataacttggagatgaaagtttataagagtttgacagcaacgcgagacgaatcaaatcatgcaataaacagaattcccattaaattgagaccttttgagattgcctcattcaggttgtatttctgagtttgtctccctcactgttttttacattcactcactcccaaacttatgccatttctatcatgataaccaaaaatagtcttaacaaaatacatataagtaaataatgctaaataaaaaagcaaaaaaataaaatttatatcacacttgtaaaacctttaaatgatcttcttttttacctgttttattcacttgtttttttttttctgagttgttgcgccttggaagaatggaaaagcaatagtttcagtgactatagtatacaatcaaaacacccgccagttcaaaactattacttggtcactaacccccaagtcatctctagcaatttaaatttcaattttaagaaaacctttatttatccaacgtgaacaagtactttcaagcacttctgcccaccgctatatcgtggaaaaatgtgtcaagctaccaatggcccgagtagagttgtgactaaaaagcataggaaatttttcgaaagacatctacagttgcttccctcttcacatcagggacatgacgtgaacagaatggcgataatattctactcaatctcaggactctctatatttgatgttaacgtttctgcgaagtacggcgatcatcttggctggatgcgcaaacattatatcaaaacagtgctggatgatacagaaaatactgtgatatctggatttgttggaagcttagtcatgaatatccctcacgcaacaacgattaatctaccaaatactctctttgcattgttgtccatgattatgctgagagattacgagtattttgagactatactagacaaaagaagcctggcgagatttgtttctaagtgccaacgacctgaccgtggctcgtttgtatcttgtttagactataagacaaattgtggatcttcggttgattcagacgatttaaggttttgctacatcgcagttgccattctgtacatatgcggatgccgatccaaagaagactttgatgaatacattgatactgagaagttgcttggctatataatgtcgcaacaatgctacaacggagctttcggtgcccacaatgaaccacactcagggtacacatcttgtgcgctgtctaccttagctttactctctagtttggaaaagctatcagacaagtttaaagaagacaccataacctggctattacataggcaagtatcaagccatggatgtatgaaatttgaaagcgaattgaatgccagctatgatcaatctgatgatggcggtttccagggaagggagaacaagttcgctgatacgtgttacgcattttggtgcttaaattcactacacttactaacaaaggattggaaaatgctatgccaaactgaactagtcacaaattatttgcttgatcgaacgcaaaaaacattaactggaggctttagtaaaaatgacgaagaagatgctgatttatatcacagctgtctagggagcgctgcgttagcattaattgaggggaaatttaatggagaattatgcatacctcaagaaatatttaatgattttagtaaaaggtgctgtttttgaagttcaaacagtaataagagtctatcgattacataaatgtgagcaagcgaaaaaaaaaaattggcattataaaccatcattttcgatgaaataatcaatcaacgtagataagctgatattatataattttggtctgttcgtgttgattttatcactgatggactttggcatacagatagtgacaatttcgttattgaaccattgagaatggaaaatcaatggaacttcatccagagttatgcacatagaagctccctcagccggaaaaaagctgatagcgccaaaatctattagtgacaagtctgtgttaaggccagttccagtaaattttgtatacgactccttcaaggaccataagtaagtaaatattgtgcatggatcagacgctttcagtaaaccgttaaattctctttcactaaaaacttctttaaatagctccaactcttccctcccgccataattgcacggagaagcgatatcaattccgacatcctggtattcatctgtacttacacattttacgaggaacatagctacatattgttcaccgatggtcatgctaaatggaagaaaacgattgttgtctaagaatggcttaccgaagctgcccttgtcaaatttcagctcttgaaaatttaagcccgttactatagagcagccaaacaactgcagcagctggctgcatagatttgaacatctatcgtgaaacgattttttattgaggattctggcttgagacgccaatggcaaagttctcattaatgcctcgaacgtaaactcatccgcgagtatatcctcttgaatttcaacaacgaatatacctgcccatggtcttacacctgccacctttgaaacttcgcttactacttcagtcgttttaaccatccacggtttttttgctgagtgattctctttctcctcattctcattttagtcatagcggttttaataagcgcccgaaagataattgtaaaacatatattcaatgcttaaaaatataagaaattgcccatcaatttgaaaactcaagtaaaacagagaagttgtaaggtgaataaggaatgagtgacgtggtcagtaaagatcgtaaggcattgttcgactcagcagtatcctttttaaaggatgagtccattaaagatgctccacttttaaagaaaatcgaatttttaaaatccaaagggttaacagaaaaggagattgaaatagccatgaaagagcccaagaaagacggtatcgtaggcgatgaagtatcgaaaaaaattggtagtactgagaatagagcctcacaggatatgtatctctatgaagcgatgccaccaacgctgccccacagggattggaaggactattttgtgatggctactgccacagctgggctgttgtatggtgcatatgaagtaactagaaggtatgtgataccaaatattttaccagaagcaaaaagcaagttggaaggggacaaaaaagaaattgatgatcagttctccaaaatcgatacagtcctcaatgccatcgaagcggagcaagctgagtttaggaaaaaggaaagcgaaacattaaaggaacttagtgacacgattgctgaactgaaacaggcgcttgtgcagacaacaagaagcagggaaaagatcgaagacgagtttagaatagttaaactcgaggtggtcaatatgcaaaatacgatcgacaaatttgtttcagataatgacggcatgcaagagttaaataatatccaaaaagaaatggaatctctgaaaagcttaatgaataaccgtatggaatccggtaatgcgcaggacaacagattattttccatatctcctaatggtatacctggcatagatacgattccatctgcgtctgagattcttgccaaaatgggcatgcaagaagaaagtgataaagaaaaggaaaacggcagcgatgctaataaagatgacaatgctgttccagcgtggaaaaaagcaagagaacaaactattgatagcaacgcctccattccagaatggcaaaaaaataccgccgccaatgagatcagtgtccctgactggcaaaatggacaggtcgaagactccatcccatagcgcaattctatgtaagtaattagttttttaacggaaattgtaattgtaactgtcctagatactatggacattcaatctgattgttacccggaacatttgcttttgaaaggcatttttagtagcactaatatattggcagctaattgaaacagtaatctacaaatatgagtaagctaaaccacctcaacaaagctattcgtggctagtatatgaccttgaattgccatggaaaaagaatcagtatacaacttagcactaaaatgtgctgagcggcaattgacctccatggaattttcgaacctttacaaggaattctttaatgaaaagttcccgtctttgattcaagaggaagaagaagatacaacaacaactgcaaatataaatgaggtcaagaaagcgtccgatttggtggatacacccagcaacaacacggctgctactgcagatactacacacttacacgaggctctagatattgtttgctccgattttgttaaaatattaaacctggagaagcctcttatcttggcagattatatcgttgaggtattgcttgtgaactacaactcagatatgataaaatgctttctgcctaaattgaattccgttaggaactccttgctattggcccattttttctccaaatcttgttcattctttgccaaattatcagatactttgataattgatcaagtacgcaaggatttgggcaacgtcatagtaccgaatatcttaagtctagacatgaatagtatgaataaagaattgattgccatagtatcaaagcttttgcaaacaactttaaaactctctccttcaccaattcttttaacttctgccggctgtaaaaatgggtcttttacgctactaaatcagttgtctcaaaccaacaagttactttttaaaagggtttctcagacttttgaagcaaaattacatttcaaagataccaagccatttttaaacaaagattccactaacgaattcgtaggttctccttcattaacctcccctcaatatatcccaagtccactttcttcaacaaaacctccaggatcagtcaattctgctgccaaatacaaagacatgaagcttcttcgttactataaaaacatttggctgaacaataaaattatcaattgggaaatatcgaacccagacttcctatcaaaatattctgcgattacttcttctatatttcaagagagctttaattcagttcaaaacttggaccagttactcacagacttgattgagacatcgtttacttgttttgctcaattcgttagcaataagcaatatcatcaggcaaattctaatttgactctgttagaaagaaagtgggtcatatttataacaaaacatctaccattattaatcctggaaaactcttcaagaagtcctcgtgtagtcacgaatgctctggataatattgacgaaaaagtcgttaaagcaatcagaatatacttcaccgaaaaagatgataacaaaaccaataatgaagatctatttgatgattatccatctacaagcttggatataagacacgattttatcaaagggttgattatgttaaatttacagcctgcgtccgttatcaacaattacttaagagaggaccaaatgatcgacaccagtattttacctacccgtgatgatttgtttgttcgtaatttgcaaggcattcaagaagtcgtccataataccaacagtttcatcatttcatccttagatactttagagttagaatcgataaccgaatcgatcacacatgattcgagtaacggactatttcaagtattacacaattttgaatctgtagctccgacaaaacaacgtgagatagtaaaagcctttttatctatatttgaagatgcaataaaagaattgaattataatagaatagccaagatatgtgctcttttgtttttcaacttttcacattcattgaccacaattctatcattttcttcgccagcagcactaatgaaaacattgataaaattcgttgatttgtctagaaatggcagaaatggctcaaacggtaatgatgaaagttcagaatatgaaacgataaatatatctttgtcattttcttgggcaattttactgataatcaacctaacacaaacatatggcatatctgtggtggatgtggcacttaagtatcctgaattgagcataaaaaattcctttataatcaatttcatttcaaatctacctaatgtctcagataagtactatttggaagaatcaaatgtgaatgattcagatatgctaacaaagtctcataataccgttcaaagctggctttgtgatctttttgttaatgggtccataacagatcaattgatccaaaatattgaaacaaggcaattggctaatctcataccatttattgttaaacaggttttgctatctgttgaaataggcgttttaacggatatttcaagtctgataggtggcttcgaatatttcttacaacctttactattagttgggctaatcaaaactttttattggctagaacaatttctttcttgcgtcaagaacgacacaatatctgaagatattttacaagggatattcaatttattgaatacacttttcaacccagtaactcttaacgaggattcgaaagcgttccacacggctgtactgaggttgaatgcaattccactactcaaagttctccgcaaatttagagttcagagccagtcaaattatggtatctactcttctgatgcccaaggtgatcctaacttagaacctttgatagccaaattagttgccgttcttaatgtatcacccgtttatgacgtcgatccaagaattatcaattcagagaacgattattctagaaagcagttgggttacggtaaattcctaattttgaacgaaaacccgattaacaagataatgacgaaccaaattaactcattctggagtctccacagcagcacatattataacttagattatctatttgagttaattgaattggttaccccaaaaagtttcctttttgatgttttgaaaacattagaatataaactagccacttatggggtccctggttctgaaaataagaggggatcattggattcagagcatgttttcgattatttcttctactttcttgtactatatgatgtgaaaaccgcggaggaagccagtcaactaatagaatatatggagaacgacgcaaaaaaaagtaagggggacgttgatataaagggagaagacttacatgagaaaaatgactcagctgaggtgaggcaagaaactcaaccaaaagctgaagctacccaagacgatgatttcgatatgctttttggcgagaatgatacaagcactcaagcttacgaagaagaagaagagaatgaggataacgacggcaataatagaacaaacaatgtaccaatgataaaagcagaagaaactcctagtaaaactaataagatatccattttaaagagacattcgtttgcggtacttctgcatgaaagaaaattattgaatgatttagctttggaaaacggcgaaataaccaagacagaaaatgagaaatttatcagttatcacgataagtacttgtgtatgctgaaaacatgcgtattctgagccatctctcctgatatataagacagatattaataaaggtgatatgatatagatatataaaaacactaaaaaattaggcagtatgataacgaatatctaatatgaaaaaaagatgaagatagcagattaaagatagacattaactccgcttaatgtaaataacacaatatgaatacctttttcatgccaatgcacttgccgcttccttaattccatcttgacttatgcttttgctaccttcacgagtgacttcggaatcattttcacccacttcaatggttttaatgtttttttcctgagtcttaccttccatgacgacttgttgaacttgctctttttgctttgctctatccctcattctttcttcgatggtaccacgaacaagtaatctgtacactgtgacttgcctcgtttggcccaacctatgtgccctatccatagcctgtgaatcaatagtagggttccaatctgaatcatagaatataacagtgtcagctgcggtcaggttgatacctagaccacctgctcttgtacttaggaggaaaacaaagatttctggattagtctgccaatcatggaccaaatctcgacggtcctccaactttgaggaaccatccagtctaatatgattatattgtctataggtcaagtattcttccataagatccatcatcttggtcatttggaaatatatcaaaactctgtggccttctgatttcaactttaccaacaattcatccaattttcttaatttcgctgattcggtaatgaacctatccatagatggcattgatatgttggatgaaaaatttttatttagtggttcagggaatagtcctgtctttggaaaatcttcaacaggtattccctttttaacgtgcatgttatattgcgttattgctggaatatcggataatgcctgacttatcaacgggtcaaacagttcattatttatgctattggtaacatgactagaaccaagaacttcaatggtgaccggaggagctgaaacattgggatgataaccacgttgtatacagttcagatactcacgttcataggcatgtttttcaacgttcaataatgaagccattacgccctcggaaggtgcatttctagtaacctcgagtagctcttgagtaatggttttaaaacttaaactgtcagtattttttggaccatttgtacgttctattactcgcttgagtaagggtgtagtagaaactctaaaaaattcattcaacgagggttcacctgttaatttagataaaaataagcacagttcataattagttgatgggttgaaaatattaaatttcacgttcttcagtttattggctatgtccacgtcattgttgtaattcggtaaaatcaaatcttcataaatcaaccttggtaggctatattttattggattccttgaagagtaaatcaaatcagtgaatttcccattggaaatattattactgctcatgctagagagattcatattactgttgctaattacgctgctgttgttattagcaacagatgcagttaacatcgaggtagttttaccaaaagtagtgaaggaaaatggagaatctacatctgccctttcaaaaagatccgggtggttacaaactttcctgaattgcatgactgcgttaatcaagttctgatcagaaccagaatttgaagcagaattggaagtagaatcattcgtagcggcattctcaatggcatcatagttagtagagatttgagatttcaaaacctgatataatttagcctgcctttgagttaaatcacataagacatcaatttcaatcttgtcgcccaattctgattggacgttctttttgacacgccttaacatgaacggtttcaaaatcatatgcaaacgacgtaattgctgttggtttaatttggtattagcttctgcatgagattcaatatccttagagaaccattcattaaattcatcgtgagaatcaaaaagagaaggcatgataaaatgtaaaagtgcccatagttcctgcatactgttttggataggagtacccgttaatagtaatctattacgacaatgaaaactcaacaggttcttccatctagatgactgtgaagatttgatagcttgggcctcatccagtatcatatattgccatttcattttctgcaaatagttagcatcagtgacaaccatttgataggatgtaaccatgacatggaatggcgcattcttattatacctcagatttttcctgtcccaaaatttcctaagaactttacggtcattggcattaccccagtatggcagaattttaaattgaggcaaaaatttggatatttcattgacccagttatgcagagtagaagcgggtgtgaccaccaaaaagggcccccaaatattatggttctcggctagatgagccaaaacggaaatagattgcacagttttacctaaccccatttcatctgctaagataccattgataccctggtcgtaaaggttagctagccaattcaaacccttgagctgatattctttcaaagtacatgccaaaatctttggttgctcgatggttatttcacctaaagaggttgggttttggaagttcaactcatcttcctcctcttcttcctcatgcgcattggcatgatcatcaaattgtttcgctttcgctcttgtttctgccagtgcattggaagcattttcagcagctcttagtctcaattgttcgtcattttcgttatcaaagtcaatggcgtgaaagtcatttttatttggagccaaagctgaaatgtcaatattcttctggctttcagaatcattactggaaacattgttcccttccaattcgttagttttgattttccttccaatgaaatgcgaatacaattctgtctgtgttaacaaaaagttcagctttttagcttgtcttttggattccttctcctcttcttccttctttgcctgttccatagcctccttttctatcttcttctttagatctctttcttcacgctcattcttcttccaaaaattggacatttccctaatacctcttctggccctcgtttggaagtcctttatttgtttgaagttcttggattgccatttcttggcttctctagcacaaagtgaggaagttttcctaaaatttgtagatctgattgattgtatttgctgaaccaatcttgacattttcgtagaatccttacgagccatgtctttccaaatagttgtataggtgttgtcgtaatgcctctggatagcacgggcttccttagcattcattttcatgccgtaagtgggcaacccgtgtctagtgttgaattttctcttattagcatcatcggcaccgttagcagtattattgtttaatttccttctcttgtgggattcagatccatcctcatcattatccaaatcattaccatccaaaccaacgttgttcttcaaggcctcttccctttctctttctctcttcgcatcgttaatcagttttttcaaccttttgacgtggtactgtttcaaagttattttgatgttcaacttggaatcgattggattgtagtcggtgacaatacaattggtgaacctcctcttcttaatcttctgatgcttgtttttgttgcacattttgataagttcacgtacaatcttcggcctatcactgttgatggtaatatttttatttattttcttggacgttattaaagacagcgagttcatagatagtttggtggatgaagaagaagaggaagatctctttctccttttctcgacatcgggattaaagtcctcatcgtcattgtcatcctgttcttcaaaggcggcgaaatcttcttcatcaagatcctcgatttcctcttcctcttcgtcctcctctccattttcttcctcgtcatcattgtcactgtcattgtcattttcattttcgttgtcgttgtcgttgtcgttgttgttttcattgtcgttgtcgttgtcttcgtcttcaccgttattgccatcctcgttttcgtctccattaacagtaacaacagtatcggcatgagtttgatcatcctttatggctttcccaatagcggcagcagcagcagcatccttctttctcgatttttgaataccattcccacgcatgctcttcccattggtatgcctaccagtacttgcctcatcttcttccatgtcttcttcaccatcttcaagctcgtcttcatcatcttcttcatcctcgtcagcgtccttttcattgattatgtccgataaatttgcatttttaaaagattggtattccgcccattctttattgatcatgctcatatcacggtacagttttttaaaatgcaggtcctgagaatcattagtgttatcaaattgccaatccttggattgttgattccattccgatatcaactcgaactcttgtagattgataaatttccagtcctgataaagttgctctatcgaatcccttctcttgatacggttgaactcactgttcagttgagatagatacgcttgtttcttatctagcactctggtgggcgccacatcggcaactctctctctgctattcttcttagcagacttgcctgcggtagtctttgaaaaatcagatatatccttgtcctccttattgagtagaactgccagtgacatgtctataaatgctcttctatatgtcttaagccttgctttgctaatatggacaggatcggtagttactcttctcttgttacttttcttttgcctcttcctcttgttcttctcactccactttttttgttttacccgtgaacacgtacactatacgctcccacccaaatgccactcacttaaattccaattcgattcgattccgagttcgtcgttgtctttgtctccttttcctttcctttttttcccacgacttcgtgcagttgcatttgcctctcccactctgtcttttttttttcccatttagcttcttctttggcgtccagcaagaaactacgttgggcacgtctaaggggccaagctcttgcaaccgtaacttatacttacatctacatacacatacatcatatatcgtaaatttacaacagaacatagcttatccaagacatgaagaagacgccggctgtgacgctggcgcgcgatccaaaaagaagtgtctttgatgactatacagaccattcagcttcagaacagacgtaactcagcatcattctcttgcgttcttttaccatttctcttgcccttttgtcgtatttttctcttctatagtatgagtacttcctgtttttcaccttccacgtggatattttcacgtttgcgcgctgcgtctttctttttcttttctggtgactaatcggtggtccatcgctggccaatgaagcatataactgatgtttaacatttaaatcttggtttagacggcatcatctaagcgttattctcatcgtatagtatcgaaaaaagaaaatagtatcatagcacagaggcatgtcaacgtttgggaaactgttccgcgtcaccacatatggtgaatcgcattgtaagtctgtcggttgcattgtcgacggtgttcctccaggaatgtcattaaccgaagctgacattcagccacaattgaccagaagaagaccgggtcaatctaagctatcgacccctagagacgaaaaggatagagtggaaatccagtccggtaccgagttcggcaagactctaggtacacccatcgccatgatgatcaaaaacgaggaccaaagacctcacgactactccgacatggacaagttccctagaccttcccatgcggacttcacgtactcggaaaagtacggtatcaaggcctcctctggtggtggcagagcttctgctagagaaacgattggccgtgtcgcttcaggtgccattgctgagaagttcttagctcagaactctaatgtcgagatcgtagcctttgtgacacaaatcggggaaatcaagatgaacagagactctttcgatcctgaatttcagcatctgttgaacaccatcaccagggaaaaagtggactcaatgggtcctatcagatgtccagacgcctccgttgctggtttgatggtcaaggaaatcgaaaagtacagaggcaacaaggactctatcggtggtgtcgtcacttgtgtcgtgagaaacttgcctaccggtctcggtgagccatgctttgacaagttggaagccatgttggctcatgctatgttgtccattccagcatccaagggtttcgaaattggctcaggttttcagggtgtctctgttccagggtccaagcacaatgacccattttactttgaaaaagaaacaaacagattaagaacaaagaccaacaattcaggtggtgtacaaggtggtatctctaatggtgagaacatctatttctctgtcccattcaagtcagtggccactatctctcaagaacaaaaaaccgccacttacgatggtgaagaaggtatcttagccgctaagggtagacatgaccctgctgtcactccaagagctattcctattgtggaagccatgaccgctctggtgttggctgacgcgcttttgatccaaaaggcaagagatttctccagatccgtggttcattaaagatagaaacaaaacccctcaagagttatgtatatttatatacgcatgtatatgtattagtgcacgtaataaaacggcaacaaaaaacaaaaagttgacatattatcggtacttttattttcgtatcggttcaattatattatatgttagatatacaaagttttttatatgtaattattttttctgctactttaaagaaaatgtcacaaaatcaaataaaaagcttataaatcttcagtaataaaacccttgtgagaaacgtagataccgtccaaaaatttacggatatccttgtttctgacacgacagatttgttgcaagtcagcagcgttttgggaaacgtcttcgacagagttacctgacaagacaatttcgtccttaacgttggtggaaaattcgatagtaacaccatctctaactggaacgtttctgatcttcttgtcacccaaaaagtttctgacttcaatgaatttggcaccatccttttcaacaatgttgacgttgattgggaaatgcgcgtagacgtatctcatcttgtacttgtaacccttggtgacaccagtgatcatgttgtcaaccaaagacttgacggttctcaaagcagcaacgtgctttctgccaccgttgtgaacagcaaccttgatcaattggttgttgaccttggtgaaggtaacatcaatgtgcttcaagttcttggtcaaagtacctcttggaccaacaaccttgacgattctggacttgatgctgacagtgacaccttctgggacttcgatttgttgttcagtttggatgtatttcatgattgaacttctggtacgggcttcttgatttcagaagctttttacacactaatttaatatcaaaaaattgaattgagtgtaaaatatactattatacaatacaggcgcgccagcgtctctgccacattgcctctgacctccgcagttccgctgtgctgcatgtgtgtgtatgccaatattgggatgatgggaggatgttggaaatttcatcgcttcttcgcgtcagtgaaattttccacagaaaaatgaaatgacaaaatgagaaaggatgaaaaaaatgtttcaaaaaattaaaaaataaacccaaacatttctggaaaacagtcttacaaaataaaaaagaagaacgacaccaaaattagcatcagtacaattttttctcctctatacgcaggacaaatactctctgcccaatgctcttttacaaacctttctttttgatatgagatgaaggattacttttgatcttaataatcaaataggtagtaactataatattggatatcagctgtgctaccataagcgacacaaaccccacaatcagataactatacgtcgcctcatttatatctcgcctatcactttccatttgaagaagtgtggtatcgctcactatctggaaaaggccgtcagagacggtattcaatgctttcaccacctgcggtgtcatttgattgaccaaatgcaacaacatgtcaggatcgagcttatcattgtaggtcatctttatcgttacagatttttcagtatcaatcgagctccacgatccgtcatagactaaatttatgaaacatatcaagaactcattacagttcccaggattaacttcgatgaccgacgtcccgctcgctagatttttcttgcttcttaacaaatcaccattcttgttattaaaaacactgaagcccagtgattgcctcccacgctcgtgactggttcctccgaacctgctggagtctgtttcttcttgcaacacgtccattacatggatttcaaaaacaacctccctagacgcgtcattcatgcctgcattaaacacggtacagaacgctccgtcagaagcactgttgttagagctatattcgaaatcttcgtacagggctgctcctagcagcaacgagcgtttaataggcggcactttgaacgacagcttattattgaatatcggcatatatacttctctggagcttacgtcgctacttaattccgcacttgtaataaatagtatgctcatgaaaagcaatattcgacctagtaaatgcggcctactgcacgccttccatcctcggagccccattcgcctatctgtcagtggtatttcctttgtctgagcaatgttcaaggaagctttttccatgttttcacaatgacacagagaaactaggccttaaagacggtagaatctgtaaggagaggcaaaaaccagaaacttttcataagattcagtaaagtctttttactactagagtgtacggcttttattttattttgaacacaactacagcctcaccacggtatttttttttcctttgaagaagtatcaacgacttagggtgcaatagcattacccatccccacattatgatgcattattaaacttaactttactggcattggctaccgtcgccgggccgagggtacaaaatcgagaagtcataaaatcagggttatatgtaaaatacagtagggcatagcattatataacggggttcttaaatagggctgaaagaagaatattaggtaaaaattctacatttctacgagccctgttttattgatatttcaatataaatacaatagtataacaatagtgtaataatagtagatgaatcctaaaaattgtaggcagaagtagataagaaattgtatattaagttattgtttataagcatagtcacaagtgcataaaaactatgaacggcattgatgatctcctaaatattaacgacagaattaagcaagtgcaaaatgagagaaacgaactggcatcaaaactgcaaaatctaaagcaatcattggccagcaatgacacagaagtagcattatcagaggtgatagcacaagatattattgaagtaggggctagtgttgaggggcttgaacaattaagggcaaaatatggtgatctgcaaatcttgaataaattggaaaaggtagctgtacaacaaacacaaatgcaagctggcgtagacaaactagatagttttgaacgtcagttagatgagttagctgaacaaccgccggatcaattcactctagatgacgtaaaggcgctacactcaaagttgacgagtgtcttcgctacagttcctcaaatcaataatatagattctcagtatgctgcttataacaaacttaaatcaaaggttaccggcaaatataatgacgttattatacagaggttagctactaactggagtaatacgtttgatcagaaattgttagaagcgcaatgggatacgcaaaaatttgcatccacatcagttggtttggttaaatgtctgagagaaaattccaccaaactttatcaattaagtctgctctacttacctttggaggaggaaacacagaatggagatagcgaacgcccactttcacgctcaaacaataaccaagaacctgtgctatggaattttaaatcactagcaaacaatttcaacgttaggtttacgtaccattttcacgccacatcgtcatcctctaagattgagacgtattttcagtttctaaacgattatctagcggaaaacctatacaagtgcatcaacatttttcatgatgactgtaatgggttgacgaagccagttattcatgaacaatttattaattacgtcttacaacccattagggataaagtaagatccaccctatttcaaaacgatttgaaaactttgatcgtcctaatttcccaaatcctggctacagacaaaaatttattgaattcttttcattaccatgggctaggtttggtgtcgttaatttccgatgaagtatgggagaaatggatcaactatgaagttgaaatggccaataggcaattcatcaatataactaaaaatccggaagatttcccaaaatcttctcagaattttgtcaaattaatcaataaaatttacgattatttggaaccgttctacgatttggattttgatctattagtaagatacaaactaatgacttgttcattaatttttatgaacttgacttcatcctacttggattacattttaactgtcgattcattgaatgaaacaagaactaaagagcaggaattgtatcaaactatggcaaaactgcaacatgtcaactttgtgtacagaaaaatcaaatctttgtcttcaaacttcatttttattcaactgaccgatattgttaacagcacagaatctaaaaaatacaattcactgtttcaaaatgtggagaatgactatgaaaaagctatgagtacggatatgcaaaactccattgtacacaggattcaaaaactgttgaaggaaaccctacgaaattacttcaagatttcaacttggtcaacattagagatgtctgtcgacgaaaatatcgggccgtcgtccgtaccaagcgctgagttggtcaattcaattaatgttttgagaagattgatcaacaaattggattcaatggatatcccactagctatttcattaaaggttaagaacgaattgttaaatgttattgttaactattttacggagtcaattctaaagttgaacaaatttaatcaaaacggtttaaatcagtttttacatgattttaaatctttaagcagcattttgagcttaccgtcacatgctaccaattataaatgtatgagtttacacgaactagtaaaaatattaaagctaaagtatgatccaaacaatcagcagtttttaaacccagaatacattaaaacaggtaatttcacatcattgaaagaagcttattccattaagtacttgaaggacacgaagattcaagatgcactctataggattatatatggtaacatattatagctcgtaaaaaaaagagaaggaaaaaaatcaacaagacgagtattattccaaatgtaactccagaccattctataaaccgtaaataaatatataaagctctatcattgtaccaaatcactattcatttcttcaaaccgaaggacctcatcattcggatcttccgaggcatttctcctgtcgattacggcgctaaatcctcttttagctaacgcctcgactatttcaccaacagttgatatcattcccgtaggaccttcgtcaaagactccgtttgtttcaaccttattcaaccatccatattcttgaggaatgttttcagctttcctatactttttctttccttcggttacgctctgaataggttcaacaacttgtgtggaattgatatcgtcattttcatcgttatcgtcatcgtcatcaccattgaagtggacatctatcagatgatcgataacgggccaaccgtatgcgttggcaaactttcttcggactataatgttgttgtgagcgtcaggttttaaagcaacgacaacctttctccatgccattccttcatgccaccttcgagcaatcgtttcttccaaatttcgatacttcgcacgttctttctttcctgcaaaaaaagcctgaaggagtatattctttttaccaaaaaaaccgtcttcgatatcaaattcggattgtggaatgtcatcctcattgtatatcttatcatgaataattacaggatctcttgaatctggatccattatgtacgctctttcaggtaaaggaggaaggagaattgagcttgctgactcgaaaaatgatactttaggaatttcggaaccattctccgtaggaaacttttgtggcgccagtatactcaacattttagtcagaggcgaaatgaaagttttattgaagaaatcttgattcacaggtgttgaagcatcatttattagcggtgattttttgctgttctcctttagtttctgtaattgctccaagatatcattatagtctaggaacaatagcgatgcggtatacaatgggacaattccgtcattaatagcgttcgcatatactgtcctccttttgaacctacgcaaaatctctatcaagggcagaccagatagcaagtagagaagcggtttgcctacttcaacatcattttccaaacccaagtcttgacctgtttttccaataaccccgaatgaaagtagtactttaatataggcgggattatctgtgactatacctaaaagcggtgaagctaaagtaataaaatttattggattcacctttttaaaaaaccaagggtagacttcataaatgtacgctattgcgaaagcctggattaggccacccaatgaatgacctacaaaagaaatcttgcggatggattcatcgtacaaatcctggataatatattcggccaaacgagtacctaaatacttaactcccttctcagtttgacagacatttcccctataacctttcacaacaatttgttcgtggggataattcttttgtgctttgtatatctgttccataatatacactagatcggtcgacacattagaatgtaaaccatgtgtcaaaactacaagatgtttctttttctgtggtgtggtaatctgaacgggaagattccacaaatccaaggtagttaacctgttcactgtaagtttagggctataagaacctagatgagatggcagatcatgcggattttctactgactctttactagttccaatagtgacttcgtaagtgacgttcgtatttgtagtgaacaatatttgactcatcacatcagcaatccatacgtatttctgtcgtatgttatgtactgaaagttcagccacgaaatcttgttgagtttgcacattcggttcaaatttggggtaatcaactgaagcaactattttttgggaatgatgatattgggcagtttttacatcgcaataaagcatgaatggacccattaggtacgcagctctatacgataacggattcatatttctcacctttaaccacaaggaatttaaattcaaatctggtggaatttcctcaccgtcataaagatgataagtaattacatatctctcaagttcaccaaccttcactgaagacttgtaatgaaacaatatttcattagttggtgtcagagacatcttgagcaaaacacggttcgtacttcactctctttgtgtactattcttactgaactgttgaggcggtacaatttatttcacagagttttgcatatttcgggcatctactatgtgcgtcagttcttacgtggcgcagaacaatagaaaagaagatttacagaagtgatagatacgatatgatatttacaagaaacgaaaagttacgttcgtcagttactctccaataattcttttgcccgttcggtgctatcatatttagacattgcctcaataacttcgtccaatcgttctccagataacacacctggcaggtccaacaatgtgaacccgcacctatgatcagtgattctgttctgtggaaaattgtatgttctaattttatcagacctattggtgctagaaacctgactctttcttgcttttctttctttttcctccttttccagcctttccttctctgcaagtctcgctcttaagatcgtaaatgctttagccttattcttgtgttgagatctttcatcttgcatggaaacaacaattccagaggggatatgggttaatctgacagcagagtctgtcgtattcacatgttgaccacctttcccgcttgcacgcatgatgtcaactctgatttcaccaggtttaaatgttctttcataagcgtcaatagatttagcagattcgtcaccaatttgaggtaacacaaccacggcagcagtggatgtgtgcgtccttcctttagtctccgtactaggaattctctgcaccctgtgaacgcctgcttcaaacctcaaacgatcgtaagatccggcttcttcaatgctcagaatggcatcgataatgcctgacccactttcgttttcatttttcgatataattcgatacttccattttctatagttggcatagccaatatacatatccaatagattctgggtaaaaatcatggcttcaatgccacctacacccggtcgaagctctagtaagctaggtttatctgcgaacggatgcggtggaagaagtttatttaccaatcttgaggaggtcgtttcatattgggggaccagttctgcatattcttgttcagcctccgcccttaatgatggatcagatacaatcatttcttgtaaacttttcaattcatttagtttttccttatactcaataaatgtatcagtgagcgctgataatttagcataatgtttctgcttattcacgtcaaaatgaatgccgcaagaaaggtctttgtcaagatcttttagttcagcttcatacttttccgcttgcttaacaagtaacggagagagttctgtgtattgtgttgggatgctgccgttgctcttagagttagtcgttgttgatgtcagtcgcactagtaacggcaacttgtgacccaaaaaaacacccttaaagatggacctcgaggggaactggaactttgaaagccacatgcttgcaccaatgaaatatattgttctgctctacgaacttttcattcctgagatattataaaacatatgatacgcactattaacgctctgtatttatcctccgagcgagcaaatcctcctaacaagtatatgaaatacacaattactcagcctagtacagatggcacaacgagaagtaacacatatattttctgagaggccttattgcataattatacacatatattaatatcatgtagtaaataaatcactaataattaaaggctttttcgcgaaatgaagtaaactgataagtgaagaatacacaaatttaaatatctgccgctggaatatcgctataatcgaatggtaatttataataaattattatgtctcctgatcttcttgaatcccagtgcgcaagagagttgaagaatctattgtattcaatgtatgatgaatctttcaggaaatcctttagaaatgcgttttccatgtgctcgaaaacaaccaaatatgttggccattcgtggctgtatgttttacctggactccttagatccttacgaaaaggcggtgggaaatttttgtaaatgaatgccgatatatcgtcatacaaatggtcactttcatccatgtaggtctctagtttggagtaagcctctgggtctccaagtaaatgcaatggagggttacaagtaatcgaccacagatcttgaatgtcactgcggtgtaaatagctttgaccaggtgtcgaatgacagggcattatgaatcccaaactatctatttctggctcttcatgtaaaaatttcataacttcgatagatccagattcgtggaatgtgtccaaaagtaatgcgatgaacaccgacacgaatggaacaagccagagtaaagattttaggccagatagtcttttccaataatctctatcaagtctcaaaaggccaaatgatgatattaatatgaaaagtggctgtaatgggaagatgaacctaaattccttatgaggtaacgtagagtacaccaacagattcaacaagatagtgagtttcacttggaaaaacgggtttaaatacttctttgggaaactccttttgcttagtggaaaaaataatccaaatgcaaaagcgggaatacttgcacctaatacgataggtaagctttgaaagaaatgaaaatgccaaggagctaccccataaaactttgataatggtgttgtgaaattgaattttagaaatcggaaaaagggaaacgttactttttcataaaaatacatgtcgataattgcatttgcagtaaataccagaaaaaaagaccgtaaaactttggaaaatgtgatgaaaagtaaatgatactgctttttgcctaccaagtttaatattagggaaatgctgggaattacccaaataagtccactgctgggtctttgcaaacatgccagaaatgcaaaaataagcgacttagtaaaagatgactcttttatcatttgtccgcctgtccagtcccagtagtagagggcaatagaagttaaaatcatttcaaaagagttgatgaacgttcttgtaataaaaaagcaattaaaaaaattagttaaacttaaaagcagtgcaaacttcgtaatctcggataaaccgctgcgtctctcctcttcctccttctcgtttctcttatcaagtgtaagtaaatagagcttttgaacaaatcttacgatataatattcccctatggaagctagtactgccataactatttttggcgcatatatcacaccataatattcgaacgaccgtgtgacatcaaaaggaagcctcttcaagtcttcagcgacttgccaacttaactcatatttcggcagtagtaaaattaataaatcagaccctatcgttgagagaagaagaagtgcatagtgaagaaggattgacgatagagaaaccaatctataagtcagctcaaaaatcatcggaaataaatagctacgaactccgaatttccattcccaagtcagttcaccatacttgaaagccttccaatgtgccggctccaatgcttgccaaaactcatcagcctgaaagaaggttctcgtcagaactgcattcagtactctaaaggctagaaaaacccaaaatatttgggtccgtcctagtttaggttttattctatgaacctcgtgagccattgaaagttagatattatgttggattacacaatcctacactatcttaatgccttttatctttttccgttcctcatggtgtgaatggcttgaatttcttttaccttaaaagttcgccttttccgcactataacgatctcacttaaacttttaaggatgactcgcctataacttcattcgagtggcaaagcgttataatttatctcaagcagcatttcaaaggattctgacttaaaatgttaaacttcaccggtcaaacaaggagaagaaatgtcaatttagggaataggactcgaaattcaaagaaggatttactggaaaaggccaaaagggaacgtgaaaggagagcacaagataagctcaaagaagacgccagtaaaaccattcaaaaaagcatcagaagacatttttcaaatgtgagactcttcaaaaacacatttactagttcgcaacttgttcatatgataccagcttacgggggcaaattaatctattacatttctcaatatgatctgcagcaactgctaaaattatctcataattttttgagttcttatcctaattctttaggcaacagacagctattgagcttgttgaagctatatcaagatgatgcactggtggctgaaactctaagcgatcttaacatggactgccctacagttgacgaatttttagatagtctatccgtttatctctgtcgggcttcctttttgagttattcctcagcttctaagctagctgatgtcatagaagcatgggaagtaatgcatagcagtgcctccattagtattttttcgatatcgataggatcttacgaaaaacggccatttgcactacagttttattgcatacttgccgaaagaaaccttttgccccaacttatcaacacaaatccgatattatgggataacatggcaaagacatattcacactgtagtaaaggtggccaaaaaaatatcgccaagctactcataccaaacttcaacaatcatattgctccatcagtcttgcgtagtgataacgactatgtcttgaaattttatgaaaaggcatttatagacgaagttattgctactactgcaaattacgtttctgatgaagatcacgtgaagaatttgatgtgctacattgcaagctctcccaatcaaagctgtaagaattctgtccttattaccttactgtctaacaaagacttcgtgagaaggctctcatgggaattctttcacactaaattcaacgccagcaagactgaggctcaccccctgttttcagttttggcacagcttatcgacatgcaccttttaatatcgacagatcgggagttattagactacaactctgtgatacctatcgaagaactaaagaaatttacatccacgttaaaagattttactttccgacaatattgggaactacctaaaagtgaaaggaaccctatgttaaaggaagcagtaccacttttgagcaaagtctacgaaagggactcaagattgcactttctatccacggagaataatccaacctattgggaaaactctgaaaagcaatttttaaatttgagattttacgaagaattacaggagtacgaagatctgtatagagaacacttagaagaggaaagtgatgaggatatggaaaaggaaatagatcttgataaagaaaggcctcctttgaagtctttattattgaacaaaatgaaaaagagattaaagtcatcattacgtttccgaaagttggaaatacttttggaattaccattttttattccttttgaagaaagggtggacttattttatatgttcatcgcactggacaagaagcgattatctttagatgacgatcacaacttgatcaatatgtttaccccctgggcctccaccggtatgaggaagcaatccgctatcatctctagggataatgtcttagaagatgctttcaacgcatttaactctataggagaaaggttcaaagcttcattagatgttacttttattaatgaatttggtgaagaagctggtattgatgggggcggcattaccaaggaatttttaactactgtgtctgatgaaggatttaaagatccaaagcacgagttatttcggacgaatgatcgctacgaattatatccttctgttgtttatgacgctacgaaacttaagtatatatggtttctgggaaaggttgtaggcaaatgtctatatgagcatgttttgatagatgtatcttttgctgatttctttttgaaaaaattattgaattactcgaacgggtttttatcttctttttctgatctgggaagctatgattcggtgttgtataataatttgatcaaattattgaacatgaccactgacgagatcaagtctttagatttaacctttgaaatagatgagcctgaaagttccgcaaaagttgttgacttaattccgaatggttcaaaaacgtacgtgacgaaggataatgtgttgctctacgttactaaagtaacggattacaaattaaacaaaagatgcttcaaaccagtttcggcattccatggagggctcagtgttatcattgccccacattggatggagatgtttaactctatagaactacaaatgttaatatcaggtgagagagataatatcgatttagacgatctgaaatctaacacagaatacgggggttataaagaagaagatcagacaattgttgatttttgggaggttttgaatgagtttaagtttgaagagaaattgaattttttgaaatttgtcacgtccgttccgcaagctcctctgcaaggcttcaaggcattagatccaaaatttggtatcagaaatgcagggacagagaaatacaggctgcctacggcatctacctgtgttaatttattaaaattgccagattatagaaacaaaacaattttgagagagaaattattatatgcaataaactcaggcgccaggtttgacttatcataattcccagaagattagggaggtaattaattaataggcagatttctagttcttatatattactatagataaggaaattatacgcttgtatgcagagataatttaagttttgctttgttcgccaccattctagttatgacctttatctatcattctattttttattggaaaggctttacaaaaaacaaacagtaaaaattctttaagcgaagtgaaatcgacaatgaatatgaaattggtaattatcttacattaggacttttcaatatcttagtccttcttttctttcatgtgacttagcaccattttcaaagctaatggcaaatcatcatcagagctttcatcatcatcgttcagataattaggatccgcattaccaagggtgctgtgtctgcttaagcttgaaagttggccggaggtagaagtaatggaaaatgctctatttctaaatgtctttggtaagccatccgcgttttggcctgctttatgagaagcaatccgtaataaattcaacgctgccggattatcatttttttcgtatgccactggacattccggctcataacttcttgtggaatcaggagaaatttgagattcattagaatttgtactttgtaaactttcatttccttcggaaatgatggaagtaccatcaaatggggtccgattgcgccgtgtattcataggattgcttttcccgttaatgaaattatcaaatcctgttactgcctctgcagcccagtcctcgtaaagtggacgcgataaaaacccgtatttaaactcatttacaccgaccagaattttagttaaattcaacagctcttcaatatactcaattatttcttccgatgcagcactagatgcgttccaacttaaaaatttttcttttaaaacatattcatgaggattagctgttgtgttggcctgtccccttctattcattttcattaccaaaccttcgttatcatcgtcatcttcatccttgccgtcagcgtaatctccttcatttggctttcttgctttatcacttaaatttgaaatctgcccaggatatcttattcgcagagtttggcgcactttattaatcagccttctatgtgcaattcttgcgctgggcaaaaattgcggtaacggggtcttatttataaatgcctcttgaagtgctctcattaggcaagaaatacttccaaccatttggcgtcgatatggatatacaacactgttaaattcttcaataaccgcacttccattttgctttctcagcaaggaaattgtatctatcctctctattatttgcttctgaataaatataacttgagtgaaaacattttccaactcggtatattcaccctttaatctcggctcttgtctggttagtcctttataggccgtagcacgggctaacgcctctttagcactttttgatatcttttcgatttttttgtatttctcttcactcatactacttgcgacttgctctccttccagtccggtggcgtagagaagttccatttccgatatacagccacagacaaaagaaatctcttcatttaattgttcccgtgccttcaatggaaagaaaaagacttgaactattaatgctacccctccaccatagccgacagctaaacatctcttggcgaaactagtcaatatatcatcttgggagggaagtattgctgcaagcataacaatataaatactaataatttcaataattgcagccttcacatagggtgtgcctaataaatagtaaaacccaggaatggctccaaaaactgtgatgactgtctccaaatatggattggtttggttgacagcagcaacataggaaagataaccccaggctgctccaaaaataacccccacagcacgcaaaaagaagacccagaacgtacctcctacggaaggttccaaacaaagtatgcacacgaaaccaatccaggtaccacgatagtctatgtaccactgccttgtctttggaataaacatcggaaatgaagccagcattaatgcaatggctacctgaaatccaaatctaaagtgaggatgtgacacttcacaaaacttatcaattgaaataagcatggacataaaagaaaatctgccttgcctcctggaagttctattagttccgaacgtagttgttttcgttaacgttaatggcgacgaagaagtgtcagaggtagaagatgaatttcctttgggttcacttgtcattggcagatctagcgatgcatcatcttttacaatgttcttattcgatgaaactttttgagataaaagttcattctcttcataatcaggccttctaataactgtgtcatgagcaaaaccattagtattaccattgaacgtaccctttaatgtatcattttcagtcactgagttcctatcgccttttaaccagatagaaaatgtctcgtagttggtcaacactaaaaaccaaagtcttttgcctctcagccagcccttcttctcttgtatttgacgtttgactaaaatgtccttgacggactccataattaccaaagttgaatctgcagtttgcctaaaatttagtagaaagctagacaacaaaaacatttcatcactaggactcataatatcaatatcaaaacttaacatttctgacttgaattttgctttacattcttctaacgcctgcttcaggtcattgatcttgttctggatgtcaacatcattgggcagattattggcgttattactgaatgttgggaagttaccatctttgaacattgagcaggaatgaacccttgaaactttcacatcaaatgcatgagcaagtaccaactttgctatgtacatgcattcactcattgtccggtgtagactataaatcactggatgcaacttgtcaataactttcaacaacttctcagcatttgcaaagctgatttctttgttctttggcagtgtcaaagctgcgacatcatcaggcctgagcttgttatcatgtcttgccaataaaataaattctaattggcatgtattaactaatccattaatgaagactgtcaaattttccaaagtagatatgattggctttagtttagttggcgaaacataagcgtaagtaaactcataaatgcactcgtgaagtactactcgacagttgttaactttagaagaaatcagtgacttcatcttcaatagcttgcctaacgaaacaggatctctactgtacaactggctactattgtgcgggtcaactgcaatgaagaaatttatcgaatagtcaatggacttatggagctcattcatagcatcaatagtcgtattacccaaatatgtggtaccccactcaggaaacaacacaagattccagaaaatcgacattgcaatacccaggtagaaaggcgtactataagctttagcaatagtgcctgctgtttcattcaaaggatccataaatgcgaaatgaaccacgacaaaaagtgggaaaacaataccaaagtaatagtgtgatacagatctcatccaaccatgaaaaaaaagcataattacttcgaaaacagccaaaattgctaatcccgcttcatatcttttatagtgcaatacgtgctgctgtgcctctgttagctcatgccaagaactccctaaacatcgctgcgcaaggaaccggccgaagattgcgtaagctaggccaaatatcaatccagttatgcaatagatagcaccatggatagtacccccgacccttcttccagggtgaacaataacagaaatcattggcagcatcgcaggagctgctcccaaatgcgcagttatcttaggtatcaagcaaaatatgaaagctaccgtagtattaacagtcgatttacatattctcttcgcgaggattctgtcacaggggaaataatacagccataacttctgaatcttagtcaactttgatttaagcgacatggacaaataatgaagtcaagcaattgatgcaaaggataaggaagattttctcgcttgaaaatatgttctcttcgaactccaggataggataggaataaagtaaaaatagtgtatgatacgtagttaggccacaaccacaattataacctctcgatagcaggtgttaatagagatgaaggtagatcctggatttctcttttctttctttagacatcaaactggtagttcttatcagtctcagccttttgaagacctatcaattttatgaggagggtaatggttgcttccttttccctagcagcggcccatcgctttagcttcaaatagttgattcctttaactgttgactatgaaaaggtagtcttcgttgggattggggataaaagaatatctgaatactgttgctgtccgtgccatttactagcttacggacgctatcaaattaactcaaaaacgcttctgttcatccgctttccagaagatcaacgctcaaaagacaacaaaacaattcgaagacgtcattcgttatagagtgccaatcaacattggtgggtactagaaaacttctttgcaaagtatagctaagaaaggtctttttatttacgagcgggccataaataaaaaaatttcaacaacaacaacaacaacaacaacaacaacaacaacaaatagtggagactagaaaagtatacccctcacaggcatgagatttcttcaggtttataaatcatcggcattaattggactaataatattgttagccagtaaagtaaatcttgcagaggcaaaaaggaagctggtagccacatcattggtcacatgtatggaaaactcgcagctgtcagcaaatagttttgacgttgttttcaatccagacgacaggtcattacattatgatcttgatatgtcaactcaaattgattcatatatttttgctgatattgatgtctacgcatatggtttcaagatcattactaaaaatgtcgatctttgttcaatcaactggaaacagttttgcccggttcacccaggtaatattcagatcgactctattgaatacatctccagtgagtacgtaaatgaaattcctggtattgcataccaagtccccgatatcgacgcatatgccagggtcaagatcaccaacaatgtgagcgagtacctagcatgtatccaaatatacttctcaaacggtaaaacagtttctcagattggtgtaaaatgggcaactgcagtggtagcgggaattggtcttttactatctgccatcttatccacttttgggaactctaccgcagcctcacatatttctgccaacacaatgtcacttttcttatacttccaatctgttgtcgtggttgccatgcaacatgttcatcgagttccgcctattgcagccgcctgggcggaaaacttggtttggtcaatggggttaattagaatctcattcatgcaaaggattttccggtggtatgtgcaatccactggtggtacgcctagcttatatctgacttcaacatctatgtctgttttggctcaaagaagttggcaatatttgatggagctcccattaatcaaaagagctaccaatgttttgtatggtaatgcaaatacattaatttttagaggaatcaaaaggctaggctataaaatgggaatcgaaaatacgtccatcgtttgtaccggttttactttcttcgtcttatgtggatatgtgttggctggatttatcatagtattcaaatgctgtgtggagttagccacccggttaggatggatccaaaaggcaaggttttgggaattcaggaaacaatggagaatgatcttaaaaggtgctcttttaagatatatttacatcggtttcgttcagttaacaattctcagtttttgggaatttactgaaagagattcacctgctgttatcgtcatcgcatgcctttttattcttttgtcatgtgggttaatgctttgggctgcatggaggactgtttttttcgcaagaagatctgttgcattgtacaacaacccagcagccttattgtatggagatgaatatgtcttacacaaatacggatttttctatacaatgttcaatgccaatcattactggtggaacattgttcttttatcctacatttttgtaaaatcattattggttggatttgctcaggcttctggtcaaacacaagttcttttcatgttcatattggatttgttttacttcgttgctattatctactataagccctatctggaccgtccaacaaacataatgaatattttaattgctactgttactgtagttaattcctttctattcatgtttttttcggacttgtttaaccaaagctacaaagtggctgctattatgggatggatatttttcattatgaacgctgcattttcgttcattttactaatgatgatattggcattcgctggtatgatgcttttctcaaagaaccccgatctaagatttaaacctgctaaggacgatagaacttctttccaaaggaacactatgaaaccagaaggtactgttaatagatcagtagcgaacgagttgcttgcgttgggcaatgtggcaaaagaccatgacgacaattcagattacgaatcaaatgatactggtgtgaatgatgagctaaagcaagcacaggatgaaaccactcccacaaccgtaacatcaagtgatgataacaagcctacgttttcagagaaaatattaagtaaattctctaggcctaagaatgaaaacgcaagcacagatgctctgagagttgaagctccaaaacaacaaacgtttcctcacaacttaacgaatctttcacgagaaaacctatcaacattaggctctaaaccttatccaggacacacaagatcacagtctgatgcgcataatggactgatcaattcctttgaagaggaagatacaagttcaaataccgatccatttcacgactccactgaaggagaccttttagatacctcaagttcggacggaggatttaggtcgcaaaactatgttcgagatgacagcataaatagtttgggaaacaataaacaaccactgaggaaaccccctggattcttcgatgaaggatttatgtgagtctttacgatatacaaaagttctgctcctatcataaaaatttttaattttacaggtttttctcattctccttctaaccttctaaattctgtttttgtcagaagtttcccaagttttctttttcattaataacgttaaaacactttgtaccagtttgcttaatatgaatttttttaaaatagatagcttttgttatctttgtttctatgttgtaatatcccagtttgtcatatttttaatactcctcgtgtaacaacaaattaaaaaaaaataaatacttaaattaatcaagttaaataaactaatcgaatcaaacaaacaatttattataaaattatgttttttcatgaataggaatgtgtaagttgttcagttcttaagaggtatcttattttttaacatctttgagatcttcctcctcaaatatttccttcttgtaatatttccactattagagtttctattatgtgcggctatcgctcttattagtgcatcatgaggcctttctatgttttgcgcaatccgatttattgtacggtctagtttttcatgaaaattcgggacattttcattcccagagctatcatattgctccataggatttatttcgtttatccaagacatttctttgtttttaaactttcttaagtttttatagctcttccaaaactccgaagttaaggatttatattccaattcgtttgatatgttcttatctgaatggatgagcatctcatatttggacataggaatacttaacgaatgtagataaggtaccaccttggtgattcttcctttaattgaccaagatattttgtaatctctaatatcatcagaaataataggcgttaatggaatagtttcaaaattgttctgagtggggggatgcgtctttgaagaattgcaaacaaatacgaatccaacaaatttattaggaaagtaaagggttacattacgctgtgtatatttctgcacccttgcaaacttgaaacatactgagctgttttgggagatagtatcatcctcctgggctggaatgcatagtggttctgcccaatctaaatccttttgaaagggtagaatatgattccaaattggctttcctcctttacaaaaggtcacttgaagaaaattattgatttgcaagggcgctacctggtattcatattgtttttcaattacaaagcctgtgtacaaagtactttgttttttgtattgttcgtactcctgcttcaagttctgtaacttgtcacctttaagaacatttaagaagaactctgtctggaaattttggtcttcgaacttacacacatcatgtccaggaaatgaactttttccttgaacgaaagtgctcttaaataaggtgtacgttataaaaaagaagaaaaattctaaaaagttgtacattcatccgaggagcactttggatattataatctatttttagttttgttgctttgtattgagctgtataaaaatcattagatccacattactaattattgaatatggacaataatatcaaatatattattatcaaattgattattttgtgacgcggcgtcaaattttaatcgcgtctgacgaatgagcgggtaataaactgtctttttttcatgaatgaatcgagctggcattaggaacatgtcgtgtaagatttgggagtaaataacagaaagctgcaataaatggtagcttgtaatggtgaattaagacacccaatcgaaacaattatacggacacgatgaagttggatataaaggtatgttaccagagcgcgttttgccaatgcaattgcgaacaagctccgacaactcctatgattaggaaatgatctcgttcgcgaagaatacaaagcctgcaaaaagcaaacattaagattagttactaacaggaagatttttgaaataaatgcatttgctcttggcatttcctttatttgacactgtacatttatgatagaaaacttttagtaatagatccgatcgagttaaaggtatcgatttccatcctactgagccatgggttttgactaccttgtactctggtcgtgttgagctttggaattacgaaacacaagttgaagttagatccatccaagttacggaaactcctgttagagcaggtaaattcattgcaagaaagaattggataattgttgggagtgatgatttcaggatcagagtcttcaactacaatacaggtgaaaaagttgttgatttcgaagctcatccagactatatccgttccattgctgtacatccaacaaagccttatgttttatccggcagtgatgatttgacagtcaaactatggaattgggaaaataactgggccttagaacaaacttttgaaggtcacgaacactttgtcatgtgcgtcgcattcaatccaaaggatcctagtacgtttgcatctgggtgtttggaccgaaccgttaaagtttggtcattgggacaatcgacaccaaatttcacgttaaccacaggacaagaaagaggtgtgaattatgttgattattacccgctacctgacaagccttatatgattactgcgtcggacgacttaaccatcaaaatttgggattaccaaacgaagtcatgtgtagccactctagaaggtcacatgtccaatgtttcttttgctgttttccatccaactttacccattataatttctggttccgaagatggcactttaaagatatggaattcttccacttacaaggtagaaaagactttaaacgttggtttagaaagaagttggtgtatcgctacccatccaacaggacgtaaaaactacattgcatccgggtttgataatgggtttaccgtactttccttgggaaatgatgaaccaactttatcacttgaccctgtcggtaagctagtatggtcaggtggcaaaaatgccgcagcttcagacattttcactgccgtcataagaggtaacgaagaagttgaacaagatgaaccattatctttacaaactaaggagctgggttccgttgatgttttccctcaatctttagcccattctccaaatggtaggtttgttacagttgttggggatggtgaatacgttatttatacggcgttggcttggagaaacaaagccttcggtaaatgtcaagactttgtttggggccccgactccaatagttatgctttaattgatgaaactgggcaaattaaatactacaaaaactttaaagaagtcacatcatggtctgtcccaatgcattctgctattgatagattattttcaggtgccttgttgggtgtgaagtctgatggcttcgtctatttcttcgattgggacaacggtacgctagttagaagaattgatgttaatgctaaggatgtcatttggtccgataacggtgagctggtgatgattgtcaacaccaatagtaatggtgatgaagcaagtggttacacattattattcaacaaggatgcttaccttgaagcagcaaataatggcaatatcgacgattcagaaggtgttgatgaggcttttgacgtattgtatgaactaagtgaatccattacatcaggcaaatgggttggtgatgtctttatctttaccacagcaactaacaggctgaactacttcgtaggtggaaagacttataatttagcccattacacaaaggaaatgtatctattgggctatctagcacgtgataataaagtatatttagctgacagagaggtccatgtttatggttacgaaatatctctagaggtgctggagttccaaacattgactttaagaggggaaattgaagaagccattgaaaatgtactcccaaatgttgagggtaaggactctttaacaaaaattgctagatttctggaaggtcaagagtattatgaagaagcactgaatatttcccctgatcaagatcaaaaatttgagctagccttaaaagtcggccaacttacgcttgctcgcgatttgttgacagatgaaagcgccgaaatgaaatggagagccttgggtgatgcttccttacaaaggttcaattttaaacttgctgttgaagctttcacaaatgcacatgatctagaatctttatttctattgcactcatcttttaataacaaggaggggttggtcactttagctaaagatgctgaaagggccggtaaattcaatttggcttttaatgcatattggatcgctggcgatatacaaggcgctaaagatcttttaatcaagtctcaaaggttttccgaagccgctttccttggatcaacatacggtttaggagatgatgcagtcaacgatattgttacaaaatggaaggaaaatttgatactcaacggtaagaatactgtatcagaaagagtttgtggggccgaaggtttaccaggctcttcgagttcaggagatgcccaaccactcattgacttagattccactccagccccagaacaagctgacgaaaacaaagaagctgaagttgaggacagcgagtttaaagaatccaactcagaggcagttgaagccgaaaaaaaagaagaggaagctccccagcaacaacaatcagaacaacagccggagcaaggagaggcagtgccggagcctgtggaagaagagagttaaccacctcatagaaagacaaataaagaactaatcaacgaatgagaaaacatctttaatggatggtaaacatatatatatacagatgtacactttttatttttattgcgataggtgtgaaaatgaacgtgacttgaaactttgcgcgcaaacaaatcatattatgaattactaaacacgtccagtttatctacatttcttttcttctttaatccgatataataggtctcctttgattcgtctctagaagcgtcaggcttgaacttatgaacgttagtgaaaactgcctgcattctttttttaaataggttttcttcttcgccggtgtatagtttacaaacaaacgaacctaatggccgtaataaatctatagccgtaactaaggctgcgtcacataaatcaatagattggtaatggtctcttatactgacaccagatgtattagccatcctaaaataagcttgattagtaatgttgttccaaaaaccggttgtttggggccagggttcatacatatcacttataatcacatcaactgggaatttttctcgttctattagggtactattcgtattcggagtttcataaatgtcatcagaggtgaaaatttcacggtacaattcagtatctttcacatgggttagctcctcctcgagcatgttctggaaatagccatggtccttatgcaaatcatcgtgtctgttcaattggaaatgcttagaaaaaaagagccgtataagatcatgagttcttttggccaatatattagcttgaatagagttcacaccatgcggaggttcacaagggagaatgtcaacgcccagtatcattgaattaggtgaacttctttgccgtgctacttgggaccaagccccaggggcatacccaagatctagaattctctgatcggtcctgtttttgctaaaaagccgatatttatcatcaatctgcataagcttgaatgcggctctagacctcagattttggaccttggcctcttttgtgtagggatccttcagttgtctattcagccatctgttttgtgagttagaattataccgtacatgtattcgacctaaagaagacgatattatactcctgatacgattgtacactaaaatcatgctgtaattttcccgtcagtatgtgtagtcattacttcaaacctcggataagcccatcttgatggctacgacttccatctatatcagaggctgacatttttctctcattgacggagacgccctttaaccggacctgatcatttttaaaagaacgccagtaaaagagatcttacaaataccagagaaacggtattgaaccttcttctttgattagaacaaattacttgatcttcttttttaaaaaagaactgaaaaatcaaaaacgatacatgaagatggtatgtaagttagctaaataacttgcttaatttcaagaaaggggactgtaaaaaattcagtttactctaccattatctccattaacatatcaacttttagatcgcaatgaagaagactgcgttcataaaccttacctcataaggccaaacagctatcagcttttggcaaaagttgaatacggacatttttgaacccatacatctttcaatatgcacgggtgcaacctcaaatatttaaagtttttttttcctgaaacttttttttcgcacacaataatgccatagacatcttttggcctcagattggaaagtccgaggaagaaagacgcaatcaatgggaagagtgttgtatttggattaagatatgtaagtacatcttcgcagcacttcttgagcattacgttatttggtaacctcttgaagtttcaggaaagactccatagaactagtcgcaagcctcacggaccaccaaatactttggaagactaattacatatcataaaatgtctaagatcacctcttctcaagtcagagaacacgtcaaggaattgttgaagtattccaacgaaaccaagaagagaaacttcttggaaaccgtcgaactacaagtcggtttgaagaactatgaccctcaaagagacaagcgtttctctggttctttgaagttgccaaactgtccaagaccaaacatgtccatctgtatcttcggtgatgctttcgatgttgacagagctaagtcttgcggtgttgacgctatgtccgtcgatgacttgaagaagttgaacaagaacaagaagttaatcaagaagttgtctaagaagtacaacgctttcattgcttccgaagttttgatcaagcaagttccaagactattgggtcctcaattgtccaaggctggtaagttcccaaccccagtttctcacaacgatgacttgtacggtaaggtcactgatgtcagatctaccatcaagttccaattgaagaaggtcttgtgtttggctgttgccgttggtaacgttgaaatggaagaagacgttttggttaaccaaatcttgatgtctgttaacttctttgtttctttgttgaagaagaactggcaaaatgttggttccttggttgttaagtcctccatgggtccagctttcagattgtactaatcacttccgagcgattaatacatatctccatctttttaaataccttttttaatacgtatgactctaagtagtaaaagtattatgcatagttttagccagatatttttgggcccggaatatatcttttcgggaagctcggagtatattgcaccgatccgattcttactccatatcatgccatttttctttcctttctcagcgatgttttgtaggaaatcacttagaacttgccttactttaaaagcatgttgagtgaatttcacagatcgatatgctttggtgttcaatcagttcaaccatacctgctattatataatcttcgactcgcataatataggtattccatgcgcaaatagattacttgcaaaatggacatgactaaaaaccacaccactgacacagaggagtttgatgatggtgatatacgtccagtcagtttgggaattgtggacgattataacgcttcgttcgaattacctttgaaaccaaagtttttacagagtgagaatttctcagatttaacaagtgaatgggaccagtctagatcaaatacgcctggtcttgcagaaggcaagactgagaaagcacagccatgcggtacaacagatagttcaaaaaatagaatacatgtagagcaactgttggaatccgctaatgaaatgaataattatttggcgcagaatatagagaacataaacaattttcaggtggggctattgaatggagggaaaggattatatagttccatgggtgatgattcgagcgcgtgtattaatggcactaattttagctcaacgtccaattttgaactaagtgatgatgagctagaggataccacgggttgcacaagttctatttttgataaagatcttttccatcaacaaaacgggctaagcatacctcgccgtagatcaccactcttcaaatctccaactgccagtttcgaaattggcgatgctacggatgtggaggagcaagatattgatgactccattttttctgaatgtagcagcattacaagctttgatatgggagggttgcatatcagtctaccacacgatgaagaagaagatcaagaaaaaactaagtccgaaagtgaaaacccgttgctacatggcataccggttgatgtagaagtgccccacatatcggttgatgaagctctggcgaatttcaaggaaaccatagaactactactaaaacttagtggcaatagaaagtgtaccggtttcaatactagagtggagaaaaaagaatactcgaatttctacatgaaaagtaaacccaccttatcatcagcagattttctcaagagaatccaagacaaatgtgagtaccagccaactgtttaccttgtggcaacatttttaattgacacgttgtttttaacaagggatggcaataacattttgcagttgaagttaaacttacaggaaaaggaggtccatcgaatgataatagcagcggttagattgagcacgaaattattggaagatttcgttcactcacatgaatattttagtaaagtatgcggtatttcgaaacggcttttgactaaattagaagtcagtctattgatctgtgtgtgcaatactaaattaatggtcagtaacaggaaattagccgcctccaaattacttttgaatgaactacggtccttctgtgtatagttgatacaagtattttagataattattttaacgaacgtaacgaatgctttccagtcaatagcggcactggtaatatgatacaaacaatttctcaataaaacaacgacaaacttagtctgtttatatttccgtgcaatggtggaaacctgtactcgatattggagaaaacttcagagcttcccaacagttatcccggattcttaattgatgctctcgaaacgcacataaaaatgtgatttttttactcgcattaaattactgttgaatctatggttcaaacaaatgtatatttgcctacacatctttctctgtcccttctgtattgtctaaccttaaaatagaaatatttcatggttttatttcttttaagtttattatccatttttaacgtggtgagaaaacccgaaatgaaaaataataaaggaaaattatagaggaaaaaaagtgtagaaatagaaaaaaaataaaaaggataataccgatcagaaaaatcctctttcttgctcttcttcttttctttgtatttctcctgaaaaaattcagaaaaacatatattgggttaaatacataactatttaaaaggctgtaaacaattcaactgacattagatacatcacactcaattactgttggaaataggcagatatatccagatttttacaattactatagcacttccattgaagatatataaaaaaagaaaataacaataggaggaagtaaagaaagccgttaataaacaatggtgttatataaaaggaaacctatattacttcctgatccaaaacctttaccattggatttgaatgtacaagtatggcatattgaagagactggagaatggttttctagttacgaagaatttttagaaaggtttgatttctacacacgccaccattttacatgcgaaatcactggtacttcttgcctgacttttttccaagctctggatagtgaggagacacaattcaaatacgtcgaagacagattcccattaaagttgagagaaccagttgcaagatttttacattttaacggaataagaaggttagatgcattggtggagaaagtttacgcaagatttaaaaatgactttttcccaggagaagttgtttatctacgtaaacagaaagactcttctaccacaagctctaattcccaacaaagtactcctcaacctgatgatatggtcgaaatcaacagtgttggtaatcctggcttaccgcagtaccaataccaaagacgttatgttatcaaagaaaaggtccaatttaacgcaacgataaatccagagagcagggaaattgtgatgcccgctcatactaaatacatgctgatagaagaagcagcttccagtaataaatccttcattgttgatcaaggacaaatttacagggaccgttccactttcactaagcacttaatcaaatgttttttcaagattactttacagagggcatcttcgaaaatgggtgcaccttggtgtgtcaaaccggaatatttagcgatgtatggtttaacgatggaatggccaaaagatatgttaaaatataaagaagatgaacctgtcgtagcaagacgttccaacagtgccaatgtttcatccccagaaagtgaaaagaataaacgtcaaagtaaatcatcgggtaaaagtaacacctcaaacgatgcttctaacaaaaaagaaaccaagaaaaaaagaaagccaaccgaagtaaatgattctgagaataattcttcggaagaagacaagaagaagggtcaaaatgtcacatcagaaacacattctaaaaaaaggaaaaaggaagccaatgaggaaccgaacacggaaaacgtcgaaagcgttcctacaccagctaatgcggagcctcaggctgtaacaataacgagcataatggatgacctagctttgccatatcaacatccaccgaacatctttccaaacttaacgtattataatgaaaaattagaatgtatttcattaggttctacaaaactttccagaccttttgattcttttggaaagctattacaagcctatcagtttctgaatacgtttggttcgaaaatttgtctctctcattttagccttgaccaattcattacttctttgaaatgtacagacccatatgagttaaagggcgaagttgttttagtgaacataagaacgcaaacgtctaaagaacaagaaattgaaaataacggcctgccgatgaaaaacaaagcagagactactactgaggaagactctgaaaacccaagtgactggcaaagaaattcatttattcgtgatatgataatgaaaagaaattccgacaaggttgagtacaagattgttcacgatgacccagcatccgatgatatacttgataatatcaatcataatgggtctgctcttctcattgaagtttttactgcgctcttacgtttgttcatcaacgaagaaggcgattggagttgcatcgtcgttgaaaactggataatagacgacaagggagtccttatggagagaaaagatgaaagaggggagggggaggcgaagcaaaaacgaaatgctcacggatactttttacaagataaggaaaagatcgacaacctaaaggacacattaaaggaaaacgcaacagaagttcaaaaagaatcagacgctaaaaacgaaacaaattcagaatctgattctaaatctgattctgacagtgaagaacgagatcctaaattagaaaagtgtttgaactaccgcaatgttaactggatagaacgcttgacgaaaaggcaatttaataacagttactggctaataattttactgggagtcttagaagattgtagacatcttcccatgtatacagagtttattgattctttcatagaaaagatcatacccaaagatatatcagctactcaattgcccaaacagctttggagaaatttctgtcgaaagctgtcgttcagtgacaaagtcaatgcgctgtggatacttgtagatctcgtatcgcatttttctccagatatcaaagctgctgtagatgattccatggaactatgtggtcaaattcgtagcgaaagattcaaagttgcgagagagttgaaaacggaggcagccgtcttaagtaatcttcaaggcgacctgcaggcaattcaagagaagttaaataaaacagatgaaaacacaccatcagccgatggtgccgataaaaaagatgattccgaatcaaatagtgaaccaattgatcttattatcattgagaaaaagcaaaagttaattgaagagcaggataaaaaggtacaagctttacaatcagataaaaatttcctcgataattgtctatttgaaaacgatctacaaagattaaagccgttgggattggatcgatacgggaacaggtatttttggctggatcacaatggtgttccatttcctcaatatcctgctggtatgaatgagacgccgaaaagtaacaatagtttgagttatcactccggtcgtttattaattcagggacctaaagcatcatcggcgaaattctttttgaacgtcagtgatgagcaattgagcaattggcaaaaaatcagaaattccgaaggaatatccgaggcaactagggaagtatttggtatctccaaaactagttccggatcttataattacgtagaaaatggaatagaggtcgaactattggacagtaatgatcgcgtaaacccacttatagagctgacacctattcaaaagaaaattatggatgaaacaccttcaaggttgctactatcaccagatcaatggtattgcattgacaagttagaggacttgtcaagaataatggactggttagataattggggtcgcaaagagcatgatctcttgaggcaaatcagacccataatggaacgaattaaaagttcccttagcttgcgcgaccatgcgctgtcactgacagcattcaccaaaaatgaagaaaagttgctaaaggagttagaaaataatgaatttaccgaaaacgaattgaacgttgatagtatggatgttgatgataaaaatagcggtgttaaaagtgaggttgatgtacaggttgatgccgaagagaagagagaagctgtgatagacgaaaagttggaggtgattgcagacgaactcatgaagctagatgatagctcgaaaacacgcaatgttcttaatagaatacaagaattagaagatcagagagatgaactcttggaacagaaaaaatccataataaattcgcagaggccaggcgcgaggattttagcccgttcagaaaggaaaagaaccaaaatctcccgtggtaataaggtgaataagcagattgaaatattgactgacttagtcaattatagacattttaaagctatggaagatgtgatagcttggaaaaacgttttagcaaattcgatatggggttcctcacttcgcaaaaatgcatctggtaataaaaggagtggtgtcattgaaacagtagacgataaattaaaagatatagtgggccaaacctcaagaacagtaacacctgccccaaattaatatataaaaaacttcctttgtaactgatggtaaattgtagtattcataaataggataagattattcattgtaagcataatggaaaaaaataacacaacaaagccgcgcaagattggaccatactttctatctaaggtaactatcacttactggcttgatggatgcgtatttttgtcggtaccagcttctgaaatatcgatatcaaacatagctggctcaattccttccatcaattgctgggtaatttcgactggtaaaccgttatcgttagagatattagcagatgcgctatcaaaatcgagttcttgggcacctgatctcaaattgcaagaatggcaaataatatcttcataccagtataaacttttgtttgtaccacaatgtgggcaagtcctttcgaaaggaagtacgtaaattttgggtttaatagcagagtcgtgtgagtttcctggcatttcgccgtgtcgcagtctaagctgttcaaaatatctcaactccactagactatggtcagattcgcacttataatatctgcagtattgttctatgtatgacagagtatgttgaggcttgtacgataatggataaagttcgtttccttctaagctgatatcgtgtctatcgcatattagtataggtctcaaagtgtatgtatcgttaagcttgacatcctttatgcacggtagagtggtgtctacagacatatttttcttttcaaacataagcttaaaattggagctgttctgtgcacatgtaatatgatacctatattggcatttgttacacttcactaacccacctccatttatcctgcacacaccacatgtaaatctactatgtttaataagcacagcagtggtattaagggcaggttgcattgattgtccgtttccatatttgatatcttcattgaaaagtgagcaaaccaaatgcacccatgtccctaagctcgtgcatttcaatgcgtctggacatattttaaatgattggctcctatatctatcatagtcatagtccttcgtaggacacatactacattggtaggtcgttgatattataggattgaggtcatttgaacaagggtcacataaccatttaaatgtcttaaggttagtgtttttcttcatatctttcggcagtttaatagcataacagaagtagtgtactgtaagtccacaattaccacatactacctcatagttgtcattgtcgttaaatttttctttgcagacactacaaaaagtccttgcgctattatttgcccatgctgtatcaggattttttggtttattcttagtgtgtttcaaaatcatgtctttctctaacattttgctcggtttattaccatcatggtatttttcaagggcgacagaagtttccttagaatgtgaaataactgtataattgtacgatgccccgtttggttcgtttaacggattacttaacgctatgtcattgatcattttgatcttcttcgttgaaggttcattatattttggcagcttattattcactaactttaagctattccgtaatcgctgaaatgttttgttatcaaatttgacaaatttaaaacctttatctacagacactgaaccagaagaactgccgcctgttttaattgaaatttctatcaaatcattcgaagcattagtgattttaggaatattgttattactagccttctcgataaatacatcgttgcacttgcgatttcggcttgtatcacttgttttgatagtaccaggtgattgtcgaattatgttcacgggaaattcgtcctttgtgtttttcgctctttctggcttttgttcagggatggcttttcttacctctttgttgtcctctataaatagctcaagatctcgttgcatcgtctccgggtgaaactcattctttcgatatgatctcacagccattttgtagagttgcgtgtggaatgtcatggaataccgcttcattttcacaaatgaatttgggttcttgtaaactttcattctttgcctgataattagctctgaatcctgaacaagttcccattctagtagtttattatgagcttgaaagggagataacgtaaacttgtttgtgttattctcctctataatcccttctatcgctgaataaaaactattctgacaggttcccgttatttttctcaatgtttcaagcggtggtacccacttaattgcgtatcttcgccacatacgagcacaacgaatgcaaagagcgccaagtttttcattctttttgctatgggcaggcgatttctctgaaatttctgttttttcgttgactcctgtctgcattcttatcttgatcttttcatcatctgaacctccagtaactctataccacatcggggagtaatctgttttacaaaacatgcattggaaggaggattctgctaaagagagtttctcagtatcaaaagaagaatcatctatatactttgtctctacgtcattttcatgattagcgatttctttttttcttttattctttgataacttactcaatttccctctcacggtaaggcctctttcagtctttttccaattgtaataaaatctaacaatcatcgacataggttgagtgcccacatactcacacactgggcgtaattcactcccaaatttctcgacagcttcctcaaactttcggatctccacggcggtaaaacttggctctttcaaaaattttctggaaagctcccttttacattttttaaatgcctctgctgtatcataatttgtaaataataaattctttaggactacatcaatgaaattacaagtctcacctctcacattgagaatagggcatatttcgcttttgcattgttcaatatattcactcaattttcgagtagtaatttttgatgcatcaagtacccatgctagttccgaagttttcgttgagcctcgctcttcttctgaatttgcacttatatacgagttccgcctccagggcacattatgattacatccgttccattgatacttcactcctaccctagagggtttgaaaggatatggaaaaaacatagaatcatttaatgcgtcaccaatatgagaaatggaatatattcctaagtattgaaaccagcaattttcggtattataaccaacattctctttgatagctttgctagaaatttcttcaattttttgtcttacagagcgaataaaatccagttccagtgcttgttcttctagaaacctaacatgcgagtccttagtaccttgttgtttctgtaagcaactgaagcaggtccaaacgacgtctttgttcggcttcctgtcaagtggcggatccatacagtatagatgtgcacaaacgccgcattcatcacatgaaaggctctccttttggatacaccattctttacagaactgacatcttttatcccattggtagtctgcaggacttaattcgtttacctctagttcatggaaaacgtatttcttcaaaacgttctccaatggatacttcggttctgtatagatataacgaaatctcctattcaaaacataaagaaatggcgacttactgttccatttatttaatattttatccgtgctgtaaactttgtaatatttcaaagtatatctgtcaaaaagttcatcaaagtaaaagatattgggtcgtataatgcattccttctcattaggaagaacatcaaaaacttcgtctttatgaaatatactacattttcccctgtatgatgaaataggacatatgtcctggtgtaatgatgcatacaccaaccttgggttaaaagtatttacgtgctcttgaatatccctaggacgataaaaccaattcattctaacttgaaaaaatttagcagggaagaccgatgttgtctttatagcttcatgaatagtgttagaaaattctggtttactaacaaaatttacaactctgccaacataataaggctcgccagcaggctctgatatcatataaatagtgtcgttcgcagataaaaggacagattctgtattgaaaagagacatctttttcaagtcaatcatggcatcatctagatcaagtatgttagagaatctgctattctttctgaacgaagggggtaatgtagggataaagttccagcaagtattcttatcatgaaggaatttttggtacttgaatttctcgtttctactagctggattgcttgtccttttacaattcctgggagtttggctattgctacccttggtcttagcaccacttttttccgctatttgtatttgttgaactaatttagtatctatttccatttcattataattcacgtttttagcagcctctcttcttctaggtaattggaaatcttcttctttaggcatagcgtgaccagctgaaaggcagatgatctcaatatgtcccgataggccaattttgccaccagatagttcgatggcattttatttttagtccttttgaaagcaatatcataaaatatatatagttctccatgatgttcgggtcagtcgctccgaagcgtaacctagtataataaatagttcattgcagaaaataacgaaagaaatggtggaatacgatctgttatatctaaactaaagctaactaacggaataagcaaatacgaatcgaccgctaatttaacaaatatggttttagcaatggaaagtagagtggcaccggaaattcctgggctcattcaacctgggaatgtcacgcaagacttgaagatgatggtctgtaaattattgaattccccaaaacctacgaaaacattccctggttcccagcctgtgtcctttcagcattctgatgtggaagagaagctgcttgcgcatgattactacgtttgtgagaaaacagatggtctgcgggtgttgatgtttatagtgataaatcctgtgacgggtgagcaaggatgctttatgattgatagggaaaataactattatctggttaatggatttaggtttcccagattaccccaaaagaagaaagaagagctgctagagactcttcaagatggcaccttattagatggtgaacttgtcatacaaactaacccaatgacaaaattacaagagttgcgttatttaatgttcgattgtcttgctatcaatggtagatgtctcacacaatcaccaacaagttctagactagcccaccttggaaaagaattttttaaaccatacttcgatttaagagcagcgtaccctaatcgttgtactacttttccgttcaaaatttccatgaaacatatggatttcagttaccaattagtaaaagttgctaaaagtttagataaactaccacatctttctgatggtctgatatttactcctgtgaaggcaccttacactgccggcggaaaagattcattgttattaaaatggaagccagaacaagaaaacaccgtggacttcaaattgattttagatatcccaatggtggaggatccttctttgcctaaagatgatcggaacaggtggtattacaattatgacgttaagccagttttcagcttatatgtctggcaaggcggagctgatgtcaattcacgtttaaaacatttcgaccagcctttcgataggaaggaatttgaaatattagaaagaacatacagaaaatttgcagagttgagcgtttcagatgaggaatggcaaaatttgaagaacctagaacagccattaaatggtagaatagtagagtgcgcaaaaaaccaagagactggggcgtgggaaatgttaagattcagggatgataagttaaatggtaatcatacatcggtggtccagaaagttttggagagtatcaacgattcagtttcattggaggacctcgaggaaattgttggtgatattaaaaggtgctgggacgagagaagagcaaatatggctggtggtagtgggagaccactaccgtctcaaagtcaaaatgcgacattatctacctctaagccagtccattcacagcccccaagtaatgataaggagccaaaatatgtagacgaggatgattggtcggattaggctaagaagtgttcgtatcgacatatatcggtgtaagaattttgtgtatgaataagatagaaaagcaaaagcaattgcttttgctaaattaattcagttagttatctatttatatgtacatgagaaatgggagaattttgagaagcgagggtgaaagtgttatatacgcatatacatgtatatatatgcgcatgcttatcacctatgggaaaggactaaacttttcaataattctcttgggttaccgttaccacttaggaaatatttttcgtcaatcaagttctcccacttttttcctgtgatatccttgtctaataaaacatttgattgtttgtagtaatcgattagttcgttaacttcctgtttgttcagtttaggaacctcgaattcggtgacattacctttttggagcaattctacgaacttcggttcatagtgatatctagtaacataggggtctactgggatcttgcccaatgccacgggtaaagttttgtttgtcctgtcaacgccggatatagctaatatagtagaactctcaccattagcaaatttcgtctctcctgaaataatgtccatcatcaatttacccatttgtaaatccagggaatatatttgtttattctctgtatttctgtacgcagaatatgcagtagttaacacttttgaaaaattatccactgtaaacatgattggcaccttggattggacagataactcatcaataatggctttcattagttttccacgattatgcgggtgggtcattacggataacaaatctaaaactgtatttttcgttttgtttaatgtgacaaatggttttacagaggcattctttgggtttgcattcgagaacttgtagtctttggatagctcaatagattttaacaatgcagggtcatttgccttcaatattttccttataagctttttcaaatacatcggttggatgaaaagctttaaatcatcatcataagaaaagtcattcctaccgttcaggaataattcaggatatgatatgttaataatgatttgcttggaatcaactgcatatgcatgcgcttgagagagtagtacagttttcccgacccctggctctccagtgattataaattttttaacaggatgagatactagtttcttcaaaaagctattcgttgcatcttcacgaactagacaaaccggtttttgaaaaagttcattgaactgcgacttcttgaaggaacccaaatggtgaagggatttgtactgtttgttggaatatgatactactttattcaaagtcttggaaatatcatcaaagttgaagataggtaatgccaaaggaacggcggtctgttgtaattgagcggtgtgcgtggtgtttgtccagtttttatacaatgaaccaggagtaactctctttgcagatgagtaagatgagactgaagatgattttttggaaaatccttgagttttaccttttggtgccggtttagcagcctggagagatcgtgccgtagtgaacagcctttgcccaatgaatcttgaagttgacatacgtagcattattctgatacgtataaccacgtggcttgtacttgttctcttgttaatgttttccctcgaagtatagaagttgatgtatatatacaatatacatatatatatattcttgtacatagtacttgctgagtttccttttctttttcttccgttttgtaagaaagccccggaaaatatagtgttccataggataaagaaaaacaggcatacatatgtgcaagctagtcgagtaggataggttcattagagaccagtcttgcaatatcgtcattcagttccgtctccaaattaaaatcagagtagtaatgtagcgggatcaagggcgaaatatccttgaccgtgggtatgaggttcccacttgaccagtttcggaatacgtgctgcgctgtgatgggagtatcgaatacagtatatatgatgattgaatcatccttcgagtagttgtttctttcagagaagtagatgtcgtagatttcattagcacttagcgtgatgaatacttgattgcgcaaatgagataagcagtttgatttattatttgattgcaggaagttgtcaaggacaattctcaaagtagagcaatcgtaatacggatgttgcgaagcattttcttggtcttgtgtgttgagatgtttccagtcaccatagggcaagttgaaatgttttagtttcctgagtagctcgccgtggcgttggatttgcaataaatcaggatgtggtgtggtggtgggtatcgtactcgattcagattcttccagcttttgtataagtttatttctttcaatgtcgtttgttttccgtaggaactcaattaaccagcggtcgtaatggggtctcacgtctgcattggtgaggatattagttgcggtcgataataagtggaatttgtgtataattgatggattgtccgggtgtttgtcaggatgatacttcagggcaagggtcctgtatttgcgtttaatttggggcaaatcatcgtagatggtatggacgtccaggggggtcggtaattctaatacatcatataggttcaaacgttgatttattacgtcttccaattcgtgtcctggcatagtcgtggcgaggcttgtagtacggcgatggacttgctttttgattttgctttcatcttctaatgtcttgcgagataatatgcaaggaaaacaaaggaaagaaaatacaaagtaatgcggcttgcatatatatatacatatatatatgtatatatgtgatatatatatgtgtgtgtgtgtatatatattcatgagtgtataaaatagatatatgaatgcgtgcgaatgtagttataattaggtgtgttcagttggcccatctttctaccatttcattcatccattgcgggccttgtaattgaatgatcttgggcagctcgtctagcccttccagcaggccatcttcattaacgatcgccgactccatgaacccgttcaacagctttaaaatgaagagacagtttggatacacaatgcattgcgaataaggggggttgcaccagtactccaggtatttcaagtagtttttgaagttaggagacttccagatctgctgttgagtgagtaagtacgttacgtattggatgtttgccagtgactggataaattcgagctccacttcgaacctcgtggggagaggattttgatccgaggaaggtgtcgctggtgcgtttccattagtgcttgacatcctgggtggagcttgggggaactttgccgtcttatgagtgctataagttttggcttactttgcctcatttttcctgcatttctttttctttttcatcctttaagaacacgttagcgggaaaaccgtgaaataaaatacaaaacgaactgttcgaaaaaagccaaaggggaaacgcctaaaactccactgaaaccagctataaagcacggcatattacaacaatgtctagcaaatggtttaatgctatacacctactggtgtgcccgttgacggtactggtaggatatctcatgaacgcgtatggctacggtgcggcgctgcaagcaaccctgaataaggatggtctggtaaatgctatgttggtaaagaaagggtggttttggacttccttggtcggatggtggtgtattatacgctaccgtgcggtgccgggggcaaccggcagagaccgaagacacattgtccagtcattcaaaaggtatgccatactgacagtgtggtggtacgtattcacgcaaggtatatggtttggcgtaggccccatcatggacttggtattcgtatatacgggtggccattgtcactatgacgtcttcgatgatgcaggtcacgtgaacgaagacttccagggttctgtcacccggactaatcgcgcgttggcgctcattcacaatgtcctcactttgcacggacaccaccaagaacaccgtcagcaacaactctgggaccgctccatagggtcgatccagggcgccctgcaggcgacgcaaccgaaaaccccaaaaaacgtaacggccagcgctgccgctgccatcaatacttttattcatgaccagatgcacaggtggcaaggtccgttaaccacctcggcacagtgcagacgttttggaggccattgggctggaggacacgatccatccgggcacgtgttcttggccaccttgatgtgcatgtttcttctaggtgagctacgtgtgtttgggcgtcgtgcactggctcacttgtacgcgcagaaatggcagcttgtacgattggtgacccgccttttcgacactggaccgctatggacgtggcggcggtgtggcggcggctcaatgacctgtggcgcccgtttgtggcgtgcgatagtcgagccgcctgtcacgtgcgcggccgccctgctccgtttgacgcgatgcatagcatgcgaccacccagtaatcatactgctgacgctattggtcacgtggttatggcagctgctgttgactgcggtggcgtcccgtttccacaccgtacgtgagcacatgtctggattgctagctgcgtacatagtgacaggccttgtctacgctcgcgacgcagccgcgctacgtccagtatgactcaggaaaagttggcgatagaccacgagcgactgaaaaaataacagcgacttttctcccggtagcgggccgtcgtttagtcattctatccctcggattatagactgtgaatattgcatatgcaactttgactcaaatttttccaaaatttgatatatatatatatatatatatgtttgtatgtatatatatatatacgtatatatatcatatatacgaaaagtagaaaaaaaaaggtgatatttcgctcgtggaaaagctaatgccacagcttgtgtttcgtgtagtttgccttgctccccttgattgaaatagtctccctaaactaaagttatcagcaaacagaaccaccacagttactactacaaccacatcgcaatatgaagatcacagaaaaattagagcaacatagacagacctctggcaagcccacttactcattcgagtacttcgtcccgaagactacacaaggtgtacagaacctgtatgaccggatggaccggatgtacgaggcttctttgccccaatttattgacatcacctggaatgcaggcggtggacggttgtcacatctgtccacggacttggttgcgacagcgcagtctgtgcttggtttggaaacgtgcatgcaccttacctgcaccaatatgcccatttcgatgattgacgacgctttagaaaacgcttatcactccggttgccagaacatcctagcgctgagaggagatcctcctagggacgcagaaaactggactcccgttgaaggtggcttccagtatgccaaggacttgattaagtatatcaagtccaagtacggtgaccatttcgctatcggcgttgccggctacccggagtgccatccggagttgcctaacaaagacgtgaagcttgatctcgagtatttgagcagaagatcgaccggcggcgacttcatcatcactcagatgttttacgatgttgataatttactcaactggtgttcccaagttagagctgcgggcatggacgtgcccattattcccgggatcatgccgatcactacctacgcggccttcttgagaaggatccaatggggccaaatctccatccctcaacatttctcgtcccgattggatcctatcaaggacgatgacgagttggtccgtgatatcggaactaacttgatcgtggaaatgtgtcaaaaattgctcgacagtggttacgtttctcacttgcacatctacaccatgaacttggaaaaagcgcctctcatgattctggaaagattgaacattctacctacggaatcagagttcaatgcacatccattggccgtgttgccatggagaaaatctttgaatccaaagcgtaaaaacgaggaagtcagacctatcttctggaagagaagaccttactcctatgtcgcaagaacctctcaatgggccgtggacgaattccccaacggtagattcggtgattcgtcttctcctgcgttcggtgacttggatctgtgtggttcagacttgatcaggcaatcagcgaacaaatgtctcgaattatggtccacccctacttccatcaacgacgtcgccttcttggtcatcaactacttgaatggaaacttgaagtgtttaccttggagtgatatccccatcaatgatgaaataaatccaatcaaagcacacttgattgagctgaaccagcattctatcatcactataaactctcaacctcaagtcaacggcattaggtccaatgacaaaattcatggttggggacccaaggatggttacgtttaccagaagcaatatttggaatttatgttgcccaagactaagttgcccaagttgattgacaccttgaaaaacaatgagttcttgacctacttcgccatcgactctcaaggtgacctgctaagtaatcatccagacaactccaagtccaacgctgtgacttggggtattttccccggcagagaaattcttcaacctaccattgtcgagaaaatttcgttcttagcgtggaaggaggagttctatcatatcttgaatgaatggaaactaaacatgaataaatacgataaaccgcatagtgcccaattcattcagtccttgattgacgattactgcttggtcaatattgttgacaatgactacatttctccagatgatcaaatccattccatcctactaagcctataataacacagacaacgataacagttctttaacagaattgtcaaccccccctctttgcattacattcaacattacattgcatttttttttttttattcactattattatggttcttcttttttaccagattttgctccttccttttccattgttttaccattcttttttaactagcatttcaacatgtgtttggttaacaccccttcttttttttcaggaaaatcctttcatttcttctcatactttcaacaaagttttttaaaggtactttaaaatagttcaacaccctcttccttcatttatttattctcttcatattcaacatactcgaaaaggaagaacactaaaagtacttacattttcacatgtatgtatacctatatatatatatatatatactcttatagatatatttacaaattaaaggaaaaaataataaaataacctccctgtcacaagttaaaacacggccccatcacttataaatagtctcgactcgtgtttttgacaccaattagctacttttctcgcactcttgaataaaacccttttgtcaacaatcccattatttccaatcagatacaattcaaaagtgggcgtcacccacgccattcctaccatattaaccgattcttgtttgaatgatgaatttccaataatgtactcatccaattcagaaaaatccatttgtgtttcgtccatcgccaagtcctcattgtctttggaactccatctaacaaaatttaacatagacctacttaacaaattgccattatctctcactaccgtgccatgtaactgttggtagtatgtcttcaatttcaattcatattctagcccctgtgaagaatccagtgcgatgttactgttgacttcgaagtgcggcataacatattgaacgttttgcttcgatttatatatgaaatgatgaaccattggtgctggtatatcgctaagcttgaacccttttgaagtatttatctttttcaatagcttctcttcttcgagtttaataatcaactcgtcactaaacgacttcaatgaaaagaatgcatccttttgtgcacttattaatactagtgccgatttctcattgctgtgagtatcattaggtagaaacttaatataacaataaagaaaaccactcgaattgaacttgggaaaacaaatgggtacccaaagttcctgagtttcgtctaaattttgaaattgatgagatattaggcaaaatagaagatgtaaatctgtagtgtgtaaagtatggcctctgggtcgaagaacacagcacaatttattctgaggcgcaattatcaagccgtacagtaaggtccccctgggaatgtcctgccttttctccagttgctgtaaaaccacattctgcaactttaatcttgaagaatggttaaatggtaagcattgtaaagagttcaatagtaaatccgggaacattctgttacagattagtgaacatatttcgtctaaattttcaaaatctgtgctttctagataatttctcaggtcgaaattttctcttttggaaaataacctaagtaattggcgttcacttaaagacgaaagaatatacgaatataaaaaatccaactgattcaacaattcgttcgaggactcgcctctttccgattgagccattagtaatataggtgatttatccaaaaaagtaagccttttaccagaagttaaagtggatatagttttcaattccgatggtccattgacttggaagtagcttattaccgtattaacgagccctgtatatgacatgatctgttcatctttgccgtgcatgcaatagatcggtttacccgctgacgtgaatatgaagaaatttttgtcacagagagtctggctctcatttaacttgcagttactattgaacttcgaaaacttgaatacattaggaatttcgttacttacgtacggccgtctctgtagttccgatcctcttatagatgtttccatagaatatatgctttcggccaagcgactcctgatgtcattctcgctgtccaaataaggaccgaaatccttttttggacagtttagtgctctcgttgtatcatcattgctctttgccaaatctgctgacaataaattatttttagcttgcaatttttttgtttgcaaaggagatcttctggatgccaaagatgttgtattcaaagaatttacagaggtagatttactaacagaatgatcatcgcatattggcattgctataggcgccttcttgaagaatgtttcatctagattaaccgatgtcgttggttctgaagtcgttgccacgattggaataccctcaaaattcccacttttactatgcttcaattgacccttcggtatctcagcatctaggtagctttcattgagattcatagttccgatgtactgattctacgtttgtgtactttgatagacttttttattcaattcgtattcactactatctttgtctcgtaccgcggtttttatcctttatttcagccctacgagatagaacgatggagcctagtaataccattttatgtaagcaaaataagaagaaagactaaaagaattaggatatgttgttaatcagggataaaggtacgcatactagccttactacgtaaatataaggttacggtttacgatcactattgcaagatactattgtttagcattggcaaagacttgacgggaaatctttgattgggcccaaccatattcattaaagatccgggatgtgagcttgaactgcttttcgacgcgaagaaggtttacacgtattttagtaattggcttattcactaaggattcttaaggttttcttaatagttttctacgtcggcatgcgattgtttggtttagaagactgctttctaaatatggttgggtgtatttaagctagacccatacacccgctctatgggattatttacttgtttgaattttaagatttgtgataatggaactggacgcaaacatttgatggaaaacgcatgtcatcattaacgaggtaacgtaggtatctgtcctgccttagtattgcacgcagcttcccaggacgcctagctattttttcatctattcccctctgtagtaacgtaagagttttcaagtttttaattcagactttctcttcctttgtttccaatttccttccttactgcttgataccttttcaatcccaaagaaaccgtgttctttatatattgtcgattgaaagttacctacatcaactttccgtgttccattccgactataacaaacaaccaataagctcaactaattaagtaatgtctgctccagaagctcaacaacaaaagagaggtggtttcggtggccgtaacagaggccgtccaaacagaagaggaccaagaaacactgaagaaaagggatgggttccagttaccaaactaggtagattagtcaaggctggtaagattaccaccattgaagaaatcttcttgcactctttgccagtcaaggaattccaaatcattgacactttgttgccaggtttgcaagacgaagtcatgaacatcaagccagttcaaaagcaaaccagagccggtcaaagaaccagatttaaggctgttgtcgttgttggtgactctaacggtcacgttggtttgggtatcaagaccgccaaggaagttgctggtgccatcagagctggtatcattattgccaagttgtccgttatcccaatcagaagaggttactggggtaccaacttgggtcaaccacattctttggccaccaagaccactggtaagtgtggttccgtcactgttagattgatcccagccccaagaggttctggtatcgtcgcttctccagctgtcaaaaagttgttgcaattggctggtgttgaagatgtctacacccaatctaacggtaagactagaactttggaaaacaccttgaaggctgctttcgttgctattggtaacacatacggtttcttgactccaaacttgtgggccgaacaaccattgccagtttctccattggacatctactccgatgaagcttctgctcaaaagaagagattctaagcttgttgtctacaaattataaaatagttttttataatcaaccattaaataattttgtacacttataataacactttatttctcgttccaattatgcgatgcatgtgccttccgtttagagtgagcattatcaaatataaagtcaaatccttttggcatttattttgattgaaacccagtctgtccttaactcttttgcctatcaaacgctgtaggtcactcttggtacggtacagcggatagcgctatttattcagcaagagaagcaagattaggcgactacaatagatcaaaattttacaagtaaaacaagtaggaacaatcacttatgcaaatgattaatgctgatatgtttatttacatcacagtgcccttatgatcaggaactgtttaaaaacttttttttttttttttttttttttttaaaatctaaatatgttgcttgaattataaatacaataacgggaaaacatatgatgtgtcatgttcaaaaagctttgaataggtgtcttccatcaaaagggtcacaggaacatgaatttcgttccgtgattttaatagtaatcagttcatttccgtatcttgttcttggtgcgtaaaactggtttgcggaggagcattttcaattattgcgttttctggcaatgcaaatggcctttcattggtaggaacgtttgaattgggtgcagcgcctttcttttccggaagtactctgcctggaggatgtctgaatagacagtaaatattcttacaattgacaccaaatctacaatcttcattaattggatggccaaataaacaatcaattctagtacagtttgctccttcacggcacataatatgagaacgagcatgtctatatttgcaacgtttattggtgcagtgcgtaccgaacttacattgttctaaggacttttcaaccggaggtggagctgctttcttctggcttattggttttacttccttgatcttcgacaatgaagagtgggcctttctacactcaggattatcacatgtcaaattcttgtcacaccacattagatcaatgactttcgcatcttcatttgctggtgttggatgaccaaatgggcatgatggattggaacacagagccccaaatttacacagaacgataccagtttgtaccggtttcctttttgccgccaataaatcagcttttcttttttgaaattcttcacgagttctttccatttccttcatcaactcttcatcttcatttggatgtaaaaactcacaagttccgggaggctttggacaatttggatattcattacataccttagttgggtgtgcatgtgggcatgatctaccaagaggacagtgaggaaacaatctgcaacgcccctctttcttggttggagtgaagttcatattactctcacccgccattccaagtgcttttgctaacggattaaaacgtgtggaattattgttgcgtcctccacggttcccaccgcgaccacctctacgattctttccaacggcgcctccgccacgttgagtgaacctttggctgttatctacaggcgcaaactgagggggagctgcagcgttaacaacgccggaaaaggctgatatgggggatggagttgcaggagcatctgtctgcattgcattctgggtccctagttgtggctgaagtggttgaagttgaggttgctgttgaggttgctgttgaggttgctgttgaggttgctgttgaggttgctgttgaggttgctgttgaggttgctgttgaggttgctgttgaggttgctgttgcgcgatgtctggttgctgttgttgttgttgctgttgttgctgttgtgcgatatccgattgtcccaagctttgcgcattcatcattctaattttggaaacaatattttcagcactttctccctgttgcagagcttctaatgcgaaaaaggctgtttgaacaacatttgcaagcgtatctctcgaaacactatcaaacaaactagccagctcgtctacgacagattcaacagtaccaccgttaacgatcaataagacaatatactccgcaacatacttgatatcttcgttaaagtttggtataccagccagtttttcggcaacgataaccttcaagttttctgtgtactgttcttgagacatttctgatgtacttccacttccttatgatcagagataattagaaaccactatatttagatgttttatggaagtatttggaagaaagatgtgtaaaattttgtatttttcccatttgccaccagcgaagcgaatatcactatttccccgcttcgtattttgtgtaacgatgtacgagaatacaacaatgtttatataattgtatatgaatgttctcttcacattaaactctgtgtataaggtcgcgttgagcaagctagtgatagaaccttctcctaggatacatagaaagagtgtcatcagttcttgttagctcttcttgtaactgtgtgaacaaatcgtcgatgtcccagtccagttctgacattttcattgaaagcacatccctatataaacgtctcgcctggttccttttttctagcaaaagtgctaacaaagatggcagtgttgtggcagtaacttcccttgattcaggctcaattttgtaatgaaccacacgatcggtaagtgtgtgcaactctccgacaacggtgacgaggttttcttgagtattggagaataacaaaacttcccagaaattataagttggttcagccccagccgaggcttcttcctcgatgtcacttagataaaacatgattgctacttaaaagatttcttatcttctctgtagttcaaattagatagtggaaaataagttttcttaatatacagatatatgcggtttaccccaaaactactttgatgggaagccaacatcctcgttgaaattgagtgattaatttcgttgcaagagtaagatgctcgttttaagcatcgttaaaggagtaatttacctttacggtaatctttgccatttttaagggaacttcctcacaccgcggtttgtttctttatttgttcttgtaaaaacacctcgaagggaatataggatgtgctctatatagacatacccaacaaaagaaaaaagcttctttttgatacagggcgctatgattttagtacaagcagctttaggttacgtgtacctatttctagttgaattttctctctatgaaatagtcctataaatttatataaatctatttttttttttttttcgacacaaaatgtctatttcttggagtgcttactcttctttttgtttttaccttgtttcaactcgtttaatctatcaactttttccttgatcctttccaaagataatttgacatcacctttttggaaattgcttaagtcgtagtatgcaggcgctatttcaatcagccattcgggcctgaccgaggtcacagttcttatgtagttcttcgatgtgagcacaaattcattgtaaatgacccattctgcgtcgtggccaagaaccgtactaggatggatcagaacatcttggttatctttaactgtgatgtatcctttagctcccgatcttttttttgctacttgcatgaaaaacccagacgcaagagcctttctgatgttgtcaaagtatttagggctttcatagtctgtagtgtttaattctaggttgtaacggttcattaatctttctaattgggagcggatattatcagcagcggaaagggacctgtaatttagatagtggtcacggcaccacttatggataccatattcataagcttcatccgatttgaacgcatgatatacatttagtaaggtgatatgatcaccgtctggatgagcaaagatattcttggcatcatctgctcgcttcttgtcctttgttgggcgaataaacacgtttggaaccgatagcatggccactatagttagtatttcttgagaacattggaactcaaaggacccaattaacatcaccgctagcataggatccaagggaaactgggatgccaatctacctaggggtgttaagttaccttcgtcgtccagacatgccaaataatttagttcttcaagggctctcatcattgtttccggagccggtggatccataaaatcgaaatggaccaagtcatcaatacctaatttttttagttctagaacggtggaggataaattggaacgtaaaatttctgggtaactttgctctatcagttccttttggaatgcctcttcagtgtataatctgaaacatttaccaggccttgtacgaccagcacgaccagctctttgttgggcagaagccttggagataggggaaacaagtaaagactcaactctaattcttggattgtaaactttttgctttgaaaatcctgggtcaacgacgtagacaataccatcaattgttaaagaagtttcagcgatgttcgtggagataacaactttcctgcctggtctaccattatgtgactctggagcaggctcgaatattctttgttgttgatgcggtggtaatgaaccatacagtgggtatacggataaaggtccgcatccctcttctctaaccaattgatcaccttctaaggaaatctttctgacagcgtcttcaatttcatcttcaccagttaaaaataacaaaatatcgccagcctcttcagtggcatgaatttgcaaaacagtacgaatggcagaatctaaatagtccctttgaaattccggtgtatagtatagctcaactggatatgttctgcccggaacggcaagtaatggagcatcgttgaagtagcgttggaacttctctgcatccagagtagcagacataataattatcttcaaatcaggtctcctcttgactacttgcttcaaaagacccatcaaaatatcagtagctagtgtacgttcgtgcgcttcatccagaatgatacatgaataacgcgacaagtcatggtcttccattgcctctctcaacaacataccatcagtcatatacttcaatatcgttttattagaagttttattttcgaatctgatagaataaccaacttcttcgcccaacttgacatccatttcctcagcaactctctgtgcaacagacattgctgcgacacgacgaggttgagtacatgcaacttgagtgttctctaagtgtggcatctcatcgaataaaacgaattgaggaatttgtgtcgttttaccggaacctgtttcaccaacaaaaaccataatctggttattttgataaagttttaaaaactcatctctctgggcatgtactggcaattctcttctaattttcaggatatcaacatattttggtgtaaactccctaccggtaaatggatttatttttccatcttcaagtttttgggcctcttctgctgaagtatggtgacgttgcaagcccttgaattcaccagcatcatgatggacaagtggctcttcggatggaagaggatgctgtttggataattcttccgcaatctcggcggcctgctcaggaatagaggtctcaactggatccgggtgttcggacgagaatcttcttttggaacccattattattcttgcagtcctaatctttctatgcgcgtttataaggttatactatcgttactcaatcgcatccccgtaaacgtgttaaatattacaattgaataagtttcttttcacctcatctcgcatttgaaaatttttcagaggcaccgaaaaaaaagaaaaagaaataaaaaaggacttgtgtataagatcgctagatcaataaaaagcaatctggtagatttatgggactccgaaatgatactgtcagttgaaacagcaaacgaatacagagcgtaaaactaaacgaccttagtttggaaaatgatgaaatttgtccataactatatactatcagtcagcaaactatgatccgggtaatattcatttgtaaagctttagatctgtaatagtacccagtacttttttagatgatcttaattagttaagatctttctggtactgtactcagtacgcttccttggcatccttattgggacctgttcggctaagatatcgttcgatatggttacaaatatggtgaaattgaggaatttaaggagattgtattgttcatcccgtctcttaagaactatacagaacgggagaatttcttctgtttcttcaatatcgttgagtaagaaatatactacaaaatctgccaaagaaggtgaagaaaacgtagaaaggaagcatgaggaggaaaaaaaggatacattaaaaagttccagtgtaccaacttcacgaatatcgagattgttccattatggctcactggcagcaggggtgggcatgaatgccgcagcaaaaggcatatcggaagttgcaaagggcaattctcccacttggaaatctttgattctatcagattcgaatattgacagaattaccaataaattttctaaaatgagaggtgttgcccttaaaatagggcaactattgtcttttcaggatgagaaagtgttgccaaaggaattatacgaaattttatcaagggtacagaatagtgcaaatcatatgcctcaaaggcaattggaaaaggttatggccaaggaattaggtgctaattggaagacaaagttttccaaatttgacaagatacctatggcagctgctagtatcggacaggtacatgcggcagagttgcccagtggtcaaagagtggttgtcaaaattcaatatcctggggttaaagaatccattgattcggatttgaatagtttactaatgttacttacagcctcaagtttattaccgaagggattatttttggataagacaattgccaacgctagaactgagttaaaatgggaatgtgattacaacagagaggctagagctctacaaaagtttgaggcgttgctaaaggatgacccagcgtttgaggttcctcatgtgtttcctgaatatacaaccgataatattataactatgacacgtatggagggaactgaaataatgaaattgcccaaggcatcacaagaaaccaaaaattttatttcggagaatatcatgagactatgtctggaagaaattgccactttcaagtatatgcaaacggatcctaattgggcaaatttcctctataacggtaggacaaagaaaattgaattattggatttcggtgcctccagaccttttgcagaagattttattctaaaatatagaaaacttttaacttacgccacattgagagataggaaaggggcgtacgaaatgtctgtacaactgggctatctcacaggcttagaatcgcagtccatgaaagacgcgcacgtcgatagtgtacttacacttggtgaaccttttaggggtgatgtagataaatctttcgatttcaaggatcaaacagtctcagacaggattagaggtaatatcgggttaatgttgaatgaaagactatgtccgccaccagaggaaacatactcgttacatagaaaatttagtggcatttttcttttgtgtgcaagaatgggtgcgtctgttcattgtgcaaagctttttaaagagatttttgcctataaagtttaaaatacttccccgctatttgtatatatgcatatctttatattatgaaagatatttttttatttacttttagtccgtatacttttattttgttttgttagacaatctcgaagaacaaaaaaaaaagataaaacagaaagataaatgtgcactcttttgtacctcgttctgctatagtacttccaaccagatcgactgaaagattactagtatatacgtcatgtttttaaatagtagttcccattctgcttcagtgaattagatatttttttccaatcattctctttaaaccctctgcgatagtgatccaacattttcttagcaacgctaatccttctgccaatagcttctcaaaatatacaccattaactttacaacattacataatatgacattccacagaactctctattccattttaccccatttcaaattactttttagtctttgaattgggtcgcttcctaattatagaattatttttctctgtaaagtcccagccttgttacaatacaattgtacatcattcatgagagatgaatataatctgcatttcttgttctaaattgaatatgtatctttgaaaatactctgtatgcaggcaacttctttaccaatatttactttatgaaacacgccagctttaagacaataccttcgggtcagaaatatagtttagtttgttaactacagcagtttcttacagaaaattttgaacttcgacattagtgcatttatctcaggatataatgatcccgttatccaatcgatatagctttcctcaggtttccattcagtcataaatgttaaattaacgttgtgcctagggggcagataagcctatgacattgtttcgtgctcatcaaaacactaatgtaatggatggcaactgttgcacctattcaggctgcaaaaaaagaagtatcatttaaatcaaaaggaatatgaactgatataaaaagaacatattcatacgggcgaatttggctagtaaccattacgagataggatagaatatacgtatgagattagaataattaacataaaatatgataatatcgctttgcattgcaattagcatacgtaacctcacacaaattttatactaattgtctaggcatttcatacaagaataacattagcgatcattagatcagctaaagttctacataaatgctgctgaacataataacataggtccgcttagcaatatcaagacattattaccgctgtcaacatttcttgtccgtcagtggacttacaagaattgaaccgaaaaaaaaaagaatagaaaaggtacaataaaaagcaatcggtaaacgcgacagcagagacgcccctgcacatttagtacaccgtttccttcatttaaccatccttaaattatcacttgcagtataaaaaatgaaacggacaggaattgaacctgcaacccttcgattgcaatcttattccgtggaatttccaagatttaattggagtcgaaagctctaccattgagccaccgcttcatcttgaaatatccaagaattaaattcttacttgtctccccgaaagctgtatctttaaaacggctcctagttatcgtcagttttgataattagtaactagaatatagtatcaccaagaacaggccaggtaatatactagaagttgtgtataactactaatatttttatacatatagatgccaagtcaaggtccaattagtagatttttcactctaccttgcattattacctgaaagatcgtttgtgtttccttaaattcgccagaggtgcaaacgaatgtaaatatctacatcaatttacggtttcacgcccgtttcgtttctaatggcaactcatgtaaactgtgataaacccgttatttcagttttattttctgctagtataaaggatgatagtagccatttcgctggaatatgtatcgggtttaaaagatggcatagttcgaaacattttcgcacaagattctaactgtcttcgaacgtcgtagaaaccgcaacgcaagaaatgacagcgcaataaaatttattttactaactgatagaacaaatgtaaaaaatttcataatatcaagtagaattctttattctctttgtgaattcctaaacccatgaaagggacttgtagtataagctggatacctattttcattggcttcgtttccaaatgacacaaaaccatcacaaaaggaaatagtccttccatagttacccaatcattctgttgcatattaaatgaacagctccttgttgataatgccagtgtggcatattcaccgctgcagttatttcttttcatatataatgagtcatttgtttctgtcatcacttttctatactttctcttccccgcgtgttttccgtacaccaacaatatatgccataatacacgtaacatttttttataaaaagaaaaggtaagtgatatatataaaatagcgccatgagtaggaaacttttctgttactgcagatatgtgccagactggctcaggtggcataaacacagattaatagtattggcgttgctgaaataagaagatctgtaacaatatcttacaatgcagccaatttcaataaaagatgtggaaagcgatcaagggaaagtttacattgttaatgccttaaaagatctcgtatgcaagtgccttttagaattcgtggacattcaaattgaaagttttatgtatccggacgatccaaagtgttttacaaggatatttaaagggaacaagatagtcaacgaagcatcagataaagattcgaaagtgagaagttacccatcttcattgggtgttggacactctgctttgtttcctttgatatacataagacaaaaaaccaactccttgcggtttttgaatgatccaaagcaattaccaacaccactggtcgatgatatgaacgcaaaattcaaaggcatcattaaagtttatgaaaatctcattcacttgtaccattcatatcagacggtggattgcaataacatgaatcagcaaaagcttttgggtgatctggtcagtcggggtaatttcatgcttgatatcctccacgggtatgttactattgcatcaacaatagtacgggacagtaaggatgccaatatcttgatagacactgttaatcggttcatccacgataccatattattccacaagcgcataatacataattccaacgcttacacagagtaccatgtaatgaaacgtggcatgcaaagaaaccagagtgaggaaacgttagttgaacttgaattccgaatactggatgtttctgatgttaatctggacaatgaatttgatgactttttacagcatagaaaaacgtctcttaaaataactcatagaagggttatatgataatttgacattcataatattggtaaaaagtaccctacatactacatatttctagaatatccacaaagaatgtgtcgttctttttctgcggttctttgttagctttccttcacttcctttatgtcctctttcatgaaagtgaaaaatgtgaagtgcatgcgatttttgcgttagcaatttgattgccgaaagaggcaaaacgtaaataggttgtttcaaataattagaaggagcatcggaaaaatgcaacgacaaaacctctagcaggcaaagaatttatcacctttaaaatagactggaatttgtcatattagttcctaattcagccaattaatagtttaaatcagactaaaccagagatcagtcatcaagcttaggactaatctgctttgcgactttgatttttgtgtccaattggaaagaaacccaaaaatatagaaatcgtccattcatttagtgcagaaatatcaaaagacaagtattacaaagaagactaatgccagaaagctctagagataagggaaatgcagcaattagcggtaaccgttctgtactttctattgcgtccccaacaaagctaaacatactatcttccgattggtccagaaaccaaggtaaagtttctaaaaattcgctaaagagatcaagttcactgaacattagaaactccaaacgtcccagtttacaagcctctgccaattctatttattcaagacctaagattacaattggggcaccaccgttaataagacgagattcttcatttttcaaagatgaatttgacgctaaaaaagacaaagcaacgttttcggcatactcttctcgttcatatccaacaattggatctgagagcgtagtttcccaaacatctttatcgcaaccgacaacatctagagaagttgatgagcaatttacagtagctgcggatagatatattccaattctacagggagcttcgcaaaacaaggtcgatcctgaaaccttacacgaggcattacctccgccaaacgcgtcgccaatttcacacttaagggcccagactaagattgtcttcaaacaaaatgtagctgaagcgtgtgggttagatatgaataaaagaatactacaatacatgccggaaccaccaaaatgctcttccttgagacaaaaaagctatatcatgaagaaaagaacacattatagttatcagcaggaacaaaaaattcctgatttaattaaattaaggaaaatcaataccaatccggaaagaattcttgatgcacctggtttccaagacgacttttatttaaacttgttaagttggtccaaaaaaaatgtcttagctatagcactagacactgcattatatctgtggaatgccaccactggggatgtttccctgttaacggatttcgaaaacaccacaatatgcagcgttacgtggtctgatgatgattgtcatatctctatcggtaaagaggatgggaacaccgaaatttgggacgttgagaccatgtcattaattagaactatgagatcaggcttaggtgtccgtatcggttcattgtcttggttagatactttgatagctacaggcagtcgtagtggagaaattcaaatcaatgatgtcaggatcaaacagcatattgtatctacatgggcagagcacacaggcgaagtctgcggtttgagctataaaagtgacggattgcaacttgcatctggtggtaatgataacactgtaatgatttgggataccagaacgtccttgcctcaattttccaagaagacgcatactgctgctgtaaaagcactaagctggtgtccatattcgccaaatattctagcctctggaggcggacaaacagataaacacatccatttttggaacagtatcacaggtgcacgagttggctcaatcaataccggatcccaggtgagctctttacattggggccaaagtcatacgtcaaccaatggtggtatgatgaataaagagattgttgccacaggaggtaatccagagaatgcaatctctgtttataattatgaaacaaaattcaaagttgcagaagtagttcatgctcatgaagcaagaatatgctgttctcaattgtcccctgacggaaccacattggccacagtgggaggagatgaaaacttaaaattttataagatatttgatccaagatgtacaggaagatcgagagaagacggattgatggatggtatgctaggacttattggcaaggaaggttgtcgaacaaatgataaggagaatcgttccaaaaattcgagtgagattcatacaaggaggccctctagtaccagccaatatttgatcaggtgataaaataaaaaaaataaaagttcatgtcaaggcatataatgaaatttccatacacgcatacataatgtataaacataaatgtattcaagaagcttaagaaataaaagtaatgaaccttgagaatacatcaagatataactcatcacatgttaaagaacccacacaccacacgcgcgagaactgggagggagagaaatttagcaaataacaaaatttaggccttggaagaaaccatagcaatgcaataatcgttattaacataatatctacattgagaacttcttgggctagtggttttgctgcaaactggaaaattgtatcaatcttttaacgttagctaaacatcttctgctgtgttagcattaggaggaagcgaaaaggaaaatacataatgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgagggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactgaaacgagccgatgagatttttgtgtacatactataaataaatgcaactaataaagtcatgattaatcagtcatgcatacttcatctgaccaatatattttcatcttgcttattttgggtataattcggcggaaattcggttataaagcgaagtgaaaaatcgattagtaatgatactgatgcgatctctgggaggggggaatgctgcatataagggtgaaggaagataatgcaaagccttttgtagtattgtctgttgataccaaaataaattagttcatcaaaaaggtacaggcagctaaagaaaagctgtaaatttaacgccgtagaaggtatttttcgtgagatctatctcaaggcatcattttttttattttcgcaccaagataggaagaaaaagagtcacagtatagaggactaaccgttaaagattctaaatcggtactgtaaatactttgaaatgcctcaatctactccaagtcaagaagtacagcgtgtaccatgggataataaacctgctttgaagcagataacactccgagcaaccatagcaggtatcgctatagggtctctggtgctaacatcaaattttcaatttggcctgcaaaccggttgggtttccatgatgtccctgccatcggcattgttagcttgtgctttctttaaaaatatctggccattaatatttccgaacgacaggcctttcagtgacgttgaaaatgtatacgtacaaagtatggcagtagctgtcggaacaggcccattagcctttgggtttgtcggcgtcatacctgccatcgagaagttccttactaacgacgaaagtggtggattaagggaacaaggacagtccttcacttttagagaattgttaatatggtccacagccctagcattcttcggtattttttttgcagttcctctaagaaagcaagtaattgttagagagaaacttcccttccccagtggtagcgccacggccactttaatttcagtgctaaatggaactgagattttacaagaggtttctaagtcagagttattggaaatgaggcagaggagattgaatgaatgccctgaagtgctacaacccaacagagatccagaggaggcggattatttaatgaactcttctcatagcgaacttggtgattatacggcaactagccaagatggaagttctatcctttctactggctctgagaactacagagcgaatattattattttattgaaaacttttgttgtttcttcgctttacaccatggtgtcatattttgtaccggtaatacggtctattccagtcttcggaaaatacctctcgaacaattatctctggaattttcagccgtcgcctgcgtatataggccaagggataataatgggtcttccaacagtatcgtatatgcttatcgggtgcttcttaggctggggtgtgttagcaccattggcgagatacaaaagatgggtaccaccagatgctgatgtccacgactgggaggagggagtgcaaggatggattctttggtcgtcgctttcaataatggttgctgacagtgtagtcgcttttattgttgtgacagtgaagtccattgtgaaatttattcttatagatgacaaagctgctttactgaacaacataatcgatgatacatttcaatctatgttactggaggaggaacgcgccattaatagcagcagaagaaatacatatgttgatggaaggcaggacaccgtaagattagtgagtagagataacgaaatagaagtagattcgaagcatttggttcgctataccaccgttatcagtggatgtctagtctcctcgataatatgcattgtttccataatatatttgtttgggatacaagtaattcccctatatgctattatcactgctttgatacttgcgttgtttctatctattctcggtattcgagcacttggagagaccgatctgaatcctgtgagcggcattggtaagatctctcaattgatttttgcctttatcataccaagggatagacctggatcagtgttaatgaacgtggtatcgggaggtattgcagaagcctctgcccaacaggcgggcgatttaatgcaggatttgaaaacggggcacctcctcggcgcctccccaagagctcagttctgtgcccaattgataggggcctgttggtcaattattttgtctagcttcatgtatttgtgctacaataaagtttattcaattccgagtgagcaattcaggataccgacagcagtagtgtggatagattgtgcaagactagtaactggtaaagggctccctgataaggccttggagtgctccatgattctcggagtcatatttgccgttttatcattaatcagaaacacttatagagattacggatacgggtggatattatatattccgtctggtgtagcagtcggtgttggtatatttaattctcccagttttacaattgcaagattcatcggcgggtgggcttcgcatttttggttgaagaatcataggggtgacttaaatgcgaaaacaaaaatgattgtattcagttcggggttggtcttaggtgaaggtatctttagcgtaataaacatgctcttcatctgcttaaatgtccctcactattaggtatataatattttactaataaagaatttacaaagtttacaaattttaaattatttactcatcacataattcgatgtcttagatttccctgtatatatatttctaggtgacaaaaatcctaggcaaaatgttatattatacgcgaccttgaaatatcggctatcttggtgtacaacatggtccatttaagaaaaataaaaaaaagtgatgggcactgttaaaacaggcagaagcctcattcataactgctgaagggttaagatcgtataggtaggaacgatctgacctctcataatggaaacatgggaagtcatagcatcggtaaaagaagcaacaaaaggccttgacttgagcttagatcatccacttattattaaatccgaggacgtgcccagtaacattctccaattactgcaacagaagaatcgacgtcaattgaaacacatctgcatgaaatcaagaaaagagtattttctactagaggaatatgggccaggattttgggttaagtggccgtacaattatttcaatggttacagcttaccagaaaggcgtacggaagttgtaacgacagttgaaagagaaagagctaagcgtgaaacgttaaaaacatgggacgaattgaaatttaaagagcttcttcatttatggtcagaagaacccaagggctcgtgtaagcttgagaaggacaaagaccttaaactggatatgaatcccccagatatgaaaggcgaatcaaaaattaatgactactattcagaccctaaagagtacatagaaagtaagtattatgatgctcttttttccatacatacgcctctcgcatatttcgtcaagtcaaatttagtaaggctcaaaaatacctgccgaaccaagtacggaagtgacagttacaaaatagcctatcaagccatgctgcaaaaatttcttctctcaattgtacaattcaaagatagacatgataacaggcttttattagagcccttttctagtcccatagcagatgaaaaaaggaagaactgtctcacaaaatttgttatccaagatgaaaacaaaaacagctcaaccattgctgatttatgtgttgtattaaaatcccgcgaaataaagctacaaatattattgctattagagataataggattgaacgatttagattggaattttagagattttgagaaaaagtataaattaaaattgaagaaaagatcacttaatttgacaaaaaagggattagttcgtcgaagatcgaagaaaaaaaccagcgaaaaagacaaaggaatcgagagaataacaacatctttggattattgtgaacagttagacttgtacttagatagagcatgcatcttggacattctactatcaagtgaaacgcccaacccagatgccatagaagcatcaaatggaacaatacaagagcataaaaaaaatatcctagacaaaagcaaagaagcctcattggttgggttcataaattatgttcttattccatatttcaacaaaaaggtaccacacgccgttgaatttataattcaaaagctcaagggaccaagcatgagaccaaagagagccctgaaaaaggtcaacgatagcacaaatgtatcgtcacctaatactgtagaaacgtataacaggttatccacgagtcaacgtgcctctcgctcttcaatcattaattccgtcccatcttcacccgcattgagaagggtggacgctaatttgttcagcagaaaatctatagcttcgcccacccctgaacttttgaattctagaacgaactctaacttgaatgaatttctcgaaagtgaaactagaagcttaaagcgcccttcacaattgggaaggacgaagtctgatctaacgatgaatcatttacaaaaacggcagttttctgtctctgacttaagcacaacaagagtaccgaattcatcaactatcacactcaaaacgcctttctcgcactcaactattaatgcatacaaaactatgaataactcttttcgcagagttgggaaacgtaaagatatcaatgaaacgatacgcctacatgaacgtgtagactctgaggaaaacgtacaagttcaagccactcctgctgtgaaaaaaagaactgtgacacctaataaaaaggcgcaacttcaaagcatcattgaatcgccgctaaatttcaaggatgatgatacgcatgaaggcagaaaaaatacctccaatattacctctactcccactaataagcccccggaaaatagctcaaaaaggagagtaagaagacgtttatttgctccagaatccacatagaataagaaactgcgagaccaccttcgctggcaagtagttgacccaactccatctttgtagcttttcttggacgaaaagggaataaaataaaactaagctacaacaatttcgcacttcgggggcctttgagtatacaattaaataactcatcatgcatatatatatatatacatacaatggcgtatgtaaaaactgttatataacattaccgttgtactattagtataaaccgattctcactattcgccaaaaaatatcgcactaattaattcttttgcgtcgtctcttttcaaaatgtgaaatccaatagtgacaccacacctctctagcaatttttccttatcctcatccgtaactttttcacctttaccctcgtacaaatctggtaaatccttttttagaactaacaatgcactaattacagtatcaaccaagatttgagtttcttctttagtaaatttggtcctagttggattggagtcatcgttcaaatgttcctctatattgtctagagttattccgctttcattgaataccaagcgcgcccaattatttaggtttcctaagaagaatctgatggattcaccttctagtaccgatacaccctttaagcacccatagtaagtcccaaaaacacggtttatgtccaaaaatgtctttagcagtgtcctagttactcttggcttcagggatttgtatgcttgaggaaattttttcaatacatagtccaacaaagatgcggcaaaatcacgtagtgcattcgttctttctaaaaattcatgaatttcttgcggcgaatcatcttttggtgatccaccaagtttttttgctaatagcaaggttaaaatggaaggcattaacgaatgaatataagggtccaggaaaatagaagtattgcttagtaaagagtaaatcatttccaaaattgttgttagcaattgtaaatcggaaagattttgtgtgatttgttcggcaataaattgaataaaatatggaaccagttggtgcaggccactatcagttcgtagtgaagtcaaagctgcttgtttcatatgctgtgcagcttcatcagcttgactcttcgctgtcaaggttgaaatgaccttattgaaataaatctgtaattctttggataaaacgtgtttcactaaaggtttgacttcagtattctgtcctggtttaacattagacaggtgttgagaggcgcctgtatccgtcacagaagcacttgctgtcgtcgacgttacaggtgtttggaggctgttatcattcaaagcagtgacaatagcacctctaataaatggtggttgggatacccttatatcattcaaatttggattttggattatggcaggttgaaccccttcaactgctagccaatgtgtagtaaaagttggtagacgaggcacttgcggtaatggctcatttattaatctatcaaaatctacttcttcctcatccaggtagtaaaccgactgtcctccacttgtgttaaccttactaaatgatacagctttattaacttcagagccatcataatatccatataaaggttccacattcagaacacgcagggccttcgatacatcgtctgtagttaaaacatctcttttagagtgtcttttaaacttgactgcctgttcaataatctctagaatacggtattcaacgtccatagcaagtgctttcaacacgtcatcgttgatattttccaacccaagcgactcagcgacatctttaacagtatcttgtggagaccaaattgtgtaagattgctgctgtgtagacattttaacaggctatcaactacactgaggcgtcctttgcttcctttttaaagccaatctattgttttcgctcatgaactacttttgctgctacttgaatcggtgtttgttattgatggtttccgggtatttttttggtaataaaataaagctgaaaaattttgtaaagcgatgcccaatctcgaagcctcacttcaatgaacataatacagagaaaatttaaccataaataggcccagcttcgatcgtaaaatgaggttactagtcagctgtgtggatagtggatccataaaggaagttttgtgtaacatcgggactgacacttccgtacaatcagcactgcagccttttcatgtggcacctcatctagccgaaggattgaaagcttacgttgacaggatgtgggtgatatccgaagatgaagccatcttagcaaggaattcaggggtcgtcgaacttgtaaagatttcgaaacaccttaaagaaaatgaagctctccaggtcgatcccaaaggagaaagcaaaaatgaaaagagcctttccgatgatctacccaaatttgacatatccgagtttgagataaccagctcagtttcagacctttttgatgatgccaaattggaatcactttcaagtaaatctgttaaaagaaccaagttggtggatggttttgtcacattatgtcccataaaaaaggattcgtcgaataacacattcgtagctgctaccaaatcgggattattacatattataaaaaaaggagaagataaaaagttaataaaactagcatcccttggactgaaagcaccagtagaatttcttcagttatatgatctagaagataccgatactgataaatatatatttgcatacggaggggaggagaatttaataaaattagtggaaatagattcgagtttccaatctttaaagcaaatttgggaagccaagaatgttaaaaacgacaggttggatatgagagtcccagtatggcccatggccctaagatttttggagccctcccctggtaaaactgaaaagggtaagctgaactaccagtttgcagccataacccgttggtcccacctcaccaaatacagcacacaacatggcagaaaaccgttcgctcagatagatttattacctaaccgtgaaccattatctcagatggaagtttttgatgccaagggagaaaatgttgtctcttcgttggggaattttcaatctgaaacctttaatgaactgaatgtgattactactgactacaaaaagaatgtttttaaattcgatggtaatggaagaatgttgggcaaggtgggtagagatgatatcactggttcgtcaacctatattcatgtacatgacggcaaatatcttttacaaggtggtttagataggtatgttcggatcttcgatataaaaactaacaaaatgctggtgaaggtttatgttgggtcccgtataaattttattgttatgctggatgacgttgaaatcgagatgccactaagtccaagtgcgaaagctgccaaagggaagcaaaaaaggaaggttacagaacttgaagaagacgcagatgagctttggaataaattggagggaaaggtagctgcttctaaagccagtaagaaaagcaaaatttaatagtaaaggacgctaattgaaggcaaagttttactagtcggcgggaaaaattattaaaaaaagcacttcctgaacgcgacgctgaataacttataatacgttacataattgtataccgtctagtaaacttacatacgcttgtctatcttgtatgctgatgcattttatcaaatagcgttatttcccgcacgagccaattttttatcgtgccccttcttacggttatggttagctctagcccctttccttttttcattcttagcatgctgtcttttcttctgttcagtagattgaggttcatgtttcttaatattttcagattttttttgtttggcttgttctttgacgacatttccatcattttggctatcacgattatgaacataagacgttttccctgttttgctatttcctttgaacataaacttcttttctaaaagtcttgctcgggtaggagatctttctaacatccgacaccaaccttcgattttttcatccgaccatgaagtcatttctttcatagttttcctgacttttgtacctctttttgatctctcaaataatttcggatcctctttcaatagattccacaagtaagcttcaacaatatgatagttatgatcttgtcgcacttcattagaatcatcttttgtatcatagctttcttcgtcttcttgaagtccaattcttttcgaaggatcggaccggttcacatcggcttcatcataagtgtcatccctttcatcttcatcagcctcgtataaaagtttcaatgctcttgtcaaagttttatttcttaattcatccggaacaccctccgagataatctttttgtctagctctttattttttgagctatctcctctatccaatatactcagttcttcagtaaaggatgcattatcaccatctgacaccggctctacttcttcctccgcaggttctctggagaatgcttcgataatggtaggatcctcaaatattttattcgttactaattcaatgttattatcataggcaagcaacgtttgagataattgatatttagaaaactgggggaacaattccatcaacgcggacagttgttcttcattaacttcagtacctgatgatgttggatagctcatatggtctccttcgtccattgacaacccccctaaattcagaaatagtaacttgctcttcaaatcaggaagccttttgtggactccttcatttatgagcattgttcctaaaagaggatataacgccaaagtttcaaaattgcttatgcctaattctttagttatttttagtaaacgatcagcagaaacagaaaataaactgataatgatcaattctctagcctctttatgaccccggccctgtccctttgcccataatgcctctaaaatttcaatccaatttgccgtaaagaagttctccgcaaacttatttggctgcatggatttggcagacagcagatcttcaacgcaccttaaatctattcttttaaattttccagattctattaactgcttcaaatgctgttgaacttggtacgatttgtccaattgtacacgttgcgtgttgatccgtggtttcaatgagccatcgatcaaaccacgaatagaatctggattacgtctaacatatactttgatcaaattccacagggagtcaccaaaaatctgaagatgtaataacccgcatttcttgatcaatgaaaatatccagccttttagtaaatataactgttcagacacatcatggttgataccgagacttaataactttccttcctcatcagcaatttcatgcaagtaagttctcaaaaataaacgaagatgatcaagtgtagattcatctaataattcaacgttagcaccttgcatcaaatactcaaaatacgttacataggtttctattagatgcagccatactacggggtccttttcaattaattgagctctgagtttaaacggtggaaatttgacaatgggcagagaaatatctgcattacccccatttatttcaataacgcggttgtaccttgataacattattcttagtgattctatcctataaaaatttccaagattcaatagttaactcgaatgtctctcatttatgagaactagtgttttatattttcattttttctatggccgcgcaaaatccattggcagatattcaggtatataaacgttacaaagccaagaggagaatggaaggccaaaaaaaaaattcttgtacaattgcatatattgattcattacaatattactgccgtcgttctctcagtcataaatcatgttttccctttccctctcagcatgctttttctcggcctcttccattaagcgagtcttatgagacttggcacgctcttgagctagctttttgcctaactcgcccttattgtacttttcattcgtctcttgaaatctcttctcagcagctaaccttgcggcctcctttgggctaactttatttttgctcggatcacttgtatcagttaatttgctgccttctttcctttgcacaaccgggacagttgtactctttagttgtgtcttcttctttttatctttcttctctttatgtcgaagttcttgctttgacttgactgtatcacgattaattggttttgttcttgctttagttgccaccgtcgtagtttgtgaaggcattggttgggttttacttccgcaaagccccatactatgtacttaaatatttgttgttgtttgctggtgcaaatttcctggatgatgttaatgataattatagaccgcttttatatagtcttatgcctatccttttcatttttatttttctagagggaaaaaatcgctgattacatgagggaaaaaaatatacacatttcttgatcatagaagattcgatcttatatattatacgtttaaatgtttatttacaagcatgcataaattgagatggggagaatgaatgcgctagtactattgctccttagcaataaagctatgtagttgaggaacaggaatgtcctcggcactcaagtcagaataaccgctcagatactcatttaatattgggtatgactctgcgcatccagtggtatacctatatacttgcttggtagcgcgaaagtagggcgtatatctttttaatattttcaagtacagctctattctgtcttctgaattcgaagtagaatcctcatttttcaaattttccaatggcttcggaacttttatgtcgtcttctgtggtcgtagtcgttgctggtgttcctttagcttttgcagaaaagaccttttcatccctctttgattgtgaccatacgacagtggcatccctcaaagcggacagatcagcattggctatatattgttggcccaattcattcagtttcttgaccaactccagccatctatccagaatctcttcattattcgtgttgtctatgcttcccaatgatttcagtagtattctatatgatataatagttcttggaatatggtacaaagtatagtttttatcgataaaatcgattatgctgcgttcgtgccagatagatgctctagttaacataacgttaaaaaatggttcatcaatttttttgaccccactgtaaaacgttatgatttcttgaagcttacggaaaccattgatattgtcattaatatagttttcgaagaatattgtgaaaaaagtgttgtttagtgaggacaaaattccaggattaacagtgttaccataaaattttacagccttttcccatattctataaacatgatcaaaatcgttctgtgctttccatatattctgcaaaaaagagttcactgtagagacttgtaaaataatcttgtatggcatttcatcgttgataattttgtcaaagaaactttctgccaacgttaaattcttggaatcaccaatgaagcttaagtgcgtttcaattaaataaccgtaattcctcacttcagccttttcacataattggccgaagagggataatgccttttcgtagtcttccgccttgatgaagacttttatcagtccgctgtaaagattgggatggataaattctttggattgaataatttggttatatagctcgttaggctcagtcagagaacgcgtttttgcataaagtaatggcagcataaaaccaaccacttttggttcttggaatgcctgtgaagtagtctcgtcggacaaattctttgacgcttcccaaattcgaatacagtcatcgtcaaatgacagctctttaaatgaagtcaatagatgagtagctccatatccgctgacagacaccttgcctatcaaaatgtcatcagatatatcctttaatgaattacatagaaagttcatcatttccttgtgaaaagattgcgaatcgtagtctggctttctacttaattttaccaattggtctctcgtcgacctcagaccgttatgcagcagatgaatcaaacgtgacacccggtacgcattgaaatcaggcgattctctcaaagaatagtataactccattgctctgcccatggagtcccaaaacatggcgaatgatggatttttattcaattggttgtttcctattcttttgtatgtattttgcaaaggcgtggtagagtactttaaagcagatgatacacactcatcaaacgaaagaagctcgtggcgccatggagaagctggatccacattaaacacattctgttctgttttgcgctgttctcgcccattcttcttgtccaaaacgcccttaggtacatttttatgaaatatcggactggagtggtaagtacggtcgctaagaactacgttggcaagcttacctctcagcattgctatcgaaccggagttaacaacgttgcttacgcttatttccatagtttttaacgatctcaccgcatttcttctaagcatcattgtcccttttgcagtatatggactctccgaatagtgtaagaaaatgacactgaaacctcaccttcttttacttattgcttagaccctcattacaatgccatactgaatacattttttcgaatcttgttcagtcaggaacctcaaccatatatcattacacacgagtagtaacaaaagcattttgaagtaagatttgaaacaaaataatactcagagtagatcgacgtataagagttccttccccagcgtattccgccaccacccatcgcacatacatagaataacaatgtcagccaccagagccaataaagatattttcacactattcgacaagaagggtcaaggcgccattgccaaggattccttgggagattacctgagggcaattggctacaaccccaccaaccagctcgtacaggacatcataaacgcggattcgagcttgagagacgcctctagcttgacgctggaccagattacaggcctaattgaagtcaacgaaaaggaattggatgcaactaccaaggcaaagacagaagacttcgtcaaggcattccaggtcttcgacaaggaaagtacaggcaaggtatccgttggtgacttaaggtacatgctaactggcttgggtgaaaagttaaccgacgctgaagtagacgagctgttgaagggtgttgaagtggacagcaacggagaaattgactacaagaagttcatcgaagatgttttgagacaatgagagtgcggaactgcaaatttagacatttattactatataacagagtcctatcgacataaaaacgaaaaaagcgccattatgcaatgaaaacttgccagcggtttttcatttttcatactggtaattcagagagccaagtctttctttataatgcatagcaataaatagtcatatatatatatatatatatatatatatgtacatatatatgaacatatatatgaacaaataaatgataatggtatgtgatagtcattattaacgattaagcgtttttcttcagtttctgagggattctaaccgcttggcgattttgcaagagataagaaaatttttcagtcatatggataacctaacacagcgtgcgacgtattttacttcagggcccaattgaataagaaagtataatatagagtttcaagagtcaatgtccgatctcgttaccaagttcgaatcgcttattatttcaaagtatccagtttctttcactaaagaacaatctgctcaagctgcccaatgggaatcggttctaaaatctggtcaaatccaaccacacttagatcaattgaatttggtgttaagagacaacaccttcattgtgtccactttgtacccaacatctaccgacgttcacgtcttcgaagtcgccttaccattgattaaggatttagtggcaagctccaaggatgtcaagtcaacttataccacatacagacatattttgagatggattgattacatgcaaaacttgttggaagtgtcgagcactgacaagttagaaataaatcacgatttggacttacctcatgaagttattgagaagaagaaaaaggcacctgcgggtggcgctgctgatgccgcagccaaggcagacgaagatgttagtaagaaggctaaaaagcaagatcatccaagaggtaagcctgatgaagaaacccttaagaaattgagagaggaggcaaaggccaagaaggcagctaagaaggccgccaacgccaaacaacaacaagagcaacaaaataaggccccagaaaagccaaagccatccgcaatagatttccgtgttggttttattcaaaaagccatcaagcacccagatgccgactccctatatgtctctacaattgatgtcggtgatgaagaaggcccaagaactgtttgttctggtttggtcaagcattttcctttggacgctatgcaagaacgttatgttgttgttgtatgcaacttgaaaccagttaacatgagaggtattaaatccactgctatggtattgtgtggttctaacgacgacaaagttgaatttgtcgagccaccaaaggactctaaggccggtgacaaggtgttctttgaaggtttcggtgacgaagctccaatgaagcaattgaatccaaaaaagaagatctgggaacacttacaacctcattttactacaaatgacgggttggaagttatcttcaaagacgaagaagaaaaggaccatcctgtaagaaagttgaccaacgctaagggcgaatcattcaaggttgctagtattgctaatgctcaagtccgttaaaaagatataatatcacgaatttgttactaatttaacatgcgtaaatacttatttcacatatataattcaaagatttataagtaaatgtctttgtgctaataacacgccgtcccgatacgcctcaatggttagcccttatttcattttagccgctcctcttggtctccggaaccttcttccagataaaggcgcttattgagcatgctatgatagcaaaaatgatgaaaacataacctgacaaaacatcatgaataatagggaaagtatatgcaatgataaaagttcctacccaattgcaaatggtaccatatctttgcgcaaggaccatatcctgtggttttgatacttctctcattattataaatggcaacggatttaaccccatcgtgaaaacgcccatatatataaatgaaaacacaatcaaaaggttcattttattatggttcattgctattcccataatgaaggcggtaacagaaactaagacggtggacgtcatcagaagcggtttacgtggcaaactatgaattagcagagaaactagtatggtgactaatacattcaccatactaatgaaaaagtttatcctaattgcgtgctgaggatacagttgactaattatcttggtaccatatagtacaatggagtttataccgcagaattgttggccaaataacaatacagtgataacatggcgagacttgacatttgttctgtccctcaagtatttccataatgaattagaaccgctaatagagttcgtggtggttggttcaatcaacggatccccagattctatttgcagttgccaatcctgtatctcttgtgcggcttcatcaaaagtcacgccacgtagcttacatagagataacttagcatcggtgactcttccatgtgctaacaaccattttggagattcatcgactataaaccacatgaaaaaattcaataccgcgataaggaagctaccaaacaaaatccacctccaacggtatgaatcagtcagtgggagggctattccttgtgtcaacaagacccctaacctgatacagatttgtgtcatcgaacccagtaaaccttcccaaccgcttggagcaacttccttaatgaaaaggggtataatcacgatcaaagagccacacgaaatacccactagaattctaccaatgattaagcccctataactattcgaattgaagattatcagcgaaccgacgatattcaatgtgcagttaattaaacttgagaacttccttccataaatattggccagactggtggcaaaataagagcccaaaatgcctccaatgcaaaaaacggaggtcacgattccaatctgttcatcattcaatggtatacattgcttatatcctctttttcccagccatgttctgtcatagggatagccctccatgggaatgtcaaattctgagcacgaaagcacctgctgaggtgcatttaattccgacaagtggtaaccaaattgtattgaaccgattgaggctactataattgcataacataacgcctttgtaattttatgcttgttttgccttggcatgctaacattggatagcaacgatgcactagatagaatcctattcatactatgctacgtacctgtttaactcttctcattttatccgttttctttcttcaccgttcctcttaagttctttatttttttcataacagaatgatcacccctttcactttgccgccaatataatattaacacacaagaaataagtatgaggtagtttgctctcgaaaaaaccaagtaatagttcaaaaaatgaaaaaaagaaaacaaataccaaattatgccaccgttaccttacgtttcatggttaatcatcgtttactgccgcctatgagcgtaagctaatgttataaagaaacaagctataatattgttaaatatagttgatcaacagcattgtaatgattacaagagacgaggtggaatgaaccttatgaaatgcgtattatatataaactgtaataagagctaagttgaattgaaatctacgatacttgatgttgacattatagcactagttcccaggaaaccctttcgaaaaacacagcaaaaacaagagtactgtaaccaatgtaacatctgtacaccagggacccacacattaccaaaatcaaaattatttttctaatgcctgttatttttcctatttttcctctggcgcgtgaatagcccgcagagacgcaaacaattttcctcgcagtttttcgcttgtttaatgcgtattttcccagataggttcaaacctttcatctgtatcccgtatatttaagatggcgtttgctttctccgttgatttttttccttcttagtgatttttttgcattaaatcccagaacaatcatccaactaatcaagaatgccttccagattcactaagactagaaagcacagaggtcacgtctcaggtatgtagttccatttggaagagggaatgaaagaaccaagacggtgactttttttttagtgttgtgcaaccaatatgtcgtgtgtatatcatggtacaggagaatgtcaatcagctaagtgtactcaacatatttctttgtgttttgattgcgaactttgtattaccatctcactgttgagacggcttatttgaggtaatagctcgagtaaatgtactcttccatcgcaaactgagcaaaaagaaagtgtgcatagcctttgtcatacttctcctttattataccatgatattcagaacagtcatactgtctactcattttacggctataaaaggtaactttcatttagattatggaaagcactaattatcgctgtatcaaatggttgtagagagcgcaattatgaaaaagagttaccacgtttcttttgtttcgataaaatgtccagttgaaaacctgttttactaacgatttaaaaattgtatttcattacaatattttttttgtacagccggtaaaggtcgtatcggtaagcacagaaagcaccccggtggtagaggtatggccggtggtcaacatcaccacagaattaacatggataaataccatccaggttatttcggtaaggttggtatgagatacttccacaagcaacaagctcatttctggaagccagtcttgaacttggacaaattgtggacattgatcccagaagacaagagagaccaatacttgaaatctgcttctaaggaaactgctccagttattgacactttggcagccggttacggtaagatcttgggtaagggtagaattccaaatgttccagttatcgtcaaagctagattcgtctccaagttggctgaagaaaaaatcagagctgctggtggtgttgttgaattgatcgcttaagcgcatcaacaaaaactctatgtattttccaataaattatatatcttcagtttaatctaattcaacatctacttctgtattatttctatcacccattttcaccgttttttcgtcttgtctattttgaagttaccagtggcagatcccaacgcttttatcgcttttttaaaagattttcaaaatccatatataaacatagggtccaaaaagaaaacaaataacaaaacaagaaaacctattcgaggtaaagaccaggaaaaacaaaatgactgcagttaacatctggaagccagaagataatatacctagggagattttggcaattctttcgaaacctcacccaaattatcagttagcgtttttgaatattatacaacttttgaaaacgcaaagaagaactggttgggttgaccatggtattgacccatgcgaaagtatatctgaccatatgtacagaatgggtttaactaccatgctgattacggacaagaatgttgatcgtaacaaatgtatcagaatcgcacttgttcacgattttgcggagtcattagttggtgatattacacctaatgacccaatgacaaaggaagagaaacatcgcagagaatttgaaactgtcaagtatctctgtgaaagcataataaggccctgcagtgaaagcgcatctagggaaattcttgatgactggttagcatacgaaaagcagacctgtttggaaggaagatatgtcaaagatattgataagtatgaaatgttggttcaatgttttgagtacgaacaaaagtataatggcaagaaggatttgaaacaatttttgggagccatcaatgatataaaaactgatgaagttaaaaaatggacacaatctttactggaagatcgacaagcctttttcgacagtttgaaggagtaataatgtggccttttgaaagaaaagttagtgcttttttttcttttctcaaaccttcacctggtggtgcgtatcatttataataacatcttgatgcttttcaacgagatagtgcccattttattttgcatgtattatacttccagcacccggtgtgcattatatgtaactttagaaataatcttttgtatattattcgcgattgaatgtgcgtgctgcattatcaaccaagttttaatatatctgtttctcttatttattgttagttaagtcttcggcaaaacgatggaaaaaatcatgaactgaatagagacaagtaaaccaaattataaacaaggtttcccttctgaagagatactaaggaagaagaagaacgacccaataatatttctgaatatgcaaccatttgatagtgggcatgatgatttagttcatgatgtcgtttatgacttttacggaagacatgtggcaacatgctcttctgatcaacatattaaagtttttaaattagacaaggacacgagtaattgggaactcagtgactcatggagagctcacgacagtagtatcgtggccattgattgggccagtccagaatatgggcgcatcattgcttcagcctcttacgataagacggtaaaattatgggaagaagatcccgaccaagaagaatgctctggccgtcgttggaacaagctgtgtaccctgaatgattccaaaggatcactttatagtgtaaaatttgcgccagcgcatttgggcttaaaattagcttgtttgggtaacgatggaatcctcagactttatgatgccttagaaccttctgacctaaggtcatggacactgacttctgagatgaaagtgctatctataccaccagcaaatcatttacagtctgatttttgtctctcttggtgtccttcgagattttctcctgaaaagctcgcagtctctgcattggaacaagcgattatataccaaaggggtaaagacggtaaacttcacgttgcagcaaaacttcccggtcataaaagtttaataagaagtatcagctgggctccttccattggtagatggtatcaactcattgcaacaggttgcaaagatggtagaattagaattttcaaaatcacagaaaaactaagtcccctggcctcagaggagtctttaactaactcaaatatgtttgataatagtgctgatgttgacatggatgcacagggcagatcagactcaaataccgaagagaaagctgagctacaatcaaacttgcaagttgaacttctaagcgagcatgatgaccataatggcgaagtttggtccgtgtcttggaatttaacgggtacaatcttaagcagtgctggggatgatgggaaggtacgtttatggaaagccacttattcaaatgaatttaagtgtatgtcagtaattactgcccaacaataaataagaatatatgtatacataacattatatattggtactttatacgtgtgcattattctgtataatacgaggcaacagatgaatcaagaaagatgatgcttttaaaaagctcttacaaatataatgatattacatcaaatgatattattattcttgatattgggtattctttcgaattatatcaagcttcccttccctcgccttttcgcctggaaatttttcaatgccgagattaaaaaatttgtcaatgaaaatgcattctactacttaataaagaggtgatgagcttataagccaacttcttttaaacacaaaactaaatctgatattgaggacccccaccaactatgccaccaaaagaagctcccaagaaatggaaggcgccaaaagggccaaaacctacccaccgtaaaaataaaaataagcttgaattaggcagagctattaaatatgcacgtcaaaaagaaaatgccatcgagtatttacctgatggtgaaatgaggttcactaccgataagcatgaggccaactgggttaaattaagatctgtaactcaagaatcagctttagatgaattcttgagtacagctgcactggcagacaaagatttcacggccgatagacattcaaatgttaaaattattagaatggatagcggtaatgattctgcgacatctcaagggttttctatgactaatgagcagcgtggaaatcttaatgcgaagcaaagagcgcttgctaaggatttgattgttccaaggaggcctgaatggaacgagggcatgtccaagtttcagcttgataggcaagaaaaggaagcgtttttagaatggagaagaaaattggcacatttacaagaaagcaatgaagacttgttgttaacaccgtttgaaagaaatatcgaagtttggaaacagttatggagagttgttgaaagatcagatttagttgttcaaattgtagatgcgaggaatccgttgctgtttagatctgtcgatttagaaagatatgtaaaagagtcagatgacagaaaagcaaacttactgctagttaataaagcagatttattgaccaaaaagcaacgtatcgcttgggcaaagtactttatctccaagaatatttcgttcacgttttactctgcattgagagctaatcaattattggagaaacaaaaggaaatgggggaagattatagagaacaagatttcgaggaagctgataaagaagggttcgatgctgatgaaaaagttatggaaaaagttaaaattctgtccattgaccaactggaagaattgtttttatcaaaagctccaaacgagcctttattgccacctctgcccggtcaacctccactgattaatattggtttggttggttatccaaatgtaggtaaatcctccactattaattcgctcgtgggtgccaagaaagtttctgtttcatccacgcctggtaaaacaaaacacttccaaactattaagttatctgattctgtcatgctttgtgactgtcccggtcttgtcttcccaaactttgcatataacaagggtgagctcgtgtgtaatggtgttttacctattgatcaattacgtgattatattggtccagcaggtttagtagcagaaagaataccaaagtattacattgaagcgatttatggtatccatattcaaaccaaatcaagggatgaaggtgggaatggggatataccaactgctcaagaattgttagtcgcatacgccagagctcgtggttatatgactcaaggttacggttctgctgatgaaccaagagcaagtcgttatatattgaaagattacgtcaatgggaaattactgtatgtcaaccctccgccccatctagaggatgatacaccttacactagagaagagtgtgaagaatttaacaaagatttatatgtgttcgacagattaccggacaccagaaaggagcaagtgcaaaatgctgctaaggctaaaggcattgatatcgtggatttagctcgtgatttgaatcagctaacgttttcagctcacactggtggtgacacacaaaaagaagccaaatctgttacgcacggtggtaaacaagctgcattgtacaatgccgctgaggacttggatagagacttcttcaagatgaacaacgtcgaaggtagattaagtacaccattccacaaagttcaaaatagttcagctggtaagagacataacaaaaaaaacaaaagtaaaaatgcgaaaagcaaagtttttagcattgaaaataattagcggtaactaacatatatcttctcaaaaaaactgtgtactattatcttttcatctcgccaattaatgacagcgttatttgagaatagacctaagataataaaactatgttcgttacccggacaaattttcttggaagaatttttgagtcctagagatattataaaacggccctctattaatttgctctttctttcctcagtttaattcttctttcgaataaaaaataaaaatatcatggctcttcaacacatttcaacatgttcaagtaatttgtgttagtggatgaccatttaggggctgctggcctggttaccgggagtttttcttggatccaagctagcttttccgtctgattatccttaagcttcacaaattacaatttttcccacgcattaagaaataagctcaagatgcctaaaataagttctatcccgccttttttcgctaacaatgactgagtattcccacagtctatagtttgatagtagatgggcggaaatttttctcatatatttactttttataggagagtatatttacgtacgtatagtgattgcatgtagttgctccctatatcttgtcatatgagcgtgatactgaccgatacctgttacagatgtcggtctggatttgttcgtttttcttccctaaagtaggtcagtatatataaaatatggccggaggaaagcttcaccactttatcaccactaaatttataaagtagaatacaatttcaacatacacagagaataaaaaaaggttgacaggacacataatagcaaggcaagatggctgaaacttccaacgacccctttctgtcctacgttttgagtagcaaacaattaactaatttgaatcgtctacgaaggaaagcagttacaaaacaactgggatcaagtgacgacaataaggtctcagaggagtttttgaggtatcaacatacttatcaaagagaagcatttgaatatctgcaaacaaaacatgacgcccacaaaataatggagtcacagtacgaacagtaccaaagcagttcaaaaacaagaagatatagtatcgatttagattctgtagatgcagttgacacggaatcgcaaacagaatacccaaatgaggagtttattgatagaaacgaagatagcgaagctgttatggagttgagaaagagattgttggggaagggacagaataagggtttaggatatgaaactacgaaatcagtcgataggcaaattgaggaccaggacacgttgcaacaggatttgattcaggatatgagcaaacttgtgggcagtttgaagcaaggagctgtggcatttcaatcagcacttgatgaagataagcaagttcttggagctgcagagataggtattcaagttgcttctcaaggtttaatggatgttagcggtaaattaaggaaatatgacaagagtaaattgagttacttgttttatattactgttttcatttttatgattctcggactggtgtttacatttatcataattcaattattcccggccctataatgtaattataacgatggaatgatgttttttggaagaaaaattcaactgtttattaatatttacggcattttttcatgtagttgagattattcctattgaaaaaagcaaattgtgagaaaaaagtatacaataaaatttgtataggctgcagaattctcctttccgtatagttgcctacttcccgtctcaaactgaatcctgctatctgattgctttctgtgttggtgcggtgaatctttttatacatataatatttgaaaaagaataaacatttgagaaaacaaaagtagctaaacaaaacgacaaaatcataacatttcctgatctgactgaaagctaatagaacagcagtgttcgatgagggtaaaataaggaggggtcttcggttacgttatactagtaagttgattttgattttaagtcatattattgaacgcattatgatgatactcataatggactaaatttttctcatgtataaggtccatagtagccaagtgcattccattacaatgttattgatattatctgtgctctcaaattcggctgaagaaaactactacaaacacaacacatcaaataatgtaacacagccttgcttattgccggtgtaagggtcgactatcttcgatctactcatattcatattatcaatttattatcatatatggtataagaaaatgacatgaacattgagaaacaaccaatagattaattggaagctgaaatgcaaggattaataacttgataaatggaagttaaaagatagtattaatgatgactaaatatggattctgttatccttgtataagagaagtataaaacaaacaccaattggtttattattctcttttcttcaattataatcagtacaataatggctccagcagctgtcacatattttaatgatgatttgcgcatatataacagagataggtttaaataatttaataattgttgggatttcacaactattgaaggctataatattatgtataaagaatataccaggaagtcaactcccagaccttgaaatcctcaaaatgaagacgatagttttacataataatattactttttcttctttccttctatatttctccttcacattcatattacgctgacaatctttgcatttcagcttccaccaagcctgatcaccgtttaccaatatttgtgtcattttcttatacctcaggtaataataaactagcaacctgaataatatcaaatagacgatatgttaaagtttcattctaacaattaccacccattccaaaatatctattgttagagaggcgttaatagaacaacacaacacaaaaatactgaaggtcaaagtttgttgtattacgggctcgagtaataccggagtgtcttgacaatcctaatataaacggtcttagggaagtaaccagttgtcaaaacagtttatcagattaattcacggaatgttacttatcttatatattatataaaatatgaatcatattaagtggtggaagcgcggaatctcggatctaaactaattgttcaggcatttatacttttggtagttcagctagggaaggacgggttttatctcatgttgttcgttttgttataaggttgtttcatatgtgttttatgaacgtttaggatgacgtattgtcatactgacatatctcattttgagatacaacaaagttcataaagaaattagccatcttagtatagtggttagtacacatcgttgtggccgatgaaaccctggttcgattctaggagatggcattttttccgaaatttcgccttctcgcacaactttccaaacccgaccaagagaaggaagaaatcattttttttgttgcgagttgtcatagaacgaggtcgagaaacagaagaggaattgaaaatgaattgtaaaagcgttcgttctatgcctctaataagagagtacgtcttgcttgatgtgaacccaaatgcccacaaaacagtacgatttgcagttatgtaaatttgtggtttgtctcctggcaaaaagaatgcattcgtactgcacataattgaaataaggatgtagttcaacttctatgaatgctcggcgatacgatatgtagaggggacaaaaatatgtaggtatcctatggtaaataaatcggtctgttttaaaacctgttttagtgcagcttctttccacgaaagaaatagtgtaagttagaggtacttctcttttacctaaaggaggtgtagttatgataaaaagcgaagctaactaagacagctaagctctttatgttgatagttaaaagttaacaggttgtattaatgaagaatgaatatggatctttttgtacttatataacagaggtataaaccacatgccgattgtttcattattatatatggctaatataatggtgattccggcagcttcatacatttaatgtgacgactcatattgctcttatatgtgactttcagatctcattcaattaatagactcttaactcaaattcagtactttctgacatgctcatttacatttccttttgtaatagtgcttccatacttcatcgtataggatttaaacatttagatcgttaccatagtaactcatgttactattaaataccgctcgtttcaacacattatataatactttggcattgatacgccacataatattctaatttctcttcaacacataagacaaacagggcaaatcaagcaacaggaaggtatttgcttcttaatggcaaaacaggttcagttccactaaataaaaaggggaaatttacgtgtcatttattatgggttcagaaattatgtgttaagtaaaacacctatagcactggggcaaattccggcatcaatttcaacgccaccaaaattgtgtgcgataataattgtgaccccatcatggaaatgagccttcagccagagacggaaaaactcttgaaaggaatactgatggatttataggttcggaaaataataataataaaaagccgtgttggacattatccctcccgttgctcgcggtaaattcttaaggccatatttcaggtaggaaccatcgtcaacaattgctacaacgttttgtagtccccaagattgaaatacaatagcagttgaaagagaactacctaagataattcaatgaggcaattactgattattcctgacagagtgtaaaatatttgcaagtaagagaatcggaacagaaaatttagatattatgagagtcttccctcggcagtaacgatataaagccaatctgtattccagtgtcctgccattctggttctttaaaaactcacttccaagatagtataatccgagactctaaagaaaaggacacttgcttttaatggacagaggaacaccgcatactctaaagtagagagcaccgatatcaagagttacatatatatatatatatatattgtttgcttccgacagagatagctatctagcaattcccttctttttcaatcgttgggcggctaaaagtagcagggtttcgcgaggacctctcgaaggacaaacaatattcattacccgcacaaataaaatttcaaaaaaacaaaaaagcacgggagaggcaaggcaggatgaataaaatcaccgatctcgagaatattaaaagtcatcaagacatcctctttaagtcaaatcctggatccagaaacttaaaaagttgtcatataaaagtttaaaatggtcaaaagaacagtcgccaccaatggagacgcgtctggcgctcatagagcaaagaaaatgtctaaaactcatgcttctcatatcataaacgctcaagaagactacaagcatatgtacttaagtgtccaaccattggatatattttgctggggtactggttctatgtgtgagcttgggttgggtccactagccaaaaataaggaagttaaaagaccaaggttaaacccatttttacctcgcgatgaggccaagatcatttcttttgcagtcggtggtatgcacaccttagcccttgatgaagaaagcaatgtatggtcctggggttgcaatgacgtgggtgcgttgggcagagatacttccaacgccaaggaacaactcaaggacatggacgccgatgactcaagtgatgacgaagatggtgatttgaacgaattggaatctacgcccgctaaaatcccaagagagtcatttcctcccttagcggagggacacaaggtcgtgcaattggcagctacagacaatatgagttgcgccctgttcagcaatggcgaggtatacgcatggggtactttccgttgcaatgaaggtatcctagggttttaccaagataaaattaaaattcaaaaaactccatggaaagtgcctacattctctaagtacaatattgtccaattagctcccggtaaggatcacatacttttcttagatgaagagggtatggtgttcgcctggggtaacggtcagcaaaaccaattaggaagaaaagttatggaaaggttccgtttaaagactttggatcccagaccatttgggttaagacatgtaaaatacatcgcatctggcgaaaaccattgctttgctttaacaaaagacaacaagttagtaagctgggggttgaatcagtttggtcaatgtggtgtttcagaggatgtggaagacggtgcgcttgttacaaagccaaaaagactagcgctacctgataacgttgttatcagaagcattgctgctggtgaacatcactcattgatcctatcccaagatggcgatttgtattcgtgtggtagactagacatgtttgaagttggtatcccaaaagacaatttacccgaatatacttacaaagatgttcatggaaaagcacgtgccgtgccacttccaactaagttgaataatgttccgaagttcaaaagcgttgcggcggggtctcaccattcagtcgcggtagctcaaaatggcattgcctattcttggggttttggtgaaacctacgccgttggattaggcccttttgaggacgacactgaagttccaaccagaatcaagaatactgctacacaggatcataacatcattttagtcgggtgtggaggccaattttccgtgtctggtggtgttaagctgtctgatgaggacgcagaaaagagagcggatgaaatggatgattaaggtagtagtacaaagataaataaaagaaaatcgacataatgcacctcagtataaattgtaaaatataacataaatcaaagaaaaacgagaaaacgatatgattatccgataccgacaaattctcatgtttatttttttttttttttttttttttttttaatttttcttgggcctttacattgagtacaggggcataagtgcgaggagttaccagacgacaactagcaggcggatgaaatcaacactgagtaagtattatgtaatccatccgctcgtccagcccttcaggttcttcctcttctgcacgtttctctagtaatgaactttctaaggaatttaatcggattttttgagaaaaacggagaaaaattaaaaatgtgccaagacaccagcaacaggcaaagcaaaggataaacttccggtgaacatgttagcacggaaaaattcattgctctctctaaccgcgacaaattacctatcgtattttaactttcttcaacagcattatggaaaatgcataccggagattgctcatacagaccataaaaacaacagaaagtcttgtgaggaagataagcaagcacggtaggtaaaccagatatgcacataaattaccgctgactctcccctaaaagaactatattgatggtctgacatataaggcaccgctgaaaagcatgtacaattttaatgtctttgcatttgcatagtcagtgtggcgtgcattctccacagaatctaactaatcaaatgtatcgtgactgggtgttgcatcattttcgcgaataaaaaatagaacactgtagagtagcgcagcgctttttttttattgaggccctttgcagaaccaaggctgcagtcttttctctgaagattagctttgctaatataaacaaatccgttaagttcttgggaatttctttgaagggggggaggcggaaatgtagtgagttgtttttactgtgatttgctttttctttcgctcatggcttattttcctttccttttcttcccacattcaataatgcagcgtaaatatagaacaagattacttgtttatacgagatatacgggcagtgaataaagtggtactagaactaattatcaaaaagagtaactgtcattcaacatttctggctctagacccaataggacataaacttttagatttttgaaaaatggcttggcgcagcacggtaatactagttggttttttaagcctactttcgccaataaaaaaaactacgaaacagttcttacttaccaatatcccctgccactacactgtactttagtgaacccaacatcacgaataagaaacaataaacaataaacaataaacaagtgttgctttagctcaacttgcccctgagaaataacagcgcaactatcaacaatgaatgcatagcatggagtagagtaaaaaagctttgttttggccccgcctagacaagaggcagctgcgcgaaataagaaattataaactcttgtttttctatactgctctcgctcaacctttttttcccacgcctattatcggttcaagggacagcagatccgctctgcgcactggagcagaaacattcccagttcggttccgactaaaacccgccttcccacgcgaaattctgggccgttcaaggcaacttattagtaagaagagcaaggggaaggtacattaaagcaagagaaccgtgcatgaatttatagacatttttcatgggaggtagggaattttcagactttaagttacaccccataggggcaaacatacagcagtggttgttatctttcattcgcgccaggaaaagccgctacccacactaagtgacgtgtaattgccgttcccttgttttgaagcacactgaaagctgaagtgatcataagaaaagaaaaaaataaatgctgagaagggtttgcaaaaaaagaaaggttcctagtatatatatggaaggcttcgttagcttaaactttctacagtcatgcatacagcaatttttttagagcattacttcttgagtggcaaaagcatttcttttttttttcagtataggaagtaatcactgtagaaataagtcaacaataattgcatagaaaaaaatgggtactagcatagtaaatctaaaccaaaagattgaactgcccccaatccaggtcttattcgagtcacttaaccgagaaaatgaaacaaaaccccacttcgaggaacgcaggttatatcaacctaatccttcatttgttcctagaacaaatatagcagttggtagcccagttaacccggttccagtatcatcccctgtttttttcattggtccttctccacagagaagcattcagaatcacaacgctattatgactcaaaacatacgtcagtatccagttatatataataataaccgagaagttatatctacgggtgagagaaattacataataactgtaggggggcctccggtaacttcttcgcagcccgagtatgagcatatctcaactcccaatttctatcaagagcagagactggcacaacctcatccggtaaatgagagtatgatgataggtggttatacaaatcctcagcctattagcatttcccgaggtaaaatgctatccggcaacataagtacgaactcggtccgcggatctaataatggatattccgcaaaagaaaaaaaacataaggcacatggtaagaggtccaatttaccaaaggccaccgtttcaattctaaacaaatggttacatgagcacgtaaacaacccttacccaaccgtgcaggaaaaaagagaactgctcgcgaaaactggtctaactaaacttcaaatttccaattggttcattaatgctaggagaagaaaaatattttctggccagaatgacgcaaataatttcagaagaaaattcagttcttctacaaatttagctaagttctgattttacttttttcggaattacctaaaatgggtttacggcatagaagatagatagattaagaggtaggttgacttttcctttgaaatttgtaattttaataaaaattccaaaaaaaaaaaaaaaaaattcaaagtaaaaagacaaactttggtgagaatcttcgattaacaaaattactccttaatattcttaaattggaaaatgatcatggttatcagtgtattttcttttaccgtgtatatcaagttttataccccgtatagcttcaatatacgcacttttctcagatctttttctgccgtcattcctttcttccttttctttcaactagaaaaagaaacgaaatcagaccatatatctagtcgccaagcatttttcccttcttggataggaggagcaaaagaaatactaacagttattaaaatgcaccatgccctctgtacatcataaacccacttacaggcttttttttcattctcgatcagaagagaaaaaaagaaaaatataactcggcaggctgtacaaccttattgttctgcgtagtttacctggtacataaacttcaatcaggtgattttttttttgatgcaacagattattttgtaggtgtatttgttcattatgtttgtatctctgtaggctcatggataatagaaattcttctcctggtacgtattggagtataccataggaatcaaatgctgcccgtcccaggatacttttttggagatatgacagtctgaaaggtgcagaataaggcaagtttctggcaaacaaaaagtgataacagtctaagtgtcttgaaaattgttgttactcttgccattgcgtcagaagaaaggtgagttttacttctatcctatagcgcaagaaggtactcaatagattacagttcttgttgcaagttggagtatcccattaattcaggccattcgccacgttttaaaacgaagttattaaaaagaatataattttggaattcgaaacttaataaatacatgatgctaggtacacagaagacatcattatttatccccctgaattatgagtccacacaagagaatcaacaactctacataataccataattattttgcctttcactcttcagaaagtcgttctttgattctgttgtatcatctgtccttttgtttgggcgtccactgaatttaatggcagcttagctttaacttcatcgaatggtttaatacttcacatcatcttctgaaaatcgcattaatggattatactgttatttaattagcagctgaaatttttgcttcaaaaagagtaacagttgcaagcaattctctcaaaagctaagaagcctttgagccttggaaagcaatgttcatctaaaaacacaagaaaaccctcaaaaagagttattgtgtgcaataacactaaatggaccacagatacatttttgaaaatgatacaatccgtttttgcttataagtacactgaaataaaacctacctgagctggcggcgctacaaacactcaatgtttctaacatatggaacaaagagaagacagcaaattaccttgctataactgtcaagacgttttggtaatacatgctacttgaaaaccctcaagagtcgctacaaacttgcctttccttaataaataaaggcaagcgttatcttcgttttcaatgaagcgtcatatacatgatactattggaataagaattagctatcatctatcgaatagtgttcataccattgacatattgttgtcggaatggaactctaaaatatcatctgtttatcggcattcgtgttagtagtatattatcacatgcggtgtaagaagatgacataaaaattgagaaacagtcatcaaatataatggaagctgaaatgcaaggattggtaatgtaataggataatgaaacataatgaacggaaggagaaataatcgtaatattattatgtagaaataccgattccattttgaggatttccatatcctcgagaagaacttgtagtaacataatattatagtctttatcaacaacgcaatctcaacaattatcaagattcacctaacattcaaatattatatatgatgtaaaaatatgatataaggattgcgaaatatatttcagatttaatgaaggtgatatgcaagtattgatcatttagaagaataactagggaatgaaaaaagagctaatactattattatataaaaataccgattccccttttgcggattactctatccatgaggagaataccctagtatattctgcatgattttataaaccaactattacagtctttataaaaatgaagttccaaaaacttctcatattggcctaatttctcgcgaatatgattggttatacggtgtaaaagtttttccatatagtaatttacctttgtaatggaatttttccaacaattattgtccgatatagtgtaacggctatcacatcacgctttcaccgtggagaccggggttcgactccccgtatcggagttttttgtcgtaagttgagaaagttttttccagttaagttattatgacgcatgcacatagaaggatcaccgaacaaagttgcaattattaggcaccgaatgaagaaaatgagaacctaatttcgcttggcaatagtaaaatgttttatctgcatcgaaaaagttatatagatttatgcctcatatataaaatagaattttagaataagataatccttatttattttgcagatctaatagaatccatatattctttagttgaaagtatagaggtgcctcctaaaaccaccctcattctgttattcatcgttccattgaaatcatggactagccttgcctcctcataagttacaccgccaataacaaacaatattacatcctgaggaatatctttgctctgctggtttccgatcactctatggccttgagtatctatttctttgaaacgatccctgaataacgcatttttagagagatctgttagtaatgacgaaatttccggaatatgttgcatatagacgttttcagcggtgttgctcttagaattcattctactattaaatcttcttgctagttcggttaatatatcgtccttgtcatggttactttgagtcattttatcctggcggctaaaaagcgatttaaatttatggaaaaagttgacgtcctctggaggaagttgttgagacagaatctcaactagttgacggattttgtctgagctggtttgattgtttaaagaataaatacatgcaagctttaacttgtaatacttatcaactgcttcattttgtagcaatttaatcaaatcggagaaatcttcttcattggcatcgtgtgctgatagattttgttctatttcactaatttcccatatattttttatcttcaactgtctgtctaattcccccactatagccatatgctttgcaacatttccagataattttctaaactctggatacttctcaataaagtttttaatatcctcaatggaatttatttggctgttggtttgtgtcttgtctttgtatgtagtcacatattgttttactttatcacccaattcaccaaaattcaaatacatggtatccctgaagaaagcatcttgctttgatgataaggtgaccttctccaggtctttatcaattctaggcactttcgataaatcaactatattccgcttaatgcctatatactcattgatcattgattggtaggtccaaggttgaagtaaaggtgttataggatcagtattacgatctaaaattagtaacacaggtgtcgaatccatcacaggaaaatcaaaaaaagttctttcgtttttaccaatctcataggaaacttctttagccaatctttcacaaattttacttgctccttcatacctgatatctggttttatctttaaggataaaagcacagaaactaagctgttggtacattttgttagccccccttcgctccaaaccaatttattacttaaaaattctcttggttgcaaatcaaacgaaaataaatcttggtttaatataaaaaagtcttggaatatttcttccaccttagtaacagcttccaagtcgtcagattcagctagccgttctaattgagatttagagacaatattactaaagaatatttgatactcgccgtaccgaggatttcttaactcacgcagcagatgttgcagtgtttcctctgtgggtttaacgtaaactaagcaccttaaatgcctggacacttcacgttgctcattttctattctttctaccagatatatttcatgcttcaacaactcactttgagtggcacataaggatatcgtaggtgtggtattcttatccaacagcaaaaccttaatcctttggtgttcattgacattggctacgctcaatttcgattgggaagtcacaattttgtttatataaaagtcagccacatcaaaaaggttcatttctttgttctatacagtaaaagatggccttaactcaaaaccaagtcactgtacctcttcactccttaatgttactctgggtacattgcatatgagccaaggcacttctataagtaagttcgaacgttaactaactgtaatgacgttaccctttcctgaaattggcagaaacaaaaatgaacatttctggcaacttttcgccatacagtcagtactcgttacggacgcccgggaaacaagtaggaaacatatgagaggccaaacaagggtaagaccttcttttctggtaatagatattacttcatcgcacaaagaagtctaattctggcgtgtgatgacaaaaaggtttaacaagacctgtttcaaaatgtttgcatatgttgattacagtatatataatagtacacaaacaccggtaacattttataatttttttgaattttttgtatacttttccaaccagtggtgcgctggtggctcttgagattacgtgaaaggcactgcaccatattatccctttgaagtttctggaactttgaaattatgggctcttccttcttcgtacacgctgttcagtactttctcaaagatagctttttctttcaggtggagatattttttgtaaagaatcaaggcagtatgggcatcttcaattgaatcgtgatttccctcttggatattcattcctaacaacacatatgccagataacgcaatgaaagatatctctttccttgtagaaaatatatggcagtgtcgcgaatttggtttcttgggacattaatattaatgtgtttgaagtcattattcaaaccatgaccaacaaatacgcatccgagctgcattaaaagccagacttttcgatatacaacgtttcttctcacaagccttttggtactcttttcagggtccaagtcaccaggaagaatcccactatatcttgtcaaatagtcttctatgtggttcgtgtttaccacataatcatcgacaaatggtactccatacagttctccttcttcgcctctaataatggatattctggccaaagcagttcttttaggtcgaataatacttctgattccttgatgatcgatttcacatagttcactttgtaatgagacaaattcggcatcaatggcaaccaaggttccagatttaggtgcctcatcatgtgttaataacttatattcacgtcttgcagtatctcttattccgtttgcgaaataatcacggaaaagtatgtcatagttgatggaatacgtatcaacagaaaagaaaggttttcgtaattcttccgcatcacaatatatgataatttctggtgttttccaagggtatgtcattttaagcgcctcttcctctgttatctcaacaaccaaataatcattaaacatgagccacttgaagcaattctcttttggattatattttttgacatatgttactagacgcgtctcgttattgttatcagtgattttagccacgtaaccattcaattcgtatttaaatatgtggcttgtgcccttcaattcggacgccgtcgatcttagaactgccttgtttttaatgatgcttccataaaattcactagttaaccagtttttcgacgaccttatattggaaaattcggtatctaatagtgataattctaatgacaacactgaaggtaaattcttgacagtacactcctgggtgatagtttcggttttgccgcaggttgggcaaatactgttcttttgggttacatttttcatggcatattcaatataaggcaaaatattctgtccattgcttttcttgttcaattgtttgattacggttttgttgattcctgatattgataaggagggtagaagtttgacggtagtgtcgtagtgatcacagctacactctgttcgtatttccgtttccaaaccaaagcattgatttagggtgatattatggttgactgtctgcgcttcctctttaataagttgcgagagcaggaatctgttaaatttttgaggcatattgcgtttaatactttcagaagaattaaaatcctcgatactttcccttatgcacagcgattctaaatactcttctaaatgttcttgtggttcaccgttttctaattgtcttttatcagttaaggatttcaatgacgcctgaaaattggaagaactacatatttttccatgtgatctttccatcatgtcaaagaggtagcctagatcagttagcaacgttgtttcaaaattctcgtctttcaaacacccaacaacgaaattaaacatttctggaataaagcgatacaattgtatgatagcatttgtgtagtgattatcaacatctggatccaatcctgaatactcagtgttattaaagggcgtaaaatcaaaattatcagtaccaaatctacctgatgtcagtggaagtctactgtatgcagggggtacttcgtacttgttgattgaggtatatgtctgtatatcgctggtttctaaaccgcttgttatctgtttccttatatctcttagacaaacgtaatctggtatagcatttctcataccgtatttggtgcgatcatatcttaacaaaggaaattcttgtgtgctcaacttctcattttggctcgagatcacagcaaggttactttttaatttgccgctcgatggtaagggtgacttacctgttaattgcggtatggtaccttcacttttaaacactacagggggccatgcagacaaaagtttatcaagatagtacggcatccccacagaactcaatggatatgtttcatcgtcgacagatattgggccgtcagaggtaatgtcattaaaataatcaggatatgctagcatttcaggggtattggtaaacattcccatgttgtttgatgatcttctccatgtatctaggtgattatcagcttctagtatacccaatacgtcaccattgggggacaaacataactttttaatcgactggcaaggatgaacatattgtgttcttaaagttggattggaaaggtcgatgaaatcaaacgaaccagaacttgaggcgacgatcataacagtaggaagcaaaggatgtaattgaacaaaatctgcgcctccagatcccatagttgttcctttagaaaaggaaacaggagggagttgacgcattgttctcaagtcgtaaacattcacaaatgggtcagcgtataagttataaaatcttttggacttccctactgtaaccaaggtgttatcccgtaaatccatagcggatatggatgcagagtgtgcattaaatgatttgatagtacgattcgatgttggatctagcaaatccacagtccctgtttgtcttccgatagacaaaactttattattagagcacattaacttcactttagatgagtaattcaagagggaatctaagcaacctctgttcaagtcaatggacgcaattccccaatttgtgttgtcaccaccacagtagatattgtttttcagtgaatgaggagaatagcacatagtgttcaattcgctaaatgcagcaatatcaatgctagtgaggttcaatttagtaacacctcttctattagcaaagtgtaaggaatcttcactaatagataaaataccatcccgatgactgagaatatccttcacggaatttccacctatgtggcccctatatcttgtataaagttgaaaagttggatcatatgacgaaatgcaaccatagctgtctccactccaaattaagtttgccttctcatcgaagctaatcgctgtaatttccttatccctattatcgaagcgaaagtatggcttcttcaaatgttccgaaagatcaactggattgttgaagaaatgttgccaattattcataatacattcaccattcagaaactcagtatagcaattgtgttctagtaatctcttagggtgtaatgcagttcaaaacaaaaaataagcaaataaaaaaattttcagaatgtaaaaattctagttaaaatgaacgtgtattatatggtaatgatgtgtctcttggagattctatttcttgtgttcctctatgcccacatagtacgttatttcctatatatgctaacgttaaaagcatgtttctttttcgttattctctcattgaaaaaaacaatacgcgaaagagaaggcgccacccgccccgttttaatacaaatagataaacacataacaaaacaaaggctaattagacactacactcagtgattaagtacttagtaaccgtgattacgacgtcccttgtgatatctaagtgggctgacaatgaatgtggatgaaagaagccggattgggggtagagagaaggatgcggggcccgggaaaggcattcttaagcagaaccaaagctcgcaaatgacttcaagctttctagagaaccctggtgttcgtattcctaccaggattataacaaaaaaagaagtattagatggtagtaacacgacatccaggatcaatacttctaatttacagagtatggtaaagagaagagtttcattcgctcccgatgttacgttgcatagttttactttcgtacctgaacaaaacaatgaaattaaggaaccaagacgtagaaaaacttcaaccaacagccctactaaaatatctagtcaagaagagcctcttgtaacgtctactcaaatcgatgatgctcgtacggaagaaaaaacagcggcagaagaagatcccgatacatctgggatggaattgacagaacctatagtggcgacaccggatagtaacaaggcttcacagcatgatcccacatcaatggaaatgactgaagtttttcctcggagtatcagacagaaaaatccagatgtagagggagaaagcattgagtcaagtcaacaaatcgatgatgtcgaggcagtgcgagaggaaacaatggaattgacggccatacataatgtacacgactatgattcaatttcaaaagatacagtagagggcgaaccaatagatctgacagaatatgagtctaaaccttacgttccaaacagtgtctcacgcagtaccgggaaatcctctgactatagcgtggaaagaagtaacgataaaagcgacctttcaaaatctgaaaataagacgaattcctctcagccgatggaaattacagatatattccatgctgatccacagaaccctatgagtctacacagcgacaataacatcaataatgatggtaatgagatggaactcacgcaaatacagacaaactttgaccgcgacaatcaccacattgacgaatctcccagcgaaaagcatgcgttttcttctaataagaggcgcaaattggatactgtctctgattatgctgcatcggttacgacaccagtcaaagaggcaaaggatactagtggagaggacaatgatggtgatttagagatgatggagaaaatgtcacccattacatttagcgatgttgataataagattgggacgagatccaatgatgtgttcactattgaacccggtactgaggatactggcatgcaaaccgcgacagacgatgaagaagatggggaaaatgtcgatgataacgggaacaaaatagttgagaaaacaagactccccgaaatagacaaggaagggcagtctggtatagccctgcctactcaagactacactttgcgggaatttataaatgaagtgggggtagggtttttagataccaaactgatagatgatctcgacaagaaggtcaatttcccgcttaacagctttaattttgtggagaatcaaaggatagataacgtattttctgccttctatatcgatatacccattttagaagtggaagcattcagatgcaaggagctttggagaagtattaatgaatccaaggataaattcaaggactttgaggcccaaattgataaatcccatccccctcttctgctccaggagtatttttcctcggatgagaaaatgaagcaattgatgagggaccagctacagttggtcaaaggatattcgaaattggaggcagcaatggaatggtatgaatggaggaaaaagcaactaaatggtctggaattaattttggcagaaaatttgaataccttgaaaagggagtacgaaaaattaaacgaagaagttgaaaaagttaacagcatcagaggcaaaatacgaaaacttaatgaagcaataaaggaagagataaggtccctaaaaaacttaccatccgattcttataagcctactttaatgaatagaataaaaattgaggctttcaaacaagagttaatggaacattccatatcgttgagttcttccaatgattttacccaagaaatgcgttcacttaaattagctattgcaaaaaaatctaatgatatactaactttaagaagtgaagtcgcctctatagacaagaaaattgaaaaacgaaaactgttcacacggtttgacttgccaaaattacgagatactctcaaaattttggagtcattaacgggggtacgctttctgaaattctcaaaggcaacactttcaattgcatttcttcaactggatgatttgagagtggatattaatctagcaaactttaaaaataatccgttaagttctatgaaagttatgaatgacagcaataatgacgatatgagttaccacttattcacaatgttgttgaagaatgttgaagccgaacatcaagatagcatgctttcgaaccttttttttgctatgaaaaagtggagaccattattgaagtatataaaattactaaagctcttgtttccggtgaaaattactcaaactgaggaagaggaagcgcttttgcagttcaaggattatgatagaagaaacaagactgcatttttttacgttatatcccttgtctcatttgctcagggcgtattctcggaaaatgggcaaattccaatgaaagttcacataagtactcaacaagattactcaccgtcacgggaagtcctctctgacaggataacccacaagatcagtggagttcttccttcatttacgaaaagtagaatacatttagagtttacgtaaagtgtttataataggacaacgatgactagtaatatctcatcacttttttttagtttttgacgaaagatttttaactgccccgccggcaggaaagttcaaacaatttgaagaaaagctcgaaaaaattttggacaaaaacaacaatcacatcaccattggaaagataaaaaattagaaagaattaactcgtttgttgtttcctgttacctatcacaattattattgctttttagaaccacaagcaaaggagaagcagtagccaccttatgtttaataaaagtgtaaatagtggtttcacctttggaaaccaaaacacatccacaccgacatccactccggcacagccttccagttcccttcaattccctcaaaaatctactgggttatttgggaacgttaatgttaatgcgaatacttcaacacctagcccatctggtggattattcaatgccaattcaaacgctaattctataagtcaacaacccgccaataattcattatttggaaataaaccagcacaaccatcaggtggcttatttggcgctacaaacaatactacttctaaaagtgccggaagcttattcggaaataataatgccacagcaaattctacgggctctacaggtttattcagtggtagcaataatatagcctctagtacccaaaatggtggtttgtttggtaatagcaacaataacaatataacttctaccacgcaaaatggtggtctgttcggtaagcctactacaacccctgctggtgctggcggcctgtttggaaattcctcatcgacaaactcaacgacaggattatttggatcaaataatacacaaagttctacaggtatttttggtcaaaagccgggagcttcaacaactgggggattgtttggaaataatggtgcttcattcccaagatccggtgaaactactggaaccatgtcaaccaacccatatggaattaacataagtaatgttcctatggcagtggctgacatgccaagatctattacgtcttctctatcagatgtgaatggcaagtcagatgcggaacccaaaccaattgaaaatagaagaacatattcgttttcttcctcagtttcagggaacgctcctttaccactcgcctcacagtcaagtttagtgagtagactaagcacgagactgaaagccactcagaaaagcacgtcaccgaatgaaatattttcaccgtcttacagtaaaccgtggctgaatggagcaggttcagctcccttagtagatgactttttttcttcaaagatgacttctttggctccaaatgaaaacagcatctttcctcagaatggttttaatttcctatcctcccaaagggccgacttgacagagctgcgtaaattgaaaattgattccaacagaagtgctgcaaaaaaattaaaactcctctctggtactcccgccatcacaaaaaaacatatgcaagacgaacaagattcatcggaaaatgagccaattgcaaatgctgatagtgtcactaacattgacaggaaagaaaatagagataataatttggataacacttatttgaatggaaaggagcaatcgaataacttgaataaacaagacggcgaaaatactttacaacatgaaaagtcatcaagttttggttattggtgttctccttccccagaacagctggagcgtttgtcattgaagcaattagcggccgtttcaaattttgttatcgggagaagaggttatggttgtattacatttcaacatgatgtggatctcacagcttttaccaaaagctttagagaagaactattcggtaaaattgtaatatttcgttcctctaagacagtagaagtatatcctgacgaagccaccaaaccaatgattgggcatgggttaaacgttcccgctataatcactctagagaatgtttatcctgtagataaaaaaacaaaaaaaccgatgaaagatacgacgaagtttgctgaatttcaagtttttgacaggaaactaagaagcatgagggaaatgaactatatatcctataatccctttggcgggacttggactttcaaagtcaatcattttagcatttgggggttagtcaatgaagaagatgcggaaatagatgaagacgatttgagtaaacaagaagacggcggtgagcaaccattaagaaaggtgcgcacgttagcgcaatcaaaaccatcggataaagaggttatcctcaaaacagatggcacttttggaactctatcaggtaaagacgactctatcgttgaggaaaaggcatacgaacctgatttgtctgatgcggactttgagggaattgaagcttcccctaaacttgacgtttctaaggattgggtagaacaattaattttagctgggtcttcactacgttctgtgtttgccacttctaaagaatttgacgggccatgtcaaaatgaaatagatttactcttttccgaatgcaatgatgaaattgataacgcaaaactcatcatgaaggaaagaagatttacagcctcttatacgtttgcaaaattttcaacaggttcaatgctactgacaaaagatattgttggtaaatcgggcgtttcaattaagcgtttaccaactgagttgcaaagaaaatttttattcgatgacgtctatttagataaagaaattgaaaaggttactatcgaagcaaggaagtcaaacccatacccacaaattagtgaaagctctttactctttaaagatgctttagattatatggaaaaaacctctagtgattacaatctatggaaactttcatctattttattcgaccccgtttcctatccatacaagacggacaatgatcaagtaaaaatggcattattaaaaaaagaaaggcattgtcgattaacttcgtggattgttagccagataggtccggaaattgaagagaaaattaggaattcttctaacgaaatagaacaaatatttctatatttgctcttgaatgatgtcgtaagggcatccaagttagcaattgagtctaagaatggtcatttgagcgttttgatatcctatttgggttcaaacgacccaaggatacgtgatttagcggaattacaattgcaaaagtggtcaactggtggttgtagtatcgacaagaatatctcgaagatttacaaattactaagcggttcaccttttgaaggtttattttctcttaaggaacttgaaagtgaattcagttggttgtgccttttgaatttgacactgtgctacggccagatagatgagtattccttagaatctcttgtgcaatcgcatttagacaagttttctttaccctatgatgatcctattggagttattttccaactatatgctgctaatgaaaatacggagaagctctataaggaggttagacaaagaaccaacgctttagatgttcagttttgctggtacttgattcaaacattgagatttaatggaacacgcgttttttcgaaggaaactagcgatgaggctacattcgcatttgccgctcaacttgaatttgcacaattacatggccactctctttttgtttcttgctttttaaatgatgacaaggcagcagaagataccataaaaaggcttgttatgcgtgaaataacattgttaagagcctctaccaatgatcacattttaaatagattaaagatcccttcgcaattgatattcaatgctcaagctttgaaagatagatatgaaggcaattacctttctgaagtacaaaatctactcctgggttcgtcttatgatttggcagaaatggctattgttacgtcattaggaccaaggctgttgttatcaaacaatcctgtacagaataatgaactgaaaactttgagggaaattcttaacgaatttccagactctgagagggacaaatggagtgtaagtataaacgtatttgaagtatatctaaagcttgtgttggataatgttgaaacgcaggagactatcgattcattaattagtggtatgaagatattttatgatcagtataagcactgtcgtgaagtggccgcatgttgtaatgttatgtcccaagagattgtatcaaaaatattggagaaaaacaatccttcaataggcgattcgaaggccaaattgcttgagctccccctagggcagccagaaaaggcatacttgaggggtgagtttgcccaggatttaatgaagtgtacatataagatataagtttttttatttttatttctaaaaaaaagaaaaatagtaaaacatggactgaagctaacgcttttggagtaattagtagcattatatatggtaaaagtgttcttcagtaggtctaagatttaaaggtaatgatatttatattataaaacgatttgacctctaatgcacttccttttattctttttgataaaatatactatacatcccccacagcatctcgcagagcctccacaacgttaagtacagcactcgaagctgggctgtcaggatagttatccaggaaactttcacccatgtcacaactcttgccaatcctcggatctaacggaacagaccccaaaaatttgatgcccaattccttacaaagtgcttcacctccacctgtggtagccttgaatatttgggactctcctttgcaatttggacatacaaatccgctcatattttccactagtccaagaatattgataccagccttcttacagaaatctatctctttccgtacatctaataaagctacttcctgaggtgtggtgaccacaagggcaccatctatgccagattctctcatatacttgtttattgaaatgtgctcatcagatgttccgggcggtgtgtcgattaccaagtaatcgagtttatcccaatcaacatcctttaaaaatttttttatcaataaattcttttttgaacccctccatataatggcggaatcgtcttctggaagcatatattgaatagacatggtggctaaattatcagtcacatagacaggtgtccaaccggagttcgattcatggacggtttctttaatgcagcctaacatatgtggcaaagaaggtccacatatatctaaatccatggcacctacttgtaaatcttcgtcagctgaaagtgcccaacttagcattgcggcaaatgtcgacttgcctacgccacctttgcctgataaaaccaatattttatgttctattcctgacaagttatctgtgatcaatggaatatctggatcagggcctttcggaagactttcacatatttctttattggcgcagccaccacaagcatcggacttacctgccatgtctgattctggaccaggacagtgttctggttccggctgattaagttcatactctgctggtagcacttcgtcgtttacatgtggtagtatctcagtcattcttggatatcacttatgtatactgttgttctcaaaaacagaaagacttcacgtttagcctagcctacgagttgttggacaaacatgttatttattattatatacaaaatatttctacgcattactaattacaccattaatgaatccgaaaaagtacccggaagcgtattttgaaaagccatattaaagaataataagatgaacggcagttttcgacgtgtcaatgcatagaactgagagaattgtgcattggatgacttatttatgtagggtgctatgtcccagctgacggagttcattagctgtatccctgtggttaatgaagaacaaaatgaagaagatgagcgtggcctctgtaagattcagattgaagatggcgctatgttggaaacattagatgagaacagtctttcagggcttagaatagagaaaatgttggtaagtgaaggtacaggaattttttccaaaagcagttttggaatcaatgatttgcgaatctttacgggagaaaatatcgatgaagagtctaagaaatatgtgtggtatgaactactcaaaatgttaactggtcacaaagtgtacattgcatcgttagacgaaaaagtcgtattcacaaaatggacgtgcagaatgcaagatgatgaggtatggaaagtagttatggagttggagtcatcggcgatcataagaaaaatcgctgaacttaccttgcatccagtcaaaaagggagagattgatttatttgaaatggcagataaactctataaagatatctgttgtgttaacgattcttaccggaatataaaggagagcgattctagcaatagaaatcgagttgaacagctggctcgggaaagggagctattggataagcttttagaaacacgtgatgaaagaaccagagcaatgatggtaaccttgttgaatgagaagaagaagaaaataagagagcttcatgagattctgcgacaaaataatatcaaattgtctgacgatgatgttttagattctgcgcttattaatacggaagtgcaaaagccaatttctgagttaaactctccaggaaaaagaatgaaacgaagaaagacggtagtagagcctcaaaatttacaaaagaagttgaaagacacaagtcggaggagagctaatagaaaaatatctaatcaatccgtgatcaaaatggaagacgacgattttgatgactttcaatttttcggactttctaaaaggccaattattactgctaaagataaactcagtgaaaagtacgatgatattacctcttttggagatgacacacaatcaataagttttgaatctgatagtagcagtgatgttcaaaaacatttagtgtctttagaagacaatggtattcaaatatcagcaggaagatcggatgaagattacggagacatttctggttctgaatctgagactgatgcaagtgcaggggaaaagaagagctccaaccatagtgaacaatccggtaatgatagggaaccttgcttgcagacagaatcggaaacggatatagaaacatagcctatttatgaatgaatgtaatatatggcaaagagtattatagtatcgcatcatttgagagaatactttatttaaatggcaaaaaatagttctatgtgagtgatcgaaaactcaactactcagattgaaaagaaaataaataaaactaggtgttgtatgaacgtgaaagaaatcgagagggtttagaagtagtttagggtcatttttcagtacattggttggcctggcttgagttgcaaccagtgccaagcatcagcgttggcctctctcttgtacattggttggcctggtctcaaatttaaccagtgccaagcgtcggcaacagcctctcttttcgccaaagtggtgttttgctctttttcagccgcctcagcaatagtggtgttgataaacaatagcccactggcggtagcgttactgaatggtaaaaaagctatgtcatgatcacctccgaaatccaagtatccaataatggcctcggctggcacctgagcgatatcttcatcggaactagcagtgacagaaacggccgctaaaataaaagtgagaaaggtagaaatgaatttcattttctccaatatgtgaatttactggaatttgatgcaggtgatggtagtaattatccattatatagaatataaaaacagatataggaaggacacctcaaactacaccagaatcaaggacagcttttatacatataagccctcgtctctgcgctgtaaagacaccaagtttcactaggtccacggcgactctgtactgaaacaactgaatatttgaaacagtaacgatgaatagtttggctcgataccttgaaaacaatcactacaggcgtcgcccagatgcgcacatcgttgctggcattgatgtaccaatgaagaaatataagtgacaaactttatgaaaagatagaaagaggtttacaagataagagaaaaattatgctgtgaagattagtaatcgaagtaactgcttattcattcagtgcatgtttttctaggaatgcgtttgatatgggacatacatcttactatgcgacattaccttttagggacatcaatgagcaagtgaacactagcaaattaggaaaacaactttagcacgcccaactgcgtactgaaacgcagaaaactatagagtttcccgaaacggtgacagctgagttcgctcaaataagaacaacaccatgtcttgaagcttcttctatagcgtagagtaagtagtgccttgtagccctaccgttttacaatgcatgaggttacccgcacttattatttttttctctttttttttcttagctataaaaggcagatcaatgcagcattcattgctttatttgactttcctttactatttatttactttccatttcttattttagtgttattttataacagtaacgcaaatttaacagccattcgtaacacgtacagtatctcgtcgaggttgaacccctccggggcgttcttgacccatgaagaatgtggattggtgttgcaatatatttattattggcttggactggagaacaaatttatcgatcttgggtgcaacagtctttctgtcgtctgttttttagcagatctaagggtttaccttcgtgtgcccggatgaggaccgttgcaaggattgataatacaactatatacatcattatcgtagtgaattgcacgagtaacttctcggcatggggtgagtaaattcatattatgaaagtaattaaacttactacctaaataagaggatatctatgtcttattgcttgtatatatgagtggcttggaatgctgcaaatactgtttaggaaaaagtagataactaaaaggtttctccttccttcggttgacgcaatttcttgttcgctggggttgccatttcctttctaagatcaagtaataaagtttccatggtgtaggctcttttccagtcacgtaaggtgtggaagtcagtttggacctcccccgtagttggattgacgcatggtagatttatcttggaaatgaaagtgacctttgggggagaatctggatagtttgggccacaatctatagaaagggaatagattctgttttcatgattactatgagggggccctaaaatagtgccgttccatttggtcatggtaatatcgtcgctatcagctaaaccataactacatgattctggaccaaaccctttttcacccttttctaattcttctaacaacctaaaatttcttggtctgatttacaataggacagtgagggtacatttcaagaatttgttagtatatgttgaaatccctttcaaaacttataataacatacacttttgacatttttgtgtaaacgctgctttcttctacgttgcatatacagaataagaatttcaccacgacatcgaaatgtaatgagcagagattgtgtaggaagttgatcttattttagtctcttatttatcgctaaaggagcaatgaaaattgatagcgtgttaccctaggaataattcctaacaattttttccatcttaaaatcgagaggtaatagtaaataatggatgtgagagcggcattgcaatgtttcttcagtgcattgagtggacgattcactggaaaaaaattgggactagagatctattctatccagtacaaaatgagcaatagtggtgggtcctctcctttcttggaaagccctggaggttcgcccgacgtaggcagtacaaatggacaaagtaatcgtcagattcaggcgttacaattcaagctcaatactctacaaaatgagtatgagattgaaaaattgcagctacaaaaacagacgaatatcttagaaaagaaatataaggccacgattgacgaattagagaaagcattgaatgatacaaaatatctttatgaaagcaatgataaattggagcaagagttaaagagtttgaaagaaagatcagctaattcgatgaatgataaagacaaatgcatagaggaattgcgaacaaccctccaaaacaaagatttagaaatggagactttaaggcagcagtatgattcgaagttatcaaaggtcactaaccaatgtgaccatttcaagttggaagcagagagctctcattcgctactgatgaaatatgagaaagaaataaagaggcaaagtgtggatatcaaagatttgcagcatcaagtgatggaaaaggatgatgaattatcttcggtaaaagcatctaagatgataaactcacatccaaactactccaccgaagagttcaacgagctcactgaaatgaacaaaatgatccaagaccaagttcagtatactaaagaattggaactagcgaacatgcaacaagccaatgaattgaaaaaacttaaacaatcccaggacacttctactttttggaaattagaaaatgaaaaactacaaaacaaattaagtcaattacacgtactcgaaagtcaatatgaaaatcttcaattggaaaacatagatctaaaatcgaaattaaccaaatgggaaatttataatgatagtgacgatgatgatgataacaatgttaacaacaatgataataataataataataaaaatgataataataatgataataataatgatacaagtaataacaacaatattaataataacaacagaaccaaaaataacataagaaataaccctgaagagattatccgggactggaaacttaccaaaaaggaatgtttaattttgacagatatgaatgataagttaagattggacaataacaatttaaagctactgaatgatgaaatggctttagagagaaaccaaatactagatttgaacaagaattatgaaaacaacatagtaaatttgaaaagattaaatcacgagttagaacaacagaagagtttatctttcgaagaatgtcgattactgcgcgaacaattagatggcctatattccgcacaaaataatgctttactagaggtcgaaaatagtgaaacacatgcgtcaaacaagaacgtaaacgaagatatgaataatttgatcgatacttataaaaataagacagaagatttaacaaacgaactaaagaagctaaacgatcagttattatcaaattccaatgatgtagaaacacaaagaaaaaagaggaagttgacaagtgaccaaattggtttaaattattcacagaggctcaacgaattgcaactggaaaatgtaagtgtctcgagggagttgagtaaagcacaaactacaattcagctactacaagaaaaattagaaaagttaactaaactaaaggagaaaaaaatacgtatactgcaattacgtgacggccccttcataaaagatcaatttatcaagaaaaacaaattacttcttctagaaaaggaaaatgcagatttacttaacgaattgaaaaagaataatccagcagtggaaacagtacccatttctgtttatgattcactaaatttcgagttgaaacagttcgaacaggaagtttttaagtcaaataaaagattttccagactaaagcaagttttcaataataaatctttggagtttattgacgttgtaaactcattattaggttttaaattggaatttcaacaagatagtcgtgtgaaaatattttcctgtttcaaacctgaaaaatatttgattgctgatctaaatgaaaacactttgaaatctaaccttgatgcagatatagaaggatgggatgatctcatgaatctatgggtggaagatagaggtcaacttccgtgctttttggcaacaataacattgcgtctgtgggaacagcgacaagccaaataagtgtatatacatttctaatagataatagtaatcggttttataatatgataaactcctatccgctgacataattgttggtcacaaaattcttttatctttcttcatcattgaccttttatgattcctttggtatgcaaaaaaaaaaaaattgtgttgaagaataaaaacaaattacagaataagtcacacatgatataaaaagaagcccagtttttcatagctattaagggggcataaatgcacttatatgagggaaggtgattctaattcaaaaaaatctgcggatgttgctgtcctctccatcatccttacgggttcgaccttaacattgatctacacatataaaaggtatttaactcaattcaaaagaacaaatgatataccgcgaagaatatttcgtaaacactggctttatggtaaagtcacgtctgtaggtgacggggacaactttcatttctttcacatgccaggtggtataagaggtggatggggatggttacgacccgtcccacaaatgatcaagaatgattctacggcagaaaagcttgttggagatagcagaaatatgaggtttttcaatttcaattggattacgcatgggaggtccaccaaaagtaaaatacaaaaagctaaaagccagttcttgaagctaaatgtaccttacaaaaataggaaaaacctgccaactattcctataagattatgtggaatcgatgccccagaaagagcacatttcggtaacccagctcaaccgtttggtaatgaagctttaatttggttacaaaaccgaattttgggaaagaaagtatgggtcaagcctttatctatagatcagtacaaccgttgtgtagctcgagtgtcatactgggactggtttggtgggtggaaagacttaagcttagaaatgctcaaggatggattagcggttgtttatgagggtaaagtaaacacagaatttgatgatagagaagataagtatcgatattatgaatttttggcaagatctagaaaaaagggactgtggatccagaataaatttgaaacgcctggtgaatataaaaaacgtatttgagttttcgagaggatttttatccatcatactgcagattttcatattatatgttcattagcttttcacgcttcctctcgatatttttttatttattttcggtttcatttttgtactagtagataaaaatacatacatgatagcagtgttatacaattgatattcgtaaatttggcattcagcattttaggtaaattccgtgcctcttttcttcttctctgatttcaaacattatttgtactgcgatgaataaactaacgcttgccaaaattacaaatttgaaaccagatacggtacagaacatatcgcttagtaattttttagtaccgtcagagcccaagcagaatccaaaaagattagcgatcatcataacccatatgttgaaaacagcaccgacagcgcaaacgtgtctgtaccagactgcgtcggtataatgagagaaaatttgggtagcaaaaatttctggtaagaggaacaaaactattagccaaccccataataataactttagttcgatgtcatgccatatagctacgaaggaaaagactgctagtgatgtcaaaactctattttttgaaccacctagaggaatatatatgtaacggacaacccacttattgtagcttctatgccaagctctccagaatgctagtgaactgtaattgttatcaacacacctgatcatattttcaggtgtatcgattccgtctagcaaagcccacagcctaaacagcctccacggaatcagtagttttagccaaataatattcaaattaaataagccaatcatggaaatctggaaaggtgtgtcattttcccacgctttggtttttgagattgccacaacgtggagaaagtgtaaaatgaactccatagataagagagcaataacgaatctcaccgcatagtaaaaaatgaatttgaaatttattgatggcaaggtatgtttcgattggtaaacataatcattgaatgttataatggggccggcaatgaaaagtggcgtgtaagtaacatatgcaatataattcattaagctgtagtcctgtatggggtgtgcagcagttaatctagcacgttcattgagcaaaatggctgatttagcttcttttgattcataggatggacttttcttcttttgtaaattctcccacctctctaagaagtccaagttgtaacttaagactctcaaaagagtaaaattgaaaaagacatcccatcttggaatgatacctctataccaatggtccaatgggcttaaaaaagagcaaatattaccaaatggatatgctctgaagttgtcgttaataaaaagcgtagaaataccataaatccaaatgctgatggtggctattcttctaaagttctttagtacatgggcgatggcatataaaattagcatatgggctaaaattcttatcgaattgacaccatgagcggccactaaaaagatcaaaccaaatatcagatcaaacctcaatttagtgatatttgttgaataaagtacaatgcgttttatagaagtgtggactagcattaaaactgacaatagcgcaaaattgtccctgaaaaacctatattgagaatcactattgtctacttttctgccaaataaccaaccttgagataggagacgttcgtatcttgcatagtttggattttcgggcgaactagcttgtaacccagcatagaacatcaagggaaccacgaccagaaatgcaatgtagtagaatttgaactcagtagttttccatagtgatggcttagtggtagtagaggcatccttttttggtgaaggtttgattcttgaatctaagccctcggaagtaattaggggagacaggatgctgatcagcgacatttcttgcaattgtctgttaacaaatgctgattcacgctttgtttttgcctttgtatgattaacatctatatatcgaaagcaatatgctaagttattattcttaccctttcagtgtcctttttggcacacccactaaacataaagagaaatacgtgaacacctatacaccctatattattttgattgttcaacattgcttgattcatcatccattctccagctctcgaatcttgtttctggcttttccaagattatgtgaaaattaacttactctttttggtcgataaataattacaagttcaagtgcatgtctaattggaaacttatttttatgtccgattgagctgatgttcagctagtttatgtttatacaagaaaaatgctcacccgtacatatgctccttcttcactcattttcttgtcctgttgttgagacattcaactttgatcctgctcttgtacttttatgattcattacttatatattggtcttcattattctcgagatgaaattctcagggtcttttaaaaaaaaagtttcagtaggaaaactaaacgtaattaaactattcttcggttcgaacctgaagttgcgtgaaaaaaagggtactgcagtcttgaaaaaatagaagccaaaaagaagttaatatcaaaacaaataaatcttgcacatattaaagcgcacaaaagtattcaaaacagtgtaacttcgaatatcgtatcattaaggaaaataggacacactttgattgagcagggatgatgttttggtcctcaaagacgggtatcacgtcaaaatattcattttcatcatcacctactttcacagctgaaccatggagcatttacaccggtcgtcccaaatcttcatcttcatcttcaccttccaaagtatcgatattcatgtttgacaagaagcagttcgaaaactatttgttacactatggtattattaaatccaaatctggatccagagataaagtattaatacaagaagcgtacgaaatattaagaaaccaggccaataacttggccaagctcaagcacccaaatattctgactttaattgaaccattagaagaacatagcaagaatttcatgttcgtcaccgagtttgtcactagctcattggagaccgttttcagagaaaccgatgatgaagagcagaatttcttacaaggtcatgttaaagataatatcgtggtacagcgaggtatattgcaactggtaaatgcactcgattttgttcataaccgcgcaagctttgtacacttgaacattcaacctagggcaatatttatcaatgaaaattctgattggaaaatttccggcttaggctatttagtaaaaataccaccaggcacaaatacctctgaatacttcttacctcaatatgatcccagagttcccccatttatgcatttacaattgaattatacggccccagaaattgtttttgagaataccctaacctttaagaacgattatttttctttaggattgttgatatattttctgtacactggtaaagacttgtttcgcagcgaaaattcgactagtgaatataaattggagtacaacaagtttgaaagcaaaattagtacaatgtcatgggataatatattcagtaaggttccacaaaagttgaggcattgtatacccaagctaataaacagagacatctattccagatatgataacataacgttgattttagattctgagtttttccaagatccgttagtcaaaaccttgaattttttagacgatttacctaccaaaaataacgaagaaaaatacgtattcttagagggtctcgtgaatctgctgccagagtttccgccagcattattgcaaaagaagttcttgcccattttattggaactattaagtcagttttgtgctgagaaggtcgtaagtgataaatgtgtgggtaaaagtttggatttgataatcaagatagggtccactttatctcagttgtcctttcaagagaaggtttatccagttttattgagtgatgcgaactttccagtattattaaaaaaagccaccatctgcctgatcgataatttagacacattgaagcaaaaagttaaacgctctgatttcttggaaaatatactcaagccgctatttaattatgttttacatgactccgaaagtgacattaccgtggtttgtcaagaaaaacttttatcacaaattccgttagctttagaggtacttgattttcctaccgtgaaacaattcttattaccattactatccaatctatttacaaagacaacaagtttaacggtgaaaaacacatgtgttacgtgctttcaaattatgatagagcataaatccatcgattcttatacttgctcagaaaccgtcttgcctttgtttaagtccatgaaaacaagagatccaagaattttatctaagttattgaagctttttgaaacggtgccgttgatcattactgatgaaattgttcttgttgaccaagtactgcctttgatgtggaattattctatggcttcaacgctaacaaagtcacaatattcaggatatacaaaggcaattaacaaaatgtcttcagacatccaaaagcaccatatcgccaaattggatgataaagtcaatgatattggcgaagatgcctttcacaaagtcattgaaccaacaatcatgaagaaggaggaccctgagacagttgcagctaaaaatattgaagtagcagccatgcaaccagttaaaaaaaagactgggtcctcttatggggagacattaccacaatctaaaagtattttaaactccaaacccctaaatcctaaaaatgcccttgcaactagaggctttccaacaaggattctaaactcccctccacagaccccatcaagtcgaactggttcaaaagttatgaccaaaggtggctccaacgacgcttcgagcactaaggtggaagaggaattcaatgaatttcaatccttttcaagcacagggagcatacgtcaaacttccgcaccatcagacgtctggatgaacagtacccccagccctaccccaacatccgcaagtagtaccaatttaccgcctgggttctcgatatccttgcaaccaaacaaaagaaaggatggttcttctgatattccccgaagtaatgtatatggatctttgatataatttgtcagcctcccgaagatgaagatatcttaaattggcttgaaacgaacgcaccacgaagtcagtggttctttgtattagtaaataaaccaaatataattttgtaccttagcagctctttcgagaaattcattttcagtttagtaggcctgactgacaagcaaattgttcttttttctggacggtgcgggatcaggggaatcacacgttcaataaataaagaaaggatgaaacagtcgtacaacaaccaaacatgaaggaggtacagaggaagcaaacaaaaccaaatttgctaaaatcaagactggggcaatttttcagtccgtatacaatcgttcacaggaattagccaatatggatgttacatttctaaccaaaaatgttcaaataaatggcactcagtttaaaatattacttcaaaatgggcaaggtgaatgcgcgctaattgcactagctaacgtattattgatatcacctgcccatgctcgctatgcccaagaaatttccagactagtgagaggcaaggaaactgttactttaaacgaacttgtgcaaactctagccgacatgggcgttcaaaatccgaatggtacagatgtggacaaacaacagctactccaaatcctaccacaattatatagcggattgaacatcaacccagaatttaacggatcttttgaggacggcgtagaaatgtcgattttcaggctctacaatgtcggcatcgttcatggatggataatagatggggacaatgatccgaactcttacgaacatgtgtccaaatattcttatatgggcgcgcaaaaagttttggtacagtcgtatgagatccaaaagaataatgcccaatttgaaaacagcgagcaaatccaatctgatgcaccttacttaaaatcgtttctggcaagatctgccacacaattgactgaatatggtctaactcatctcagagaaattttagtagaaagatcgtatgccgtgctttttagaaatgatcacttttgcacattatataaaaacaatggcgaattgtttactttggtcacggatcctacttacagaaatcgcaaggacataaactggcagtcgcttaaatccgtgaatggatcgcaggattcttactacacgggcaacttcattcccacaagtctggaaagaacagaaactactgctaccgggcaaaatgagtcctacatttctaacccattcagtgaccagaatacagggcatgtaactagcaaccaagttaatagtggagcaagcggtgttcaacaaatcgaagatgatgaggaactagctaggaggttacaggaacaagaagatatgcgtgcggcaaataacatgcaaaatggttatgctaataacggtagaaatcatcaaagggaaaggtttgaaagacctgaaaaaaattcaaagaaaaacaagttccttccctttaatgggagtaataaagaaaagaaaagagacaagttgaaaaaaaactgtgtaattatgtgaaaccatgatttctttttcgtcttttgtatctttcttatagaattattttttttgtgggtgtcaccacgctagcgcttatttttaactctaccactttttaattttgtaaatgtatattttactccttcatggcgttcaactggcctatttgtgatatataacctgataataccaatgatttatttttttttacagattccttctcctaaatttgtccaaacaaaacggctcaagaagccccgaataatgcactacagcggaaattaacatttttgggatatcttcacagaatactaaagcaatcaaagtggctcatagtattgagttttacaaattacttgaaaaaaaaataatcactaggcagttgcataaagttgaaactgagggaaggaactggggaaatcatgggtgatataagaacttttgttttcgctatagaagatacggaaacaacacaaggtttgtgtaaaaccattggccgttcgagttcatttgatcaaaatagtctatgtaagccgtacaatctatattttgatgagccagaactaagcagacagcatgctgtcctatgtataaagacaccaatacccaaaattgaaggagttccctctatagaacaactccgcatctgcattcgggatttgaataacaagactggtacagtaaacttagtgtctgatgggccaaatgatgaaattgatttgaaaaatggtgatgcttttggtttgattgcaattgataatcatccttttcgcgacaaccatcatttagccgccaagttaattttccgaattgaacttgagtatttcgatgaagcaagggaaatcgtaaagtgcactattacaaatgtaacatttggaaagaataatacagtgtcatctttccctattcattctgcaacatccacagaagatagcgattcaagttggtacggattgtcggaagcgagtacgcaaacggaagttgcagatgagtgtcatgaaacgaacaccatattgactcgaggtggtaggttttctatcctttcgttgagaaaaagaggcagcaagcaagaccagaagatctgcagtaactttgatagaaaaatacatgaaacgagttctttcgaagaagaaatcgaagtttgcactgacacagacaccacagaagaaaaagaagaagaagaagaaaaagaagaaggggatgatgaggaaggagaaatagaacttgaaattattagagtaaaaagaataaagggcaggacgaagataaagaagacgcttacttgcttctcgaaaaacaagaaaattattacccctcagcactccaatagtatgtggttactactaatagtaatcttgatttttgaccgcctactatcgaattaaatataattttataacccagttctatattgctgggtggtattatagcttcatggctagtcaaataagtggagttttttgctctggacgtggcctgtaaagttctcttttgcgacggccccccgctttaaccgaggcgaaatgacaagtgctttctggcaaagaaggaatagccactacaacctgcggtctccacctttctccaccgataatctatttaaacactcacttgccaatcagcaaacgtcaatacatctacatatatacgtatagattttattgcactgtgatcaaaaagaatgtctcaaccggttcaacgcgctgcagcacgctcattccttcaaaaatacatcaataaagaaactttgaaatatattttcacaacacacttctggggtcccgtatcaaatttcggtatcccaattgctgctatatatgatctgaaaaaagaccctacactaatctctggcccaatgacttttgctttagttacctattcaggtgttttcatgaagtatgctctttcagtatcacccaaaaactacttactgtttggatgccaccttattaatgaaactgcgcaattagctcaaggctataggtttctcaaatacacgtatttcacaacagatgaggagaagaaagctctagataaggaatggaaagagaaagaaaaaactggtaaacagtaaaacgagcagtctaagaacctgaagtaggtgactagatggaaacataaaaaagaacaagcaaggattaagaggatggatatgttcatgcatattctctcatttttacctcttctccttttcatatatgcatgctatagaaccattatctctatgagtttcattttatttagtagttagtattgaaccaaactacataagatgacatattctaaataacctaaataattattatgtctttattcaaatatttcttttatatccaagacaatttccctctcatctcctttgtattactgattatattcagccattcaaaaagttaaaaaagaacgtttttcactgaaaagtcgcagctatattatagtaaaataataagagaggcaaaataatggttaccaacacttagtgaagaacaatggtgaccggaatatcggaggaaaatgatgatgaagagactttttcggctgttcattcttcaacacccagtattaattctcaatcctacgcgattcctataacagaggaaatgtccagctctttccatgattcgatcagcaccactagcaactcaagtggtagcttcgatagtgatggaagtaacgtttcagatgttgtggagcaaaatgaaatggacaatgaatctaacgttgacgaagatttgttcctagataacgatatccctcagtcaagcaatttgctacccacggatgcccaggatcctggtccaatatttgacgtttctagatatatttttgattctctaaaacaatctattgattctgctgatttctcagaggcactttctctacagaccaaaacctccgctgttataaattcgaaaagcctagagcttaaacaatatattgatgaaatgaagagcaggctcactcaactgcaagagaagtttgaaaatggtgaggctacttcaaaaaaaataaaacgtgatttagaaacttcaagaaagaacatcgactatttaaacgctgctttgcgtgtcgatttccccatagagtttaatcaggcaagagaaaaaattcttgagcgcagattgaatgaagaccatgactgctgatatactgaatcgtattttttttctagaaaatatgtatactatgtgagagtcaatttaaataatattaatgataaatgaaagtgggcagttataatagtaatatacagtgttttgttaataaatctccgactctcgattggctattattagagaagaaaatccaagattgaagtaaacgaaaaaacccctaatcgaaagtaattttttttggtttcttagtcaaatcgacgtccttaaagaatgaaccataagcgctatgttccttcttcttagtgtgagtaccgaactttatcaaatcttcaggaacaggttgattggcaccattcaaaacgttaaccagtccaccagccaaatgcttttcttgttcagtgaacagagtgtgtgctgtgcctgtttgaccagctctaccagttctaccgattctatggacataatcctccacagtcaatgggaaagttaaattaataactgtcttaacatttggtatatctaaacctcttgctgcaacgtcggtggccagtaacaagttagacttcccgcttttgaactcattcaatgcttgcgttctttgttgctgggacaaatcaccatggatagctgcgacgttatacccgttatatttcaaattcctttcaacacgagcagcttccttcttataaagagcaaaaatcaagaccttttcattcttttttggaccagagtggtactttttcaacagttccaataactttctttcttttccacgtgggtccaccacttcaacaatctgtgtaattcttttgttagcagttagttggtccgtgttaccaatagatactttgattgggttgttcatgaacgtggaagctaattcacggacttcctttggccaggtagcggtaaacattagagtttgtcttttggacgcatcagtttctctgataatattcttgatgtcttcttcaaaacctttttccaacattctgtctgcctcgtctaatactaagtaattaacttgagataagtcaacagatccttcctgcaataggtctaataatctaccaggtgtagcaaccaccacttgtgacttttttaactgaattctttgctcatcctttggaacaccaccataaacacaacaacactgcataccaaccttgtcagttaatacaatcagattatcataaatttgggaagcaagttctctagttggggaaatgactagaacctgtatgccccttttcttttgatcgttcattaaatggctgatagctggaacaccgaaagcaaatgttttaccagaaccggtctcagcaacaccaacaacatctttaccagataacaaatatggccaggctacggcttgaataggcgttggttttggaaatttggaaatttctgcttgaatggaagagtctaaagaaagataatcaaatgataatagcggacgtagggctagatccagagaatcctcaacagcaatttcattttccttgaaatattcgtcaatatcagattgtggaagactggttagtgcttcactctgaacataaaactcactagccactgcagaagtaggttcaggtttcttttcagattctttctctggtacttccacttccttctcacccttcttctccttcttatgctttttatgctttttatccttcttttccttcttgtctttcttatcctttttgtgtttcttactcttctttttttcaattacctcctcatctacaacctttctcttcttgtctgcgatttcttcctttgtcattttaatcccctatatatcaaactgttaatacttatgctttcgttaaaaggctgtaaaatgaagttaagctatatctctgagctgctatattgttgcctatctattattaatattttttttttatttgcttcttatgcgatgaggtgaaaaatttttcatctttttcccgcaaaaatatttcaagaaatttgaattacagtcacatcgctttcaagagcgcaaagcctgagggatatttaggttgaaatatcttagtccctcgtctaaaatggcttaacaaaccattaaaaaaaattcacttttattacttctatgcaaataatatacttaaaataaataacggtcgactgatcaacactataaattcacttctttccccacggtacgtgttcattttcgagttcaacgtcagaggccgcaacggaaaattctcgactatcttcaatggtatcgaagttattactatattcagcctgttcgttctcagattcttctaaagcgtggaattccttcttacccttgtatttccagtaaagaatcgaatacgcagtataaccaacaataactacacaaacatagttcatgttatcctttgtcacaggtaaaactggtggaaaggaaaaaaagaccacagaaaagacagtccaacccaaaagaacaatgtttgaaaaaaatccaaattttccaagccagaatggaccatgagctatgttacgctttttagcaagtaaacatataaccggaatgatgtaggataacaataaaaatgcaatacaacctgtaattaaggactgaaaagccgtactggaagccaaataaagtaggccaatgagggttatccaagcgcatgacattaaatgagcgttcaaaggtacaccagtgtgtgggttaacttgcgaccataaacgggataatggaagaccattgtccctggcaaatgaccaacataaccttgcctgccaagtgtgacaagcaatgacgcaaccaaaagaggtaaatagaatcaagcaacccaggaaaatcgcacctgatttattacccaatgcctgattataaatgtccaagattggggcgcctgttgtagaagacaagacagcgtccagatcttgtatagagaagaacatagcgataacataacaaaaggaagtgacaaacccaatggcgactgttcccatgatagcaatgggaataactctttctggtttttcaacttcaaacgccatatgggttgcacagtcaaggcacgaaaatgaccaagctgggttaatcaaaccgacaataaaggcgataccgccgttcttccaacctgtttcattattaaatgtggcaaaaacaaactttgcatcgttgaactttccatgagaacatgccaatacagtaattgtaattgtgaaaaaggatagtagggaaatgtatagagaggaagatgaaatgataggtaaggatttaccgtaacagttgaaaaacatcaagaacaaatgcaacaattcaaagcaaacgaatatatgccatctctttgggatgaattcagggtgcgtcagagcgtacataccaaccacttcggtagcaacggataacgtagttgaagcacttgtgaacacggatcctgcgtaagcaaatgaaccgcacatgtaggccgcaaatcttttgtacttaggaggggcaagcttcaaagaccaccaaaactgaccaccggcgtgcggatatgcggaagataattcacccaacgaggtaccaatgcaaatagaaatcagggcaacaataattataccgtaaacaatcatcatgggtccaccagaagatatacctgcaaccatcgatgtagaaataccgaaccaggaattagtcaaaccgaatccaacaccaagaattgaccacaacgaaaatgactttcttagatgaacttcaccatctgctgctacagcacccttgctatccatatcatccaatggctttatttcctcctcaactcttaagtctcttttgtgcatagaagcgttcgaagattgatccggctgcatatagccaccggaagcattatcattccgaatactcatcgttcttcaaaatactaatttctgagtaaatgagccagttaacactgaaagatattctttctatggaagttcgaagatattataatttttctttatgcaagctatatatgataagcacagacaccttctttccaattgttggtattcaaggcttttataaataagttggctaactttcgttgaaatatcggcagtttagagaagtcaaggccgcttatcttcagttttcatttttttttttttcgttatataggttctgcgcatgtgaaaaaaaagagaagaaaataaagccaattataagtcattactgacgaaattataagataaattagaggtacaatatacaaactagtgaataacagaactatataggacttagataaaataagtagttatatgtaatgtgacttcaaccagtttagttcatggacttaaccaatttgttgatgaattcttcacggttaccgaaagaaccaccttggataaagtgcttgaactttcttgggacaccccaaccaccagatgggttggacaacttgaatggccacaaaaagttgttagcttgcttgaagtgtggaccaacagtgatgatttcgtgaatcaaatcgtcaatggacaagataccatacttacccaagttggcttcgatgatagcattgtcggacaatggaactctttgcttgttgatcttaccgaaacctctcttgtagaccaattgtctaatagtagagtacgatgggtaaccgtaagcaacgtatggttcaatcaacttcaatagttccaaagtagccttggtaactttgacgaatgtaccagagttgattcttgtcaatcttagcaattgtagaacctttcttggcttaggtgggatcttgttaatacccttgattctgacaacgaagaccaacttgtgttgagcttcgacgtagtaggaaccagcagccttggcatcacgcttagcttgaatgatgtttctttcagcagtttcgtattccttttggtaagcggcgtttctttccaaaataatggctctcttttccttgttagcctaaatgaaaataaaaagtaaaaaacagtaaattgatgttagtaaaaaaataccagatggaaaacacagtattttatgctaaaaattgttacacggcattatcactcaatggtttttctgacactggaaacacggcaataattgtaaccttaataccttaactctctggtctattttactttctatttcttttcttataatcagtcgaaagatggtgataagttacgacagcatcgtcaatgactagtcgaatatgtattgggatacaatggattttcatcataaaatgagaaaacaaacagaacgtaacaaatagtccattagcctaatgataccacaggtgttgagaatattgcaactgttcgaatgatacttatcaaaattggcgacgcacgtgaactcacatatatcccagtaagaaaatgtgttgcagcataaaatataaatgtaagcaaaagtttaacatacagccttacgagcagctctttcagcagcgacttgttcagcagtcttttgttgagccttagacttcttcaactgagattctggggtcaagatttttctgtaataatacaaataataaaatatttttgttagcataaccgaaaatagaatgaattaggtttgtatgaccatcaagtaaaacttttttctacgaagttacatcgaattgaaaacaccacttttcattcgaatgaagggagtgaaacagagacacttaggaaatgaaaatttgagaaaatattctaatcaaggtcggcgatgaaatttttggcaacaatcaagatatttcaaatttttcctcaaattcatcaactaaaattgtctttgaccctgtgaaggtaatcccctacggaaaatcatcttgtgaatagtcacaagttgaagataaatgtaagtgtgagtgcaaatgctattagagcagaattgctcctttttctcaacgtaacttgcggaaactagtatacttctctggatactttaggaaatagtaataaaatagacgatttcgtatacatactcagcggccattgtgatcttaatttgcttggttggttatttggatttatatgaaccgaagacaatacaaggcagatctagtgtcttgattatttcaatatttcagaaaggatgaagttgtcaaagtgatacagatacagatggcaatgattctcagaagtcgcgtccggcagcgacaaacctgcagaaagaatttcagacaaaatttgaaaaaatatatatatatatataggaaaggtacggatttatagatatgtgtgggtgtttatatgatcagtagctattctctactcaactgatgtgaactggagtacaaattatgcaagatatttttttggccaagctacaaacgtaatacgtagaagaatggataaaatagatgtattaaatatcagccccgaaagatggtgtaatttaagttgacaacatcgcaattttgctagtcactttttggaatgccagaatcggcagtatcatcactaaataaatacatctctttatcctattcctcatcttggatagagagtttacgcatctgagctgtaacatgaaatatcacatgaactcatatgagatataagacattagctcgttattatcaacgctgccacgcacattattttgtgttatgcatatctaaaataataaaacctgtgctattataagtatatatttttgtaacaaaatgagaaaagaccaaggtaaagaatgtgttgctgaaatatcgagttcatcctttttatacttcgaaaggcggtttttttctcgttcatcgcaagggtgacggcagatgtaaaaaaaaaaaaaaaaaataaagttaggactagcgattgtcgtagacgcacatcaatgctgaattattttgaattgaaggatatcatgaacggtttacgtgactattttcactgtgtatgaagtggcacggtgcaaaggccaaggtttaaatgccgaatactctactatatgcgtcatccacattggcatttgaacggtattcagtttctaaatctgtctgatcttcaaagaaccatacaatcttgcttaatatgccactattttcccaccatgataattgtaaccttgagttttgggatggtgtgtcatgagcatatacgtattttctaatgtatggtaggacacctgccagtaaagcgaaacagactataattcttattgttgcttttacccatatgttggagggaaccgcggaaataaaattcttgaaagtcccatcaccatcagtggttgcatgttttcgttttgaatgtgataccttatcgttactgcaattgagccccctttctcgccgtatttgatcctttaggaaagatatggtgtctgtttgtctctgtaatcttcttctaaactcttccagaatggctttttgatcgattcccgttaccagaggtgatcctgggtcagatgttctggagctattttgattatcttccacttgtctagctttctgtaagtcgctgaaccgctgttgtatggaagcatacttttcttgataagtttcgagccttattttcaattcgcttacttgtcgttcattttcctgaaggaggctttgtttcgcagttagttctcttttcaattcctccacctgcacctctaaggcctttcctatattattcctgcttaacagcttgataggtgattcagtaagcttcttcctaggtgtcgaaattccagccccctctgtattcttgttcttgttctcaaccagaaatttggaaggtgaattcaaattcatgcttacgataaaatcacttggaatagaatctacaccaatgaacgcgttttctaagatttccctgagggggtgattaaccaaattgaagaagatatcgtcaaattcttctttgtgtattttaaagaaggtttttgtattagaaaacgtgcgaaacaaatctttattgatttctgaaaacaatggcaatcgaagctcataggaaccacttttctgtgccttttgaaagatattctcaattatctcgattagctttggcaaatctttaccatatataaagtctccactgatgggtttgtcaatttggccccatgcgtactcaaaaatagcatcaaacgcaccgttactcatacttacgttgtcaaagacagaattgtttgtaaagctttctttcttaaccttggagccgccaaaaaaaatactccactaaggccagtagcaacaacacgttttcttggatgatgcgttttcttgaacaaacagtaccgactaggactgtttcaatgaagttgtgtacggtctggtagtatatctatattccgtgatgcctttgtggaggacgttgagatgagactgagtcgtacaccatgttattcctgtttacggttaattgcgcgtcgcgctttctctagcaaatatctcggttcgaagtaaagcaggtccttcatgtaatggtaacctaaggcaaagggtttgtcatatacccgtgaaggcatttacacaagcgcacttctagtcatatgcagttcatgcatattaagtgagtgttataacgcaagagttatatttgaaatagggttgttaaagaagggagaacccattcaccacattatctttgcgagtgtaaaactagataacttaaatttttaggagagattttgccacttggcagcaaataccaaatagcagtactgttccggtagataaaggcaaagagttagaggtgtgctttacgaacagcgctggaagggaaaggaaacaaaaaagacaaaaagacagctgtattgttggcgccatgaataatgctgcaaatacagggacgaccaatgagtcaaacgtgagcgatgctccccgtattgagcctttaccaagcttgaatgatgatgacattgaaaaaatcttacaaccgaacgatatctttacgaccgatcgtaccgatgcaagtactacatcttccacagccattgaagatattattaacccctcattggatccgcagtcagcagcatcgccggttccttcttcctcttttttccatgactcaaggaaaccttccaccagtacacatttagtaaggagaggtactccattgggaatttaccaaaccaatctatacggtcacaatagcagagaaaatactaatcctaatagtacattattatcttctaagttactcgcgcatccaccagttccttatgggcaaaatcccgatttactacaacatgctgtgtacagggcacagccgtcaagtggaaccactaacgcgcaaccgcgccaaaccacaagaagatatcaatcccataaatcacggcctgcatttgttaataaactatggagcatgttaaacgatgattctaatacgaaacttatacagtgggcggaggatggaaaatcttttattgtcacgaatagggaggaatttgtgcaccaaattttaccaaaatattttaaacattccaatttcgcttcctttgtaagacaattgaacatgtatggatggcataaagttcaagatgtcaagtcaggatcaattcaaagtagttcagatgataagtggcaatttgaaaatgaaaacttcattagaggtagagaagatttgctggaaaaaataatcaggcagaaaggttcctccaataaccataatagccctagtggtaacggtaatccagcgaatggtagcaacatccctctggacaatgccgcaggaagtaataatagcaataataacatcagtagtagtaattcattttttaacaatggtcatttattgcagggtaaaacactaagattaatgaacgaagcgaatcttggagataagaatgatgtcaccgcgattttgggggaattagagcaaataaaatataaccagattgcaatttccaaagatttactaagaataaacaaagataatgagttattatggcaagagaatatgatggccagggaaagacatagaacccaacagcaagccttggaaaaaatgttcagattcttgacatctatagtcccacacttagatcccaaaatgattatggacgggctgggagatccgaaagttaataatgaaaagctaaacagtgcgaataacattgggttaaatcgcgacaacacaggcactatagatgaactaaaatccaacgattctttcataaacgatgatcgtaattctttcaccaatgctacaaccaacgcccgtaataacatgagtcccaacaatgatgacaatagtattgacaccgctagcactaataccaccaacagaaagaaaaatatagatgaaaacatcaaaaataacaacgacataattaatgacattatatttaataccaaccttgccaacaatctcagcaattacaattccaacaataatgctggctcgccaataaggccctataaacaaagatatcttttgaaaaatagagccaattcctcgacatcgagtgagaatccaagcctaacgccctttgatatcgaatctaataatgaccgcaaaatttcagaaattccttttgatgacgaagaagaagaagaaacggattttaggccttttacctcgcgagatcctaataaccaaacgagtgaaaacacttttgatccaaacagatttacgatgctctctgatgatgatttaaaaaaagattctcataccaatgacaataaacacaacgaaagtgatcttttttgggacaacgtacatagaaatatagacgaacaagatgcaagactccagaacttggaaaatatggttcacatactttctcctggatatcctaataagtcgttcaacaacaaaacttcctcgacaaacactaattccaatatggaaagtgctgtcaacgttaatagccctggtttcaacttacaggattatttaactggagagtctaattcccccaattctgttcattctgttccctccaatggcagcggctccacaccgttgcccatgccaaatgataatgacaccgagcacgcaagtacaagtgtcaatcaaggcgaaaatggaagcggattaacgcccttcctcacggtagatgatcacacactaaacgacaataacactagtgagggaagtacaagggtgtcccccgatataaagttcagcgccactgaaaacactaaagtgagtgataacctgccaagctttaatgaccacagttattccacccaggccgacacggcgcccgagaacgctaagaaaagatttgtggaggaaataccggaaccggctatagtcgaaatacaggacccgacagagtacaacgatcaccgcctgcccaaacgagctaagaaatagtacacagggcaaggtcattaaatagcgtatataatcatttaatatagtatgttctcgaagctgatcgcgtaaggcgcagagcgaactaaaaaaaataccggcacccatgcacctcacaccgccgcacgcgagtgaggttgaactgcacccggaaaatgccaagtagatgagtcgtgaagagttctcgttattcgagctagtgagagcctgagaagggcttgccgagtgaactggtgtcacattggccgttttaacgcaagttggcgtacttatattgactgttggatgaaagggtaatcaagagaaacggaaacggcctcctcatcgttaagctcatcagtattcatttctcccctttctgctccatcgcgtgctcgagactatattcttcagattatcaagcagaaacagaattcgcatattacataactttcacaggttgaagtataaaccgctacagtacacaacctcggatagaatatagggaagaggccaattccgtgaaaacgatttaatattctttacagttacaaaaagtattacctattatcctcttttcggtgtcattgacaaacctcttagcgacagaaactccctagcaaaagagtaaatccataggaacaacaaaagaagacaaattatcataatataattgggagtgatagacgacgattcatgctataccgtaggtttttgatacaagtctaacagttatactatttttaaaaacaaaaaaataacagaaaaatctacgacaatggaaggcttcaatccggctgacatagaacatgcgtcaccgattaattcatctgacagccattcatcctcctttgtatatgctctacccaaaagtgctagtgaatatgtagtcaaccataatgagggtcgtgcaagtgcaagtggaaatccagccgcagtgccgtctcccataatgacactgaatctcaaaagcacacattccctcaatattgatcagcatgttcatacctcaacatcgccgacggaaactattgggcatattcatcatgtggaaaagctgaatcaaaacaatttgattcatctggatccagtacccaactttgaagataagtccgatattaagccttggttgcaaaagattttttatcctcaaggaatagaacttgtgatagaaaggtcggacgcatttaaagttgtcttcaagtgtaaagctgctaaaaggggaaggaacgcgagaaggaaaagaaaagataagcccaaaggacaggaccacgaagacgagaaatccaagatcaatgatgacgaattagaatatgcgagtccttctaatgccacagtaaccaatgggcctcaaacatcgcccgatcaaacatcctccataaagccaaagaaaaaaagatgtgtatcgaggtttaataactgtccgtttagagtacgagctacttattcgttaaagaggaaaagatggagcattgttgtaatggacaataaccattcacatcagctaaagtttaaccctgattccgaagagtacaaaaaattcaaagaaaaattaagaaaggataatgacgtagatgcaatcaagaaattcgacgaattggaatacagaactttggccaatttgcccattccaacagctacaatcccctgtgattgtggtttaacaaatgaaatacaaagtttcaatgtcgtattgcccactaacagtaatgttacttcatcagcatcctcttcaactgtatcgtccatatcccttgattcatcgaatgcatctaaaaggccatgcttaccctctgtaaataacaccggtagtatcaataccaataacgtaaggaaaccgaaaagccagtgtaagaataaagacacactcttaaaaagaaccaccatgcagaactttctcacaactaaatcaaggctgcgtaagaccggtacgccaacatcttcgcaacactcatctacagcattttcaggatatattgatgatcctttcaatttgaatgaaatcttgccactgccggcatccgatttcaagctaaacactgtaacaaatttgaacgaaattgactttacgaacatttttaccaaatcgccgcatccacatagcgggtctacccatccaagacaagtcttcgaccaattggacgattgttcctctatactcttctctccattaactacaaacacgaataatgaatttgaaggagagtcagatgattttgttcattctccatatttgaactcagaggcagatttcagccaaattcttagtagtgctcccccagtccatcatgacccaaatgaaacacatcaggaaaaccaggatattattgatagatttgctaatagttcccaagaacataatgagtatattctacaatatttgacgcactccgatgctgctaaccacaataacatcggcgttccaaacaacaattcacattcgctaaatactcagcataacgtttctgatctgggcaactcacttttaagacaagaagctttagttggcagctcttcaacaaaaatcttcgacgaattgaaatttgtacaaaatggcccacacggttctcaacatcctatagattttcaacatgttgaccatcgtcatctcagctctaatgaacctcaagtacgatcacatcaatatggtccgcaacagcagccaccgcagcaattgcaatatcaccaaaatcagccccacgacggccataaccacgaacagcaccaaacagtacaaaaggatatgcaaacgcatgaatcgctagaaataatgggaaacacattattggaagagttcaaagacattaaaatggtgaacggcgagttgaagtatgtgaagccagaagattagcatatagatgaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtgacatttgggacattctctatcagatctcggaagagtgggatcggaaccaatatcttgcaccactcccgcagtttcaccaatgttggtaatcaattcatgcctgtagaccaatggactgcccgcttcttctacatacgagcatgttctgcattcaaataacaaccggttattttctttatcctcacgagggtacaacatattgttgcagtcacgacaaaatctaaacgtagtcatagcagttttaaggggagtttaacttgctcttttggctagattttgtaactttcgttctacctagaatctgctcttgttccatttgacttactctttaacgctattcaccaaaacaaaatttttcaacttacccgccctatgtcttgaagtccaataaaacaactcaaactaatggcaaacaagaactcggtaagttctggaaggaacaggacaagcagcccgtcagcagcaaacacagtcaattaaataagcgcccagtatgtccttacgtatactagcgaagagatcttcttctatctggatgaaaacgcgcgttacaccagcgctaatttctcctattactatcacaacccgtttcaattctacgactacaacagcaccatcacataaggatgatgtaaggccagttgatcctaaaatttctaaaattgtacaggacatttcacaattgactcttttggaaacttccagtttaatcaacgagctgaaaaccgtattgaacattccagaaatttccatgcctatgggcggattcatggcaggcgctgcaggcgcaggtgctggtaatgtacctagctccactggtgaagctggtagtggtgctgaagaagaagctaagcctgaggcaaagaccgtgtttacggtgaagttggactcgttcgacacgaagactaaggctaaagtcatcaaggaagtcaagggattattggggctttcattagttgaagctaagaaattcgttgaagctgcaccaaaggtcttgaaagaaaatgtcgccaaggatgatgctgaaaagattaagaaaaccttggaagacttaggagctaaggtcagtttagaatgattttaaaactgtagcaatctaccaatcgtgttaatcaaaatagtctgttttctcttcgagaaaataaggaatatatcatgtaaatatgtttaactctttattcttctttcgtcctgccttttatatattttgccacatcgcttcttgcaagtagatgtataaaaatgattgatttccttattattttctatagtatcttcaacttcattatggcattcgttttcgtgttataagtatttcagacgggctaatctatcacttcataaatctacttttccaacttacaaaagcggttgcttttcttcgaaatataaagcccaccaaccataagaataaagaacaagagcaggagcgaaacgaaagagaagataaagattgtacctttttgctcctgatttttttttgattacgctacggttagttgagagaatgtccactgctgtgactttttttggccagcatgtcttgaacagagtttcgttcttaagatgttcgaaagagttcatcaaaaaatcattgaaccatgactctaccgtttttatcccatttatcgaaggggaagccctcatttcgcccgaaaatggtgacctagttcagctttctaattctgtaaagtcttacaagaatattttgtcagcaatagttcctttatacactactttattgaacacaactcgctcaagaagcgatgaatcaggcatcaatgtaacatttttaggtctcctggaaggcacagattctgcatttaattttgaatggtctaatatttcttacaaaggaacaccatattttggattagatatccgtgttactgagagcacactcttcaagaaagtcgactttgagcctattttttcctatccgaaggtgaccagagatcacattttcaaacaaacaaatgaggatgcttcactttattcacaaggtaagatgtatctggattggctagcaaagtacaaattctgtcccggttgtgggtctccgttattcccagtagaggcaggaactaagcttcagtgttctaatgaaaatcggaatgtatactgtaatgtgagagatgcaagaattaataacgtttgcttcccaagaactgatccaacggtcattatagccttgaccaattcggattactctaagtgttgtctggcaagatcaaaaaaaaggtacggtgattttgtattgtattcaacaatagcaggttttatggagccatcagaaaccatagaggaggcttgtatcagagaaatatgggaggaaacaggcatttcatgcaaaaatattgatatagtccggtcacagccctggccttacccttgcagtttgatgattggctgtttaggcatagttcaattcaattccaaaaatgaggttatcaacctgaatcatgacgacgaattattggatgctcaatggtttgatacaactgaaatcattcaagctttggataagtacgccggcgggtatcgtgttccattcaaaaatgatatcaatttacctggaagtactaccattgccttccaattaatcaatcatgtttgcgagaactataaaaacttacgtaagacctcatcgagccatctatagtttttaatataataaacattgataaataggcgtgcttcagcatatggatatttttcactcagttacccgaagaaaacagaggtgcgtcataatgcaaatgctaaatgaatgaatataggatgttagattgctggtacaagcaattttgaaacaaaaatcattacgaacagaagaaagtggagctgaagagcgtatatagttgttcatagctgtaaaataatttctaaattactatttagaacctttttgatatccagcatcgctcattagagattaatttaccaaaacggaataaaccaaaaaaataagaatagtgaacacacaagagaagcgcaaaagagtaaagagctaaaatgaggtcaggcgatgcagagattaaaggaattaagcccaaagttattgaggaatattctttatctcagggaagtggtccttccaacgattcatggaaaagtttaatgtcgtccgcgaaggacactcctttgcagtatgatcacatgaatcgcgaaagtctaaaaaaatacttcaatccgaatgcacaactcattgaagatcctttggataaaccgattcagtatagagtgtgcgaaaaatgtgggaaacccttagctttgacagcaattgtagaccacttagaaaaccattgtgcgggagcatctggaaaaagtagcacagatccaagagatgagagtactagggaaacgatacgaaatggagtagaatcaactgggagaaataataacgacgatgacaatagcaatgataataacaatgatgatgatgatgatgacgataacgacgacaacgaagatgatgatgacgctgatgatgacgacgataattccaatggtgccaattacaagaagaatgactcttcttttaaccctttgaaaagatccacatctatggaatctgcgaacacaccaaatatggacacgaaaagatcgaaaactgggactcctcaaaccttcagctcttccataaaaaaacaaaagaaagtcaaacaaagaaacccaactgaaaagcatttaattgatttcaacaaacagtgtggtgtagagttgccggaaggtggttactgtgcacgttcgctgacatgtaagtcccattcaatgggtgcaaagagggctgtctctggtcgttccaagccctacgacgtcttgctagcagattatcatagagaacatcaaacaaaaattggtgcagctgctgagaaacgtgctaagcaacaagaattacaaaaattacaaaagcagatacaaaaagagcagaaaaaacatactcagcaacagaaacaaggtcaaaggtctaagcaaagaaatgtgaatggtgggaaatcagccaaaaatggtggtaagagtactgtacacaatggtaacaatatcaatgagataggacacgttaacctaactcctgaagaggaaacaacacaggttctaaatggggtatcccgatctttcccactgccactagagtcaacggtactatcgtcagttagatacaggactaaatattttagaatgagggaaatgtttgcttcctccttttctgtgaaaccaggatatacatctccaggttacggtgcgatccattctcgtgtaggatgcttggatttggatagaacaacagattacaaatttcgtgttaggactccacagccaattaatcacctcacaaaccaaaacctcaatccgaaacaaatacaaagactacaacaacagagagctctacaggctcagcttctttctcaacaacagcaacagcagcaacagcagcagcaacatcactcaccccaagcgcaggcccaggccagtacccaacaacctactcaaggtatggtgcccaatcatttccccggcggggcaacgaattcatcatttaatgccaatgtgtcgagcaagcaaattcagcagcagcagcagcagcagcagcacaagtctcaagacacaggtctcacgccgctggagatacaatcacaacaacaaaaactacgacaacaacaactacaacaacagaagtttgaagctgctgcttcatatttagccaacgctaccaaattaatgcaagaatcaaatcaagatagccatttatctggcacccacaacaataatagtagtaaaaacggtaacaataacctcatgacgatgaaagcctccataagctctcccaatactagcgtaaatagtatccaatctccccctagtgtcaacagcgtcaatggctccgggcaaggtgtatctaccggtattaatgtctctggcaataacgggagaattgaagtaggtattggaaattctgtgaacccctacaatggcagaataaattaattgaatcatgcacgttatccagcatgttcacgaagtgagtaataaaaaattattcgccgaagtaacatgtacacgtctatgtttgtggacaagttacgctatttgcatttagagatttcttctccaatgtaaattattttttcttcggggggtatacattatttatttaagtagacattatatttcttcataagggtaggagagagcgaatacaaatgcccagtaaattccccataagtagttcttaaaatataataccataaaagtggccataaataggaagggccatggattattgggtagaatttttataaatgccatatgcaaaataaaattagagaatgaaataccgaatatttcccaaggataatactttttttctttccatatgactttctcgacgttttcttcaaatgactgagtcattgcttccctagaaaagtatttcttgactcttagcgggccattcctctcaaagttcacagaaccgttctgcaagatctttctgctttcatcaattgcagtagcccattgaatagggacggcaggttttagccacccagtggcagaactttcattttcaccagcaacgtaagatttgatagtctccaaaggacctccattgtttactgctagtacaggcttacctaatttcatggcttctaaaggaacaataccaaagtgctcatatgctggtgtatacaataacatttcggttctttcgagcagtaattctttcagagatgatgaaatggaagttaaaaatataattttactattattggttttgaatgactctaaatcggagacgcgctttatttcttggtagtatatggttgtatgggataattcgtattcatcggccagagactgtagttccttcaagtactccacattttctgcaaccctctcgtcataaccaccgcaaataactaacttaacgttgtcattgatttgatcttcagataacgcaaaagcctttatagccagcgcaacatccttttttttctcaaaacgatttatacttaggtaaaatctatcgccttcgttaaacactgttttgaaaaatttcttgtcaatatcttcaatttcgattgttgataaatccacgcatggataaatgacgtctggatcattggataaatacttgaacgtttggtggaacgtattcttagtgaaatttgaatttaccacaacagtatcggcagcactcacggaaaactgttctattaagtcaaatggtagtctgtatattttcttcaatagcccagctctttgagccaataattggtcggggaaatgacaataaaacatcaaagtggcagaactaaagatatgcagaagcggaatacatgtagacagttgatcaatgataattaattggtacgcattcacttttttctgtaggatcaattgaataactaaataaagctgtctaattgttgcgaaaacaataaaaaaacgacccaaaaagtttgtcggtaaaaaatcaccataaacttcgacttttaattggccgtttttaacttcttcgaaacaatgtgatttatcacagtgactagtatagatgattacactatgtccttgttgctgtagacctaatgctgcatcgacgactaacctttcagcgcccccaatacctaggtctggatgaataaaagcaatcgttcttttatccttttcaatcatttttgcttgtctaatcgactcttttttatctgtctttactactgtatctatttcgtgacttcttaaatggcgaacgtaatcttttgatgttaaaatgaatacatcatttattttgttgttcgcgcgttcatctagccaggcacttgtttataaaaaaagaagctatacgcaaggctctcgatctataaattgtatctgtgattgtgaccctttcgtatatatgttataatatttacaagaatatacatttatcatgataatctctggtgctttttgatgatctttggaagagctttagcccaagattttgttttactgtcagttagcataaatacgcggccgccctgtttcattctagcagttctgcccactcggtgtatcaggtctattgacgttttgggtacatcgtagagaacaacattccgtacacctttgaaattgagccctcttgccatgaggtcggtggttacgagtacatgcaaagacttgttactgggtgcggtaccattagaatttgtgtttttcaatttgccgatgacgatgttggaatcaggaatttcaaatttcttcaaggaagtgggaggtgaagtactctgagcaaccacctccgaaagtggtcgcggtggtgataaaaagggcataattttctcggatctttcttcaaatgtatcttcaccagttaaaccgatggcattatgaccgaatttcttattcaataggttaacaatttcaggaacattctttttttcgttaacaaagataatgcatcttttctcgaaccctggttccgtgtcatcatttgaaatagcatataaagtttgtgccaatgctttgatcttggatcccttgaaaggacttaaggcagaatttataactttaaagtccaaagcgaatggtaacttatgcagtctgggtgtcattataggaaccactgtaggaaatagtctttgcattgttttattaaactcttgaggaatagtagcggaacagaaaataaggtgattaatgttaggaattctctttattgcggagtgcgtttcttcaagccatgacctatctagaagtgtgtcagcttcatctagtactacgaaacccactttggacaagactttatcaggtctagttatcattcttatggagaacaggttcagtagttttcccggagtagtgactaaaatatctattctatttttaatgttctctaataaatcacgatatgatgtggccttgtcccacttgaaagagtttaagcctaacaaggttttcgtcttggaaacagtttcgtatacttggtcaaccaattcatgcgtaggcaccagtatgatggaccgaatcagaacgttttttcttaatgtttcccataattcgggagtttccaactcctgtcttttcaaatagtctattaaaggtatcaagtaggccatggtcttacctgaacctgtctcagcggcaatcgcatgtatttgtaactttggatccattaaatttttggatattctcttaatggccactgtttgaatgggactcggtattatattttcactggtttttttcctactatcttgtagcttcagggactctttggaaatgatttctttcacagcgtctctgacaggtggaagtataagcaattggtcgaaattcgatattttttgaatgagtttattcgtactgtccatattcatctcgacgtcttttttcaatccaccatactctccaaagttgaatgcttggtcagggtcattctttttgttaccttttttgcctttggccttctgttttcggtttttattactactgcctgtaggcactgaagctaatggagagtttcctttatgctttgttcttgggcctcccgcataagaacgcactcctatcttgagaagcacggggaaagaccactgtggtgaaattactggcttgaaaaaaagcgacatttgtcttattatactttaatctgatctgaagaagtatttctactcatcactaatatctattccgctattattatagttgtaatttatgattccgtggtaagtgatttgaacttttgcttcctttcgaaaatttcaagaatatggtttggttgtgctgtgcaagagcggttgtattgcgaaatagaacccatcgagaaaagaaaatgaaaaagacggcattaaagactagctctgttttaagacaaatatttacaggccagagaataaagagatactcgtatgtatgaattgtagccccttacacacatatgtatatatatcgatgtgaacatagcatttattaacagttctgctcagtacaaatggtagtagtactagtgatgaggttactccgacaccgttaacagcggtagtaaagagaaggccgagtaaacataaggtcgttatgctcttaggttactgtggcagcggatactatggaatgcaatacaacccaccacacaagacgattgaaggtgagattctcaccaagctcttcgacgtaggagccatttccgaagaaaattcattggcaccgaagaaaaattcctttatggcagcggcaagaacagacaagggtgtacacgctatgttgaatctactgtcgctaaagatcacattgcgagaggacacagtagcgaagttaaacgccgcactaccgcccgaaatacgcgtgtggggtatccagcctgtcaataaaaagtttaatgctagatccgcgtgcgattctcgatggtaccaataccttatcccagaatttatactcattggtccaccccggagttctcttttgcatcgaaacgtggggggatcgtaccgcgaagacggctcgcaagaggtgtgggatacgttcctggaacagacgcgtgggagatttagcggggatgagctgtgccgtttgcaggacactgcacagaaactaagcgagagcgatcctttggtacaagactacgtggggctattgagcggtacccttagcggctactgcttgtcgccctcgaagctggacgcgtttgaggcagccatgcaggagtacgtgggaacgcataattttcacaactttaccacaggaaagctttggggggatcctagtgctcagcgccatatcaaaaaggttgtagtgtcgcaggcctcaccgggatggatatgtgtgcggatccacgggcagtcgtttatgttgcatcagattcgacgaatggtagcgcttgccgtacttgcagcccgttgccaattgccgcctaatattgtacgtaactattttaacgccgggcctaggaaatacattccgagggcgcccgcacaaggcctattattagagggacctgtgtttgacgggtataacactaagttgcgcaatttgctgtattgcgaaatccgcccggacgatatcactcttgagcgcatgtgccgtttccgagaacgccagatctgtactgcgatcgcacacgaggagacacagcgtcacgtgttttgccattttgtacgacaaatgaaccgcctggccacgcctctaatctagccgcccaatgtcgcgggttgacccgcgacattgggcgggcaatactctcatcttattggctattcaacttagacaacggccagttgcgcgcacaaatttggtcatgaccgctccaccggcatgcgtgtcgtcatcccgcatcattcgggacattttggccttttccgcagtgcgtagttgacgtggggagaaagctagtgggctgtcgcatatggttggttttaggtggcgaaagtttcgccgcgatagcaatcatgtcctcgaccttaatctcaatggaatgggtcatgctcggtaagtgagtctcgctgtatataagtatatatgtaatcgcctagttcgatagatacaaggaggtcttgagtatgtagataaacgaaaagaagataacaaaaggaaaatctcagcctctccccttcctcttagacaatgtcgcaaagaaaattcgccggcttgagagataacttcaatctcttgggtgaaaagaacaaaatattggtggctaatagaggagaaattccaatcagaatttttcgtaccgctcatgaactgtctatgcagacggtagctatatattctcatgaagatcgtctttcaacgcacaaacaaaaggctgacgaagcatacgtcataggtgaagtaggccaatatacccccgtcggcgcttatttggccattgacgaaatcatttccattgcccaaaaacaccaggtagatttcatccatccaggttatgggttcttgtctgaaaattcggaatttgccgacaaagtagtgaaggccggtatcacttggattggccctccagctgaagttattgactccgtgggtgataaggtctcagctagaaacctggcagcaaaagctaatgtgcccaccgttcctggtacaccaggtcctatagaaactgtagaggaagcacttgacttcgtcaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggccgataaccacggaaacgtggttcatcttttcgaaagagactgttccgtgcagagaagacaccaaaaggttgtcgaagtggccccagcaaagactttaccccgtgaagtccgtgacgccattttgacagatgcagttaaattggccaaagagtgtggctacagaaatgcgggtactgctgaattcttggttgataaccaaaatagacactatttcattgaaattaatccaagaatccaagtggaacataccatcacagaagaaattaccggtatagatattgtggcggctcagatccaaattgcggcaggtgcctctctaccccagctgggcctattccaggacaaaattacgactcgtggctttgccattcagtgccgtattaccacggaagaccctgctaagaacttccaaccagataccggtagaatagaagtgtaccgttctgcaggtggtaatggtgttagactggatggtggtaacgcctatgcaggaacaataatctcacctcattacgactcaatgctggtcaaatgctcatgctccggttccacctacgaaatcgttcgtagaaaaatgattcgtgcattaatcgagttcagaattagaggtgtcaagaccaacattcccttcctattgactcttttgaccaatccagtatttattgagggtacatactggacgacttttattgacgacaccccacaactgttccaaatggtttcatcacaaaacagagcccaaaaacttttacattacctcgccgacgtggcagtcaatggttcatctatcaagggtcaaattggcttgccaaaattaaaatcaaatccaagtgtcccccatttgcacgatgctcagggcaatgtcatcaacgttacaaagtctgcaccaccatccggatggaggcaagtgctactagaaaaggggccagctgaatttgccagacaagttagacagttcaatggtactttattgatggacaccacctggagagacgctcatcaatctctacttgcaacaagagtcagaacccacgatttggctacaatcgctccaacaaccgcacatgcccttgcaggtcgtttcgccttagaatgttggggtggtgccacattcgatgttgcaatgagatttttgcatgaggatccatgggaacgtttgagaaaattaagatctctggtgcctaatattccattccaaatgttattgcgtggtgccaatggtgtggcttattcttcattgcctgacaatgctattgaccatttcgtcaagcaagccaaggataatggtgttgatatatttagagtctttgatgccttaaatgacttggaacaattgaaggtcggtgtagatgctgtgaagaaggcaggtggtgttgtagaagccactgtttgtttctctggggatatgcttcagccaggcaagaaatacaatttggattactacttggaaattgctgaaaaaattgtccaaatgggcactcatatcctgggtatcaaagatatggcaggtaccatgaagccagcagctgccaaactactgattggatctttgagggctaagtaccctgatctcccaatacatgttcacactcacgattctgcaggtactgctgttgcatcaatgactgcgtgtgctctggcgggcgccgatgtcgttgatgttgccatcaactcaatgtctggtttaacttcacaaccatcaatcaatgctctgttggcttcattagaaggtaatattgacactggtattaacgttgagcatgtccgtgaactagatgcatattgggcagagatgagattgttatactcttgtttcgaggctgacttgaagggcccagatccagaagtttatcaacatgaaatcccaggtggtcaattgacaaacttgttgtttcaagcccaacaattgggtcttggagaacaatgggccgaaacaaaaagagcttacagagaagccaattatttattgggtgatattgtcaaagttaccccaacttcgaaggtcgttggtgatctggcacaatttatggtctccaataaattaacttccgatgatgtgagacgcctggctaattctttggatttccctgactctgttatggatttcttcgaaggcttaatcggccaaccatatggtgggttcccagaaccatttagatcagacgttttaaggaacaagagaagaaagttgacttgtcgtccaggcctggaactagagccatttgatctcgaaaaaattagagaagacttgcagaatagatttggtgatgttgatgagtgcgacgttgcttcttataacatgtacccaagagtttatgaagacttccaaaagatgagagaaacgtatggtgatttatctgtattgccaacaagaagctttttgtctccactagagactgacgaagaaattgaagttgtaatcgaacaaggtaaaacgctaattatcaagctacaggctgtgggtgatttgaacaaaaagaccggtgaaagagaagtttactttgatttgaatggtgaaatgagaaaaattcgtgttgctgacagatcacaaaaagtggaaactgttactaaatccaaagcagacatgcatgatccattacacattggtgcaccaatggcaggtgtcattgttgaagttaaagttcataaaggatcactaataaagaagggccaacctgtagccgtattaagcgccatgaaaatggaaatgattatatcttctccatccgatggacaagttaaagaagtgtttgtctctgatggtgaaaatgtggactcttctgatttattagttctattagaagaccaagttcctgttgaaactaaggcatgaaccggttagttctcatttataatgtataatatacccgaatcttatttatttacctttcctattttttgacgaccagtaaatactaatacataattaggaacaaaagttaaataaaaaaaaaaataataatttaacgcatccaattaacgtgtccttttttcatcattaatttatctactatttcgatttaaattccatatacaataaatcctagatacattcccgaaagcatcttttagcgaaacatcttccttgagctgctagcagtgggcttagtccacctgttagttactcttggtataccactaggtcttttcgaggcaggaacatgggtctttcttactcttccgttatttgaaattcctgccgaaggaacgggccttctaccagattgcacaccgtaccttggatttaagccttgatttggtggctttgctggtgcagcatccttttcacccttcctattttctaatttttgtctcaaatccaagatctccttctttttcaacgctatcacgttgtgtaaagtactcccatcttcatcatttgtgtttacattttcattgtgcagtctatcattaattagctttaaataggtttgatcgctcatcaatttatgaatataaccagcttgagaatgaatgttgatccatgaatctaaaatggaattcgtagatttacatacctcatgtacttgattaacgtatactggcaagttattttttaatgcggccgtaacattttttatcattgctgttattttatctaacgattctgattctttgagtaaggattgcgttgtgattgaattaaacgatcttatagaattgctgttagccgaaatattatcgcttgctccacctcctgtgctttttggaaatttattggtcgtgttattgaggttagatctcatctcattgaaaatctgtggaatcagtttgtctatagtcgaatcatctaattggctttgctcactcatattgaagacttgttcaagtttcaaattatcttctttagtaatacttgagtcaccagtccagattacttagcctatctttctttatcgcgtttgattttggcgtttgtttgtaattattattcttttttccttcgtttcgctgtgaaactaacttgcgctgaggtccaaaaacctctcatctaagaataaaggaaaatacatattatcctgggtctaaaaggctaaaagaactcaccgtcaagaggaaggggctcagaaagtatgggtgagtcaattgaaacaatttgtaaaaggccttgtcagggctttccaagaggagaaggatgattttgtctcacttgtaacaatcattgatatgtacaacgagcaggtgaactctggaaagtctataaaagaaaaggaacgttatttggatgccctattgaaaatacttaaggataatccagttaccttaaaggaaattggctgggatctgccaaagggtttattgcagtttttctcacgcaaaaacatcaatgtcaatatacatctagtttttagtccccttgtttctagtgtgatggaatgcttcaatgagctagccatcaatggaaatccgaaagaatgcttgttgaccgcttgcgaattggtgtcaacactccatatagtcttaactgaaactggcgactccgatgaagagaatgaagatttaaatgactccaatagaaatgatgcgtcaaacattactgatgagctgtcagttatcactccggagattgggcactatatggccaaaaatacagtagaattcattccaaatttgaaaatttacgttctctttgaatttatgagtttattgttgaaacgtgtggacactttatatccatctaaatttctagccatggtaacttctgcaattattaagtatgtaacaaccaacgttcaggctatggatgatccacactttattttgcgcatagtgtacaatttttgtactaattactctccagctcaaccatctgctagtctgaccgatggtattagtacaaacgatcttgaaaaaattcatgatgatgaatctgccttacagaaaaaactactggctaatctgagcgtattcgtgattagcaactgcctaaaaaatcatccaggtaatattgacaagatatatttcaaaacattgatgcataaaaaaacagatgaaaatgaaatcgatgcttcagttttacagatatgccaccaatactacgagtatgtcacatcattggatgtccacatgaaagaacttttagaaaagtgcctggtagaatcaagaagcatctataactctcttctcatgaacccggccgcttccacgcccgaattcaaagaagaaattaaccaactagtatatgaggtatcttacgcatatcaaatcaagaaactagctgacgaaaagaacttagagctggaccaatatggagttgtgattctatctgcaatacattattctaaaaatggtactcacttattgccgcaaattgatatccaaagcgcaatttacctctatctacggtgtacgacagcttctttattttcagaaatatacgaaaataagtttttggaaagttcagtacgctactggctatgggtatccacaaccgagacttccacagagaaaataaagtgtgccttacaagaacttccagggcacattaccacggcctttttgcagatgttactgatgaaaacttgcaatgaatctaataacgacactaagttgaccgaaattactcttctgaggaggttactctatctcatgcccgaaagcacatcttttacgttcatctttgaaactctactacattgtccatatataactgcaaagattgctgttcttgacattctaagagatatgatgattagatctcctgaggctgctaatcgtgacgaaactgtcggtttaatcgaacaacagaatcctgggaataccgctaatagtgtaccgataatgccaactctacctccaagaccttacatcactattaatgaagatcgcatggcttccattcatagcattgctttaatatgtttttctgccgccaagcaaaagaaaagaacgcaaggtgatttactcttggtactaacatatatgaaattttttgttagtttaaggaacaaatgggatttgggtctgttaacactcatcaataaagaaatctccgaatcatttcaaggagaaggtgagcctgaattagcattcatcaacatttccaataatactctgggagaatatatagaagagatgaacatacgctcgtaaactacatagtaaattagttgctcttctcttttgttcccgagtaaatcgaattattctattaaagggaaacactatgttttgagtcatccaaactttcatttttttcagatttcatcgcccgatcgtcaaggaataaaaagggaagggatgggatacttgcattggaacccagaaagtacgtaaaagatgaagatcgtgagagattggtcaatggataaatagttctgtaattatgtctaagtatcaaattaattgcataagataccggcactttctcaggacatctaatatctcgcagatccctgatttcacgaaatactgcattggtcccgtaaatgaagaattggcaccttacatcatggaaaccatgaaggcatacccttcaaattccgaatatatcaatccgcagcattactatcataatagaacggtattagtagaaaattacttaaaacgaagtccaaatccagtatcattaacgcagttagcgcaatattatgacgattctaccaagctgaccagaaccaagatcatcaattccgggaaatttgtaaaagaagaactggtaattaggatcgcgcataaattaaatcaattgcaacaacttccatttaatgttgtgaacaacttccattttgttcaagtttatgagtcatattacaatatttttgaaagctttagaaaatatccgactataagaactttagaggacgcttctcaatttgcagattttatcaaaaatatgctagaaggcttcaatactctaaacttaccacatttgataatgggggctttagaatgtacaattttggatctttatcctcgtgaaaaaatggaccaactactatctgatctgttaagagctcgaatatcaagaagattgattgtagaggaacacgtcgtatacacagccaactacactagtggtaaggaggaaaataccttggtattgggtgatatttttcaagaatgtagcgctaaaaaatatttattggaagccagtgaggaatctcaaaaatttatccaagatatgtactttaaagacattcccatgccagaatttattatcgaaggtgacactcaactaagcttttactttttgcctacacatttgaagtatttgttaggggagatccttcgaaatacttacgaagcaaccatgaaacactatattcgtaagggattagaaaagccggaaccaatcatagtaactgtagtaagtaacgatgaatcctatttgtttagaatttcagataaagctgggggcgtcctccatgatgatgaaaatctatggtcattcggtaaatcgaaagaaagggctcaagaatccctaaataattttcacaagttacctggtttacaaacagtatctatttatgacgaagtacattcccatactaaatataactccaaactgaagtcattgcagtcaataacattaaaaccgtacatgcacacgtcgctagaaccaatgagttatcctagcatcataaatgggcacatcaaatatgaaactcccctaattgaattgttaagcggtcttttagatacaagcttgggattgggttagccatgtgtaaagtgtatgctgaatattggaacggcgacctttcattgcattcaatgcctggatatggtaccgatgttgtattaaaattaggcaacttgatgaagcatacgaagaaactacaattagataaagtgtgagctaaccatgcttacactatataccaaggaacaaatacatattcggaatattagtatggtgactacatttcccggattagtgtatgtatatacaaaaaggcacctccggggtagccggagtagaaagctggaaaaataaaaatgaaagcgaatggaatgtgtaagagaaaaaaaggaaagaactatcaagttgcagagttgatgacataaatagtagagtggaaaatcaacgaagatcgaattccaaagattatttttaggcagacagagactaaaagataaagcgtcatgtccacaccagctagaagaaggttgatgagagattttaaacgtatgaaggaagatgccccaccgggtgtatctgcttcaccattacctgataacgtcatggtatggaacgccatgattatcgggccagccgatactccatatgaagacggaacttttaggttattgttggagtttgatgaagaatatcccaataagccaccgcatgtcaaatttttgagtgaaatgtttcatcccaatgtctatgcaaatggtgaaatttgtttggatattttgcagaacagatggactccaacatatgatgtcgcatccatattgacatccattcaaagtttattcaacgatccaaatccagcttcgccagcaaacgttgaagctgcaacattattcaaagatcataaatcacagtacgtcaaaagagttaaggagacggtagagaaatcttgggaggatgatatggacgatatggacgatgatgatgatgatgatgacgacgacgacgacgacgaagcagactgagaaaaatcaaaagaatcttaatgatgaatgccgagccgatattatgaattcgattacctttttgttcaatcaaatatagggcttcatcgtgagtttctttctctatcgatccgtttgctttctattcctccatcttctactttataccgtaaagaaaatttaataatgatagaaacattgcatataaataatatactaaaaagaaacactgctctaccataaatttctttggagaaaataacgtgaaatgagaaataaggacaatttgttatcggttataactgccgatacccgtatcttttgtgtttgattcaaggaatacttatttagagtagaaagaatatatttacttagataacttaatgtataatatataaaaaaaatcaaaaaaacaggaaaaaaaaaaatcatgagtgagtggcacttttaactgcaagaatgaagagtgaccccatttttttttattctgatattacagtactcttctgtgcgggcagctccttcgttttttgttttgcactttcatccaaccacacatatatggaaacaaaaacgacgaatgaaattatagctttgctgaatggatctatgctcttccaagtaaaccttttatcatcaagatgaaacaccttgaccacgttttgcacatcagcaggtagtatatttgcgtttttgttattttgtaggagaaaccaattatattcgatgaatggaagtttcaagaattgggacctaactgacggagaagagtttgtcaggacaaattgagttcgaggtccaagaaagccaaatgacttgtagtaccacaactgaatgaaatcttgctttagatcattccagtttcctcgcattttctcatttatggcaaaatccaataaatctaagtcattaccacttaacttaggaaaattctgaagtaatatattcgtatctatcaactgattgttatgtgtcgaagacggattgaagaatttgttcataatgacaccaagctcgccgttgtttagacgctcagttaataaatgatcgcgtttcaaaccacttgtttcgtcttcatctagatctggtgcacttggctgcaagacgctaaatatctcggacatggtctgtgagaaggaaatggggttttctgtagatgtagtactgccattttgagctaaccgtattttctgcttcaaaagcagtgaagccggtggaattctttctaattttggttgataaaatctctttaccaaaagatttcctgcgactgctttaatcatgggaccgattctgaaggctctatgcgattttaatctgaagattttaacatttgacagtaccatctcaatcggaccttttaactgattttagcgagaacatgtgtatatatttcctctaagaaaagaaagggcctaaaaacctcgccccagtgcataataaaagtaaaaaaaaaaaaatcaaactttattgggataaaataaaaatcagaaaaacccttatatatgtatatgtagttaaatgaagccagtttttttcgtctggtttgtttcagcctatatgccctctttgctttcttgccatctgcggatcaatttccttatgatgcgtttgttttcttgccaaaacacttaatatgtcagtcaatgacacaacacctatcaatttacctgttctatactccttttcgaaatgtgctggagttggagatgcgggacaattacttggactttgaggtggtggcattgtggccgatggagactgtggttgagaaggtgagggaccactcaaatttatatttacatttattttattgtttgatgtatctgaagattttagaacaggagagttggccatcctggaagattgcgtgttcgaatggtatgacgacgcaagcgatggcaatgtcgttacgggtggagtacttggtgatggagatgaggatttttcggaagatgctgttggttgattgtcatttggttgtactatccataatctgtgagatttggtagcgaccaatttggcaaacgttcttgccagggaacttgttggatacacatggaaaataggaaatgagtccttaccggtctctaggccccttaaattcaaaataaccgagacaaaatgacgacatgtattgtgtaataaaggatattgtgaagttctggtgacgtgtttgacgtctgttactgaaatattaccaatcaagtttccctgcgggtcaactaccgcaatggaagagattctttcgacatacattttatgcagagccataattagatgctcgtcaccttggatggatatgacacgtgactgcttgaatgtaggtttatcacgggctgcatttagtacaccaatattcagctcctccagggaagagtccaagagaggcttcaagttgggaaatgatctcgcattctcccacagatacttaatcaatcgacgttgggaaagtatacctttaatctgtgtcatttccacgttcgtgatggcaacacgatgcacacctgagcctagtatgcctattaccgtcgataagttttccgtttcgggcaatttgtagaatggattcttaggtgtcaactttactatctccgccacgggcacggacttaccattctggcagtctgaggttatcttgtcgttgctcaccttgatcctgtttaatacaagaagaaggtacgcattgagatcattatagtcgaatgttaaacaattcatgtctcccggaaaattctccacaggcaaagaagttagctggtgcttgaccagcgtgttgaatgcttcctctacggaaatagaacctctgatgaaaatcaatttgttctgttccaccaaatttgacagaggagtgtgttgccactcctgcctatgaacagataacagattctgtgaattcaaggtggacaaggagttgccattattgtttgagtattccgtgttatccagcgtggagagagaagatgaagatgacgatttcgaaatagatttatgtagtgattctgtgtcgcttttgtttgcttcagtgttcttgtctgtctgttcgctcaaactatttaaatctgtggaattcggtaattgaggtggggtagaaagcatttctacgatggacgtgtgtcttgtattttgaggcattgggtgggtcttgctgaaaagatgatgttctgaggtattcgtatcgctagcttgatacgcttttaacaaaagtaagcttttcgtttgcaggtttggttacttttctgtacgagatgatatcgctaagtttatagtcatctgtgaaatttctcaaaaacctcatggtttctccatcacccatttttcatttcatttgccgggcggaaaaaaaaaaggaaaaaaaaaaaaaaaaaaaataaatgaacacatggaaataagtcaaggattagcggatatgtagttccagtccgggttataccatcacgtgataataaatccaaatgagaatgagggtgtcatatctaatcattatgcacgtcaagattctccgtgactatggctcttttctgagcatttttcggggcgcccgtgcaaaaactaactccgagcccgggcatgtcccgggttagcgggcccaacaaaggcgcttatctggtgggcttccgtagaagaaaaaaagctgttgagcgagctatttcgggtatcccagccttctctgcagaccgccccagttggcttggctctggtgctgttcgttagcatcacatcgcctgtgacaggcagaggtaataacggcttaaggttctcttcgcatagtcggcagctttctttcggacgttgaacactcaacaaaccttatctagtgcccaaccaggtgtgcttctacgagtcttgctcactcagacacacctatccctattgttacggctatggggatggcacacaaaggtggaaataatagtagttaacaatatatgcagcaaatcatcggctcctggctcatcgagtcttgcaaatcagcatatacatatatatatgggggcagatcttgattcatttattgttctatttccatctttcctacttctgtttccgtttatattttgtattacgtagaatagaacatcatagtaatagatagttgtggtgatcatattataaacagcactaaaacattacaacaaagatgccaacttctggaactactattgaattgattgacgaccaatttccaaaggatgactctgccagcagtggcattgtcgacgaagtcgacttaacggaagctaatattttggctactggtttgaataagaaagcaccaagaattgtcaacggttttggttctttaatgggctccaaggaaatggtttccgtggaattcgacaagaagggaaacgaaaagaagtccaatttggatcgtctgctagaaaaggacaaccaagaaaaagaagaagctaaaactaaaattcacatctccgaacaaccatggactttgaataactggcaccaacatttgaactggttgaacatggttcttgtttgtggtatgccaatgattggttggtactttgctctctctggtaaagtgcctttgcatttaaacgttttccttttctccgttttctactacgctgtcggtggtgtttctattactgccggttaccatagattatggtctcacagatcttactccgctcactggccattgagattattctacgctatcttcggttgtgcttccgttgaagggtccgctaaatggtggggccactctcacagaattcaccatcgttacactgataccttgagagatccttatgacgctcgtagaggtctatggtactcccacatgggatggatgcttttgaagccaaatccaaaatacaaggctagagctgatattaccgatatgactgatgattggaccattagattccaacacagacactacatcttgttgatgttgttaaccgctttcgtcattccaactcttatctgtggttactttttcaacgactatatgggtggtttgatctatgccggttttattcgtgtctttgtcattcaacaagctaccttttgcattaactccttggctcattacatcggtacccaaccattcgatgacagaagaacccctcgtgacaactggattactgccattgttactttcggtgaaggttaccataacttccaccacgaattcccaactgattacagaaacgctattaagtggtaccaatacgacccaactaaggttatcatctatttgacttctttagttggtctagcatacgacttgaagaaattctctcaaaatgctattgaagaagccttgattcaacaagaacaaaagaagatcaataaaaagaaggctaagattaactggggtccagttttgactgatttgccaatgtgggacaaacaaaccttcttggctaagtctaaggaaaacaagggtttggttatcatttctggtattgttcacgacgtatctggttatatctctgaacatccaggtggtgaaactttaattaaaactgcattaggtaaggacgctaccaaggctttcagtggtggtgtctaccgtcactcaaatgccgctcaaaatgtcttggctgatatgagagtggctgttatcaaggaaagtaagaactctgctattagaatggctagtaagagaggtgaaatctacgaaactggtaagttcttttaagtatcacattacaataacaaaactgcaactaccataaaaaaaaattgaaaaatcataaattaaaaaaaaaaaaatcaattgaatttttttttttcatgattacgttttgacatttttcctttttttttctcttattacgatttaccttttttatttatttttttcattttagtattttattcttcgttatttatgtatagaaattttcattttcatttagattcagatttggttatcttttttcattatatatcttttgcactaagtttcaacttaagttctattttttattttttttttctgggccctggagcaatagatatgggatggcttactgcatctcttcaaaatttcacagtcatgctcacccttaagttctcaaccttttagtttttttttttttttttttttattttgtatggcatactaactatacaaatatttatatgtacatttatacagtaacctattatttaccgatattcaccggtattttactttaatagatgctggtaataacgaaaaaaattgataactcccaccgacaattgagaaaaaaagcaaaaaaggaaaaaagggaagcacgaattaatacattctgtgtatttatcttttttatcttcagttttcctccaatctatgggcggccattaagtatgtctattattcttggcccttcagtcttctttggatttcaatgtcttgttggattagaagtcatcaccactttcagcaatcaaagccatgatcattctgtacaagtagaagaagaacatcaataagtggaaacctaactttaggaaactctcccttttatgtttgcctaaagttctgaatatttcggtagcatccaaaagttgaactttattgtagatcttgtttagattgtaagctagaactggtaagttcaataaaaatacaaaccagtaaccgttcagtaagaatagtaatgacaaagcaccatgcaaggcggcttcaggggtaattaacttgttaactttagaacataattcaattggattgatatagtcagcttctaaatcagcgtatagtattgtgaaatgcacttggccaaacaaattgatacagttgacaacaacagcaaggataaataaccaagcacccatttttctttttattcttaatttttttactttactttaattgcagttcaaaggtaaatgtctttgttaagtaggcagtgagacataataatatgagaaaaatccaggtctctccttcgtattaaggaatacatgtctatgctatcactcttaaatctttctccttccttgttttttctccgaaatgaagaaaaaaaattttcttcacggaactaacgtgaaaaaaaactttcaaaaaaatactccgatacggggagtcgaaccccggtctccacggtgaaagcgtgatgtgatagccgttacactatatcggaaacaaattaactgaaaatgttgtatctcaaaatgagatatgtcagtatgacaatacgtcatcctaaacgttcatacaacacatatgaaacaaccttatatcaaaacgaacaacatgagataaaacccggccttccctagctgaactacccaaaagtataaatgcctgaacaattagtttagatccgagattccgcgcttccaccacttagtatgattcatattttatataatatataagataagtaacattccgtgaattaatctgataaactgttttgacaactggttacttaccatatatattattgagaaatgggtggattttgagataaatgtgagaaatgggtgaatgttgagattgttggaataaaaatccactatcgtctatcaactaatagttatattatcaatatattatcatatacggtgttaagatgatgacataagttatgagaagctgtcatcgatgttagaggaagctgaagtgcaaggattgataatgtaataggataatgaaacatataaaacggaatgaggaataatcgtgatattagtatgtagaaatatagattccattttgaggattcctatatcctcgaggagaacttctagtatattaggtatacctaatattatagcctttatcaacaatggaatcccaacaattatctcaaaattcccccaattctcaacatccgactgccatgcaatgtgcttttctggatctcactcatgatcataatggccctgtaaaaggctcgtactgttattatcatatcttcaattacgtattatttcggaggctgtacctattagtgaaataacgcctctaaaaatgaaaagaagaaaaagaatatgaaaggggttctgaattgctaaaatatttcgtcaaagctcaattagtatcaagatcaagtcgtaattcgaatcagcataacaacctccaaaaccatataataaccttacacaagacaagatatcaattcaacatgcaaaccccttcagaaaataccaacgccaagtcggattctctcgacgaacccggtgcatatttaatcgaggaaaatgtggctcttcctaaggacatattccattcgtacttgagttattggatatatgaagcagctcactgtacaccggtcatgcttttgtctctagtaattggggttttaatctcaataattattctttttcatgataacgaaaattgcgttggggtttctgtagggtttctcctcatattctctggcattttagtgatagttctaatactcaggtttggaccacagatcagtgatgaagatttcaaatgtaagctactgatggaaattatcacacggaaacctacggtaaaggggaaagaatggaggacaattacatacaagatgaaccagtatttatttgataacgatttatggaacactccctactacttttaccgtgatgaagattgccaccgttattttctaagtcttattaagggaagaactttcaagaagcaaaaggaatcgtcagccagcaatgttaaagacgcacaatcaaatgacgaaaccgctggcacaccaaacgaagccgctgagtcttctagttttagtgccggaccgaactttataaagctcctcaccaaggcagccgaaatcgaacaacaatttcaaaaggaatattggcgacaagagtatcctggtgtcgatgagtttttttagacagaagacgggagacactagcacacaacttgacaaaggatctacttctcgattgacgacactagtaggtgtcaaatttagtgtcatttatgattttttgtaataggatataaatatatacggcgctccaaataatgcagttgccccaaaaacaccacggaacctcatctgttctcgtactttgttgtgacaaagtagctcactgccttattaccacattttcattatacatcacttcgcaaaatgcaatattgaaaatgcctctagagatgaaaaacaatcgtgaaaagggtcctgcgttattaaaacatttgatcagtatgcaatggcacagagacaatcaggaatactatagtcatagacgatacaaggtatatattggtcatgcagacccctctagaaagtaccgacgtcaagttagatacactcaacgaacctagtgcacatttaattgagaaaaatgtggctcttcctaaggacatattccgttcgtacttgagttattggatctatgaaatcgctcgctatacaccagtcatgattttgtccctggtaataggggttttggttttattaattatattttttaatgacaacgaagcttgtgttttcaattctgcatactacgcttatctttctcttgtagtattgttaataatattaggtgatggtaatccaaagctagtcagtcgtcgaaattttaggaccgagcttttagtggatgtcatcacacgtaaaccggcagtagaagggaaagaatggaggatcatcacatacaacatgaaccaatatttgtttaatcatgggcaatggcatactccgtattacttttacagcgatgaggattgctaccgttattttctacgccttgttgagggagtaacccccaagaagcaaacagccacgtcaattggcaattctccggtcaccgctaagcctgaagatgccatcgagtcagcttctcctagttccagactgaattatcgaaactttttgctcaaggcagcggagatcgaacgacaagctcaggaaaattactggcgaaggcggcatcccaatatcgatgcgcttcttaaaaagacggaatagcttagagacactgccatacgtaaagcgaacataaactagagtatgatatataatcagcactaactggcccgaaaacggccgaagaagcctcgaaaagtcgattcgtgttggacccatttgctgaacgaagtgttcattgcctacctattatggtagtagtcgtgataatcgtgtggttggttttgtcaacggtgcatttgcattttcatgacaataagccttgcgttttcgttctcgggatattactttccccccacttctttcgcctcgatagctcctataagcattctcagggcgtatgtcggtgatcgagatttccaagcaagcttttagtggaaatcatcgcgcgcaagccagcggtaaagggaaaagaacggaggacgattacatacaagatgaacgaataaataaattaataataaataataatagaaagtacagtagcattaaatattattaagtttaatgattaaaaattggttaattgtcaagaaaatctaaggtattaataaataaataatactatgacaacttgcagcgaaacgatcagccccaatgaaaattaatcagaattgaatttgagcgtatctatttgataacggtttacgtaactgttggaataaaaatcaactatcatctactaactagtgtttacgttactagtatataatcatatacggtgttagaagatgacggcaaatgatgagaaatagtcatcgttttcaatggaagctgaaatacaaggattgataattgttggaataaaaatcaactatcatctactaactagtatttacgttactaatatattatcatcaaaattcacccactcttcagttacttatcttatatattatataaaatatgaatcatactaagtggtggaagcgcggaatctcggatctaaactaattgttcaggcatttatacttttgggtagttcagctagggaaggccgggttttatctcatgttgttcgttttgttataaggttgtttcatatgtgttttatgaacggttgaagtattgtcatactgacgcttctgattttgagattcaacacttccaacaaacagtagctcgcgtggcgtaatggcaacgcgtctgacttctaatcagaagattatgggttcgacccccatcgtgagtgctttttttgaataagcttgaaattggtaagacatgccagcgtaccatagtatttcgctttactgaggtaacgacagcagatatcaaaaattcattttttcttacccagaacagagctcttcttccactaacgcttttagttaggaatgtatacattaacagtctatttttttttgaaacctttcttcactgagatacaacagatagataccaaccagtaagatttaagtaactcatggctgcgcagaatgcctttgaacaaaaaaagagggcaattttgaatgagatagactcaacccaaccagatttgtcaccaaaaggcactatagatgaactatgccttccaataattgatcttatcaacgcaagcgctgatatggtgacaacttcatcgtgttccggtagagtcagtgtattcttggaaggtactaagtcatataacggggaggtcaagataggtggtaagggacaaggcggtaaatggctttacgtcactcatgatcgtgagaaagttattggctggttagatgagttgaaatcaaaaagtgagttttcttttgaactatctggcaaggagataccaacagagaaagtaacggggagtatcagatatatactttataagtatgagcctttcatattgcacgttaaatgcagagactttcaagcagcatccaagttatacaacacagccatgtcttgtggtttcagagaaagtgggattggttcgaacaatctggtcgcaatcagaataaatatcaagctggacgtaccgctcggttatttagatgagacttcaggcactttgaaattttttgtaactccagaatacgtaagcgttctggattctttatcgttaagcaaattcgatgagaataccaggaaaatgcaagcactatatgatagaattgaaaaagaactcataaattgtgcgccggatgtaaattctaaggtcaatataacgccaatcgaaacaaaggaagagaggagagaacgaaagaaaagagaaggtatggagagacaacgtcaacttaagagcccacaaaatgtgctataagaaaaggggacataccaagaattactcagcctttatttttctttcttgtggctcttgcgttcatttttcgttgttatataatcttgttaatctttgacgggataaaagcgttattattttgtaatatacacattaaaacttattttttttcttaaatttatctgtatatgatgaaagatcaggtctagttaatgcacaaaaaggtttaacacatgaattaaaaaggaaaaagactagcttatcgtttctaaaagaaaatcttttaatcactgtccccatcgttattcattaatgcgtcgaacatattagctcttggagcttgagaaacttcttcgactttacgagcatttctttggttatttctgaaagaacctgttttcgtggaagcaaaactatctctttgggtgttttgcatgttccttctgttagaagaatatctgttgctgttcgattggttgtgattgttgaatctagaatttgatctctgactgttctttttctgacgtaattgttcttcttcttggtggatttgttgaattgtctttggtccggcgtctttcttagcgctgttccaatgcttaatttccctcaattccttcacgtctatcaacttgaactttattctgttcgatatggtgccaccgtcaatgatatgttgtaacaacataaatagattgtcgagtagtaccgaaccttcaagagttgcctgaggcgtaacaaatttatcatgttcaaattgttcacccacagtattcagtaattcaataacggactctaatgtctcctcggatggatcgttgtttagatctttcattaatctccggaagcactcaaacatcatcttaccagttaataagttcaaacaatataagtaccctatgaaacgtactaaacctaaccctcttctcttggcggcagccgcaatataatactcatcggacatcatttcaggttctagtggattaccatcttctcctgcaggcaacttatcagcccaacctttctcaaattcttcgtgacatcttgccactaaataatgcaacacaagctttggtccattctttccttcgttctctttatctttaatgtttgggtcaaggtctttgaccactttgccacataactgagcatacattgaagaccaatgaggttcatcacaagccttgtggaaaatttgttcaataactattttcaatgtttcgccatcatcttcccactttgattggtttgctatatccaaaatctcagaggagattgaatcaaacatttctaaagttaacttgtttaatagagacttcatttttcgttctacttcttccttgtcaaataattcagttttgccgtcaggagctaacttcttttctgtttttttaacccttgatttaggtatccatctattagcactcggaaccaacggggcgatttcttcctttggagcttgctcttctgccttttctgcagctttttcgcgatcttttctggaggtatatcctctattagatcttctgtcgtcacccattctctttgatcttcttttcgatgaaactcttgaactggaagtatggtccataccgcgcatagatggacttctgaaatcgcctccaaatctgccactatcttttggtttatttctggctatatgaggaggtataacaattttcgaggatacagcttcaacccacgcaggatcaggcctgaattttagtttatctttgaattgcagtaagaaggtagggccataagtgtacttaacgcttggtttcttgtatttgatatcaggcctttcaacattttccggataggcaaactcatatatgtcagaaattggttgagccttacctaaagtttcaagtagttgagatacagttggcatctcaatatcggaagtggaaggttctgtctccttcactgtgttctcctctgtggtgattacggaatttattgtttcgtcgtcacttttatttacagtttttccaccagtcgtatccgaaatttcagtagtatcatcatctttaacaagctcatcaacatcctgagaactgctctcattctcgggttcgttaaaagtcacggatttagttacacttccagttacatgttgtggagttttgacacttgcccctgattttccatcaatcacaacttcattagcttctcccgttggtttcggcgcttccttaataggttcagattcaataaccgagttgggcttagttgtatcagtattatcatgatttgaagtttcttgcttcttctcagtttcggagattaaaccgtttttctttctttccatggcagctttgcgcaatctcacctgctctaaaaataatctcttagtattttccgcttcagaggtagatttttcattagatgtttcggttaacgtatctttaactgcttcattagcaggtagtacaggagttgcctccttttcaaaaggggttcctgatttagatttctgctctaccccatcattcttctcttcacctttcgaagctttcttttcttcgtggaattttttcaaatttaaacgttcaccagttttcgtagtgatttctatttttgtagttttaggtgtagagggaggttcgggattagtgttgagtggttggtgtgtatatggtggagaagcaactggaaccatttgttggggtatataatacatctgaggagcatagtagttagctggccattgcatacctggcaacattgccgggttatagtcgttgttattcagtctgtagccattattgaatctgttattgtagtactgtgcatttccttgactattattacgattattgtatttatttgtcccgtatttgccatttttcgactggtattgcttgttattgtgaggttcccttgcactgtaaagattttcattgtagtggttatttggctgactattattggctccagagtattggttatcatgaggaggaaatttcttgtagccattggcttgctgcgggtgtgggggcggtggacctctttggtcagtcatagtgcctacaattgatctattgttctttgtaataaattctttctttcaggaacagtaaaaacagcctaaaaatatgaagtcgccgtagtaaacgttatcttctagttactatcaacacagacgcctttttaaattcgagggtcaaggctgctaggctgagtggtcgtttgctgtgtttacctctaatcaaaaacttattatcttttttttttcagtcctttttgcaaagcaggtacctactatttttcaaaatacactaaaggaacgggccccccggcttactattaataaggtcaggacggggaaaaagcagcaatgctctgcccctctgttctcgaaaagacaaacggttgttatatcctgtatatccagcggtataattttgcctcttagttaatgctaaactatgatattatacacatacactaagtaacatatacaatgagccaagtgaaacgaatacatcacttgaacagcttggcgacagaaatggccgtttcttggttcttgttcataaccttacccacagcgagttcgaagtcttcttgagtaacgtgtattcttctttctcttaaagcatacataccagcttctgtacagacacctttgacatcggcaccagaacaaccgttcatcttttcagcaacctttctcaagttgataccacgagttagattcatttttctggaatggattcttaaaatttcagctctagctgcgacacttggaggtggaaattcaatcttcctatctattctaccgggtctcaaaagtgctggatctagaatatctagtctattcgtggccattatgatcttgatatttttagaagtttcaaacccgtccaattggtttagtagttctaacattgttctttgaacttctgaatcaccaccaccagaaccttctacacgagtagagccaatggaatcgatttcatccataaagataattgagggagcatgttctctagccatcacaaacagctcacggaccatacgggaaccttcgccgatatacttttgtaccagttccgcaccactgaccctgatgaatttacaatcagtgtgatgtgcgacagctcttgccaataaggttttccctgtaccaggggggccatataagatgacaccctttggttgcgcaatacccaaactttcaaaaagttcaggatgttttacgggcaattcaataacttctttaatctcctttatttgctttgtcaaaccaccaaccatatcgtatgtggaatcaggaactttttccaccatcatcaacgaaactagtgggtcagccttattctcaagaactttatgcaacatataagagtcactccttagacaaactctttgagatgcctttaagtccttcacgtttatatcttttgcaacatccacgatgtattttccctcaggttgcactttaacgagaacttttttgtcagacacgatctttataacttcacccacataagatccaggttcctgtaatagacgcagttcgtccttgataaaacgtactttgtcattcaatgcattcctttgagcttccagtctgcgaacattttctgttttggagcggatctttaattctgtttcttggatcttctgttcaaaatatggtttgataccactttcgtgggtttctaatactatattggaggatgttacagcagctgtcattgtcgtgatagtatcccactatactgttgttccgtttacataaaacctaacctaactgttactgatattacaacttttgccacctcgctcgcattttgacagttttaaaatacgaaaatttccgaacaagaataagggtagagaagtatgcaaaatatgatttcatattaaaaaacccaaccgaagaaaaagggaaatagaaaaacaagttttcagtcgcaaaaagaggttaaacaaacgagtcagaagccagctctttcaaacaatgggtattattgaagaaaaggctctttttgttacgtgtggggcaacggtgccatttccaaagctcgtctcatgtgtgctaagcgacgaattctgccaagaattgattcaatatggattcgtacgtctaatcattcagtttgggagaaactacagttctgaatttgagcatttagtgcaagaacgcgggggccaaagagaaagccaaaaaattccaattgaccagtttggctgtggcgacaccgcaagacagtatgtcctgatgaacgggaaattaaaggtgatcgggtttgacttttcgaccaagatgcaaagtattatacgtgattattcagatttggtcatatcacacgctggaacgggctctatactagattctctacggttgaataaaccgttgatagtttgcgtaaacgattctttgatggataaccaccagcagcagatagcagacaagtttgtagagttgggctacgtatggtcttgtgcacccactgaaacaggtttgatagctggtttacgtgcatctcaaacagagaaactcaaaccattcccagtttctcataacccgtcatttgagcgattgctagttgaaactatatacagctagttagtaagattttaaaagacgaaaagaacggaaagtaggacaactaccaaaaaaaaagatggaaggtttctttggttagttagcagtatccgcgtaatgccttagacgtttttgatcagaaaaaaataaaacttgatttcgcccaggatcgaactggggacgttctgcgtgttaagcagatgccataaccgactagaccacgaaaccagttttttgatgtttcgtttaggacaagagtcctatgagagtccactaaaattctaaaaataattgtatcaacaaccgtcatgcagctgttgtatcaagaatcgaccaccatctatagactattgttcatagctgtattacaatatcatataagatgtaaggatagaacgtgaagatcgagaaacagtcagcagatttaatggaagctgaaatgcacggattgataatgtaatagaataagtgacaacataagaaatgaaagaaaaaaaataacattaatataatttagaaatgttagtttccttctatgaactctcgtatccctggggaggactttcaatatattcagtatacctaccgttcaaatgatactctaaaatatcatctattaagtggtattcaggtttttcccacgcaagattgagtgcgtcaggcaaagccacgatcgcagattactctcctaacaatattaagatcgtcaagaacatccggttttactcaagcgcttaatacaacacgtcggctttcgctcaactgcagtatattgtgtctgtaacctctcccgtcaagtttgcgccacgggcccaataaccaacttctgcgccattgttacggaaaagtggccatctttgctatgctcgtaaggctagcgctctctaagtacgccagcccaaaaactccgtatcgctcttcatcggaattgctatatctacagccggacgggcactctatgtatactcatatcacagccactgttgcactacattattcgcagggactccgagatcgctgagcatgttgctaagcaacttaccaaggttggaatgcattatatagtccgatatagaccccgctcggactatattatataaattcaaatagcactttcaacgagtgtcttaatccgtcctagttcctgctctcgctccacgttgtcatcccacccattcgcacgggtcttctgtgcgaatgagccacaacggggccgagttcaggccgtgtccgcctacaacgtccgccaactagtggcaattgctacgtacgccgaccacgctgacacgcaccgttctactcgctctatgctgcggtgtgacgtgtgaacgcgcgatcgttcgcaatcgtatcgtttgccaagaaaaaaagccaatcggagaatctgaaaatcgctattcggcttgcaggtcgcacgcactcagagtacgaaatgccaagtaccggaatttccttggccttttttaagtttcttctcttctattctttttcccctttctttcttcctttgctatctgtctggtttaaataaacatagtatttttttgtgtctaagcctcttcctcttctctcgtacttgctctactaccactttacttaatcgcctttctttgttttctttcttcgttatttgttcttggaacttttccgctccaatcccaacgattggcttcaaaacacgttctactgtctagcaatttctgcaggtgccatttttcttaggcttataccctttccttttccccttacatttgatttcttcttcaaagttccttatagtattattgtctaagctctattgagtcaaaagtaacaatctagacgaaggaaaaaaaaaaaatagaaaatagacatccccgaatacgcatcatctcacgcacgtacaagattttaacgttaaagccaaagtacgctagtatagtatcatcagcatcaccctcactatcggtagcattgaccaaacatgtcgttactgagactgtggaacaaagaatcaagggcaccatcaaaaataaagagtcatggtattgttggcagttacggcaacagcatgctggcccataacaacgtgaagcaatttcgtatagacatagacgaaccgcatagagtatggaaaccgaatgaaagcataaccggagaagcggtcattgacataaagagagacataactaacgtagcgatcaaattatcgctagtatgtgaggttcgcgtgaaaacggggaacagtccaacctccaagaataagagaattgagaaaaccttagagaagtcgacgtttctttatggacaggactacgtaaagacagctttttcggctaaggaaaagaaaccgcatgttgacaaaaccaccattctcaatggtttaagcaagggggaacacaggtttccctttaggatacgaataccacgaggcagaggaatgttgagctctataaagttcgaaaggggctcgataacatacttcctctcttgcactttagaatccctcaacaacatcaacggattaaaaaaaccggaagcaagatgcgaacgtgagtttgcagtcatagttccgctggacgtctcgaggctgcccaagccgaaaactaagacagtggttttacaatcagcatctatggtccaaaacaaaaagaacaaatctacagaggacgaatcctcatcgtatacacaattaactcaaaagtctactacttctaattcttctagcagttcagtaaactccaagacgtcccccttaccaaataaacggtgactatatccgtagacatacgcaggctggattcatgattggtgaaattatccctatagacgttaagattgaccactataagcctttctatgcctgcgggtctcaccaccactttggtgaggatatgtagggtgggcggtgcaggcaaagatggatcctatggagactttcagaaaagatatatgtcagagtatctctcctatatatattaaccctgaaacgttgcagtttcaatctagagtttatctgaaagtgccccttgatgcattttcgacccttactactgtgggaaaatttttctccttccaatactatatcgaggttatggttaacttatcaaaaaaaaacgtggtttacacagaatctaatagaataataggaactcctattggagaacaaaatggcttgggcgtagagaataatatcaaccgtatccaaaggaaaatgctacgtatggtcaatccagaaacgttggagaacgattctgagggttatgaatccagtatatttttcaaagatatggtaaatgtggaaaagctaaagagactgaggaatgtaactggtatgtccatagaaaccgtcataggaacgacgagatccgaacagcagcaatctgatgcaagcatcccatcccaatcctcaatcacggctcctcaaaattctccatcgaatttaagagattggttggccccattaaatgcatatgatagtgacgatgttccagttccaaagtattcgccaaatgataaagtcagtgtaccgtcggaagacaaacaagaacttgaacaaaaaagactacaacagttagaaagcgatcctcccccttgtgatgactattaaaaagtgcaggtaacaagtcatatactcgcagcttgcgccgtgttggaactaggcgccttaatcatgtttgcatatttccactatcccagccacgtaatgatccatgacattaacatagaaaaaaaaaatcgaagcatgcacaaacctgagatttatatatgttcatgtgtacttaatatacgtttaatgattaaaactatagccgtcctcaggcaaactgagataagaaacgaaaaaatagcagtaacgtaaacgttattctatatttataaagacgtcaaaaaaaaaagtgattgtgatattgagatgtaagctatataccgaactttgagctccctcacgtggaaaatatgatagattgttgcctcatcattgcggaaccgcattttttttttgtatttttgcctccctagtttcaaaatgcaccaaattctccccttaatgctttttgttttaagtcccaaatagccatcctttcatcatcgggcaagatagaaatttgactgtcattcagttgtaacacctgtttcagtagttctttctgtttgttaagcacagctggatccaccacctcgttcacgctattgttattcgtagccgatgcctcttcttgcggcctggaagctaacgggatcaaatcatccactttacatatcccattcgttagcaataattcagccgtaacaaaactcaactgtggacacagctctaatagcgaaacagcatcttcaggatgcgctcttgtccattcttggaatttttgtaaaaatttcaactgcacctctttcggttttttagctagttcgctcgatatcatcatagcaggggtggtcatgtttatgttaacgtcgataccagagggcaattctggaaacttttgacttagaaaattggcatttccgctgttttgaaagtccggcccattactattattattattatttccattgttgttattgttcccattaatgttgttgtactgttgttgttgctgttgtgaaactcccgatatatcactattgctggagtaaccgcatttcaaaaacctagagcctaattggtatccattcaaattacgtactgcgctggcactggactctaaatctctaaattcaataaacgcgtaccctttcgacctaccagtttgggggtcgaacatcattttcaaattgatcacgggcccaacattactacataaatcaagtatctgctcctctgtttgatcgtatggtatagaacccagatacaccactcgggatggtgggttgttctgtacccccgcattcacaccgctctgcctattcattttatcgttttcgtcttttctttcaatgtattgataattaacgtgtctatgtgatgctattggtatatagcctttcttgtatatccctctaacaattattacaagtgtttctgtttaaagcaagtgctagaagtgactcggttctcttaggaaattctaaacgcaagatttctcttatggtgattgtaacaattatgagatacttcactagcccaccttaactttacggaccttcttttgaaacgatgcttcgaatgacaacgcctttttgatatataatatccaatttcattatagggaaattttcaactcttacccgccccactgtgctgatatgaccaagtgatcactcgatgatgggactacgtattgaaaaatattgaatgaaaaattactcaagcagcagaacattcacagtgtagtcagtccgcataagagcattcatcatggatagtaaggaagtactggtacatgttaagaatctagaaaagaacaaaagtaatgatgctgcagttctagaaatcttacatgtcttggataaagaattcgtccccactgaaaagttactgagagaaacaaaagttggtgtggaagtcaacaagtttaaaaaatccactaatgtagagatcagcaaactcgtgaagaaaatgattagctcttggaaagacgcaattaataaaaataagcgttccaggcaagcacagcagcatcatcaagatcatgcgccaggcaatgcagaggacaagacaactgtaggtgagtccgtgaatggtgttcaacagccggcctcctcccagtcagatgccatgaaacaagacaagtacgtcagcactaaaccaagaaatagtaagaacgatggtgtggatacagctatataccaccacaaattacgtgatcaggtactaaaagcactctacgacgttttggccaaggaaagtgagcatccacctcaatctattttgcatactgcaaaggccatagaaagtgaaatgaataaagttaacaactgtgacaccaacgaagccgcttacaaagccaggtatcgtataatttattcaaacgtcatatcaaagaataacccagatctcaaacataaaattgccaacggtgatataacacctgaattcttagctacatgcgatgccaaggatctggcaccagcgcccttaaagcaaaagatagaagaaattgccaagcaaaacttatacaacgcacagggtgccaccatagaaaggtcagtcaccgatagatttacatgtggtaaatgtaaagagaagaaggtatcttactatcaattgcaaacaagatctgcggatgaaccattgaccactttctgtacatgtgaagcatgtggtaacagatggaaattctcttagaatagaaaaagatgagagtagccacggacagagcaaaggaaacaataggaggaagggacagaaaagcctgttctgactctattcgtagtagtatttgacagccggaatccaggaaaagaaaaagccaaacatacaaccatatccaatttgttgaaatggcatattcatatacgatgtacatatatacatatactgctggtgttaattttttttgtcctgtctcacgtaaaatcttttgttcgtccagttacttttaattatttatgattttcatgttttctttattaatcttctatgcattaaatatggctcggtcagaactaaagaaatacaatttaagatgtaacaaaaccgacgaataaaaagttagaataaacacaagaagcagaaagtagatactacagccacacataatgctaagagttatatggaagcatagttccagagtcactcgttcgatagaactatcgaacatttctaccactaatcacaccaggagtttaaggaggctttcctggatttctccgagaagattttacgctcaatcttgggacgacagacagcctaatgacaaaatagatgcacacataaaggtgcagaaactcatggatcaaataaattcgaggcctaatgttctgggaaaagttagaaaaggttagcaatatcatgatcgaaaaaaaattggttaatctagatgggacttctgccaatgaagaaaatacgatgaaaccatggcaaatgattaagatcttaatggacagagatctgagacacgctatgaaggaatttaaattggaattggaaaaatctggcatacagttaggacctgaacaactggccccgctaatgaccgttttaggccttgagaagaaaaaatgagaggtgaaagtaaaaaaacattacctatctgtcttactagcgccttccgtgtataaatattacgtactactacataaatactcattaggaggattacataatttccattgtatcgtatactaggtcgcatctttgcatattataaagcttgccaaatagggatatactgccagcactgttacatttgtcatattgacatcattatttttactattcacaaggtaagcacgtttttttttagttttcttcatctaaccagtctaggaactcaggagccaaataagtgatgattaatctggcacccgccctcaagaaaccttgatgagattcaaaggcaattgtcttcaaatcaacaacacctttttcagctgcagcatgtaacattgcgtattcgcccgacacgtgatatgcgcagattggtaagtctttacaaatttcacttgcatccctcattatatctaagtagaaagtggaaggcttaacaataataccgtcggcaccttcactcatatccctttccaacgccctacgtgccaggccacgaccggcaggaggtaattggtaacatttcctatcaccattcgaaggagctgaacaagcagcatcacggaatggcccatatagattaccgctaaacttagctgcataggataacacgaaggtcttgtgagccaagtttgcatttattaagcctcgtttaatatctctgatcctaccatcgatcatatcactgggagccacacagtgcgcaccagctttagcgtagttaactgccacagctgctaatctagagacactacgttctctattaatagtaccatcatcgtatagaaccccgcaatggccatgagaagtgtattcacagagacagacatcgcaaataatatacagttcagggaaatactcacgaatgaatttaataccttgaatgactggccctgcaggatcgtcagccgctgtacccactggatccttggtaccagggatgagaggcacaccaaacaagatcacagaacgcaaacccttggccactaatggctttaagtagtcttttagcctatttacaccgattctattgatattaggtagagagtcaatttcagtaaagtcatctggattatcggagatgaatagcggaaaaatcaacatgttcttagtcagttgacgctcactttgccactgtctcagcagtgggtgattataaccacctgctagaacagatgagatttctgttggttctgtttccaaaaattcagctgtatgcatggttttgtcaattttctaggtatgaattactggagtaagcaataatatgagtaagcagtaaaacttttttttatttggctgattgggcaagaaaatcaaagacaatagagtggcgcatagatgttgctagcatttattaggttgccttactcttatataaatcaagcgggaagcttgcctcaagccaatcaccgcaccgaacagggattgctcgtttacccgtattttgatttttttttcaccttttccaatttttttttcggcaacaattttttggatgatttttatcgtcgatcttggaatgatgatgtatttcggcgtctctacaagacccaataaagtaattcggtgacacaggcttgtagcagatagaaaacgttccgaaagatgggttccaattgatgtaacacttcttttttatatattcatgtggacgtgtacgccttcttcccttctttgcctcttgtgccactgttaatcctcttaagcatattgtttttatttacagacattggctgactcaccagaaactataattgacgctgatttctagttaattaaaaataaaatatatgcaagaattagcaccaggcagtcatttctgtaaattgctttgttttctatttcaaatttgttttttgtatatgtttcaatgttctcgtgacaatgcaggcttttttttgtgcgaattaaagtaaagctaatcaaaactaaacaataatttatcttgttcccgaaagagtggatcatgaggaggaaagctaaccgtccaagatcctatataatttttgaactgaaaaccaactgttcacctagaagacaggtatctggatatgtaactacacgctctataaatacagaaatcgtaagctaatcaatataaatgtaaaagaaaataggaattgctgtcgatagatttatttacttttgtattgtcatctgtgttctgtgccagtacaccggactcgtatgagctgtatggtgtcgtttcaatagaatctactgtaataatcacacagattagaaattattttcaagattaaatatgacaatacaccttggaataaaaacacaggatctaatagtggcccaaaatgaagctcgacgtgaaaataatagagccgtgattttaatttcatgattggaagacgttttcaaggatggttagactttgggtctgaaagcactgtctcgtagtccatatataaagaaaatcttatgggaaactggttacattctaatgattttagcaacaagttgcagctaagagtttgaatatctgaacgaagttgtcggtacttctgccactatcagtataaataattgccgccgttccatgatatggagagcatggcaaggtttactctgatcttggccattcttcattaatttgtcgtgtgaaatgcgcagtaatcaaccaattttctgtcagcggtatttgaagccctaagatgacacaaatgagaaagcgttttctcaactagtaatgccaaattcctcccttctataaaaagcccctaactccgctgcattcaattgcatttttcattaaaagaataccttgaataaaaccatgcgggaacatatagatatataaagcagaacatttttgctcaagaacagaaagttccaatggttatctataggttccgtttcagctttacgtacctcccagtcaaggtacgattcaaagccttttaattttttatcccaaatagagcacgatgtcgcaatcttctgagtgttaaactgtcgccaaatctgtatttgggtatagccatttcttccaaaattgctaggaatggccttataagctatattgtgcttgtgcttgcgtttgcgtttgcatttttttttttgttattttattacttcgtcacaaggggtacaagagaactcttatccaactgaccacagctttgtcactaatttctctccagaggggaatgtccctttgagattatcgaacaggaatgattggatctattgcactaaaatgacccaaaaacgctctagtccatgctgcatcctatcttccatcaatacagaaaataacagaaggttcatcagctcatatatagagaagaaagaaaagaaagaaaaaaaactctgtgtagtgtaatacaactgactaacgcacccaccgaaagagggtccacgaggaatagacagtgcattatacagaacgtgctgaaaatgtagaaccttccttgtgaattttactccttgtacttcctgagataatatatgaccttctgaaaggtaaaagagcgaccttgatcctgcaaatttagcgaatatttgaatcgattttcatattttttctatattaaagcccaactactgggaccgaatattttcccctacaaaggctagaagacggtgaagccttcttgtaatttttatttcgttttagtttagttacaaagtgcttttgccattgcatagacgagcagcttatcccataatgaataaattctattcaaactaataataactaatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaaccattatttttttccatttaaaatgatctttttaccgaccaggcgtcactaaccacgaaaacatagtttaaggtattttccgttttaggcgcaatgaatatactgcaacgtgcctattgaatcctattcgaaatcacctccaaagttatgttgccgattaggcaaatactctaaaagtatagtactaaagaactacgtaaaggtaaaataaaacacctgaatttcatttctgaaatgaagtaccatcatgaaatatgatgaaagtcaagactcgttgggtcaatatacaccacaaaaaaaggtacacacgaatggtttaaccctttcggttccttctgtaaatcgaaaaatgccctttatacagcgggttggtctcccatcaaagttgagaagcgattagaaattaggttacctaatgaatccataaataaatggaaaacgctattttgttcgaacgatggaataaaaatatgaacgggtgtcattgaaattcggtgtattttttgatcgggcctgatctggctcgggtttggcacaatttggcttggttagttcggcaaagcttatttaaagaacctttttggatagccaattgagagacttgaaatagaaagatcgtaagtatttttatgaacgcaaaatcaatcttggtagcccagttagtttctcttcactaattccggagaacaaaaacatatcatacgattgtgtgagattcaacaaaaatcgatcagaaattttttttgaacagaatagtcatgactactgaaaaaaccgttgtttttgtttctggtgctactggtttcattgctctacacgtagtggacgatttattaaaaactggttacaaggtcatcggttcgggtaggtcccaagaaaagaatgatggattgctgaaaaaatttaagagcaatcccaacctttcaatggagattgtcgaagacattgctgctccaaacgcttttgacaaagtttttcaaaagcacggcaaagagatcaaggttgtcttgcacatagcttctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgcggtttccgcatactgtggttccaagaaatttgctgaaaaaactgcttgggattttctcgaggaaaaccaatcaagcatcaaatttacgctatcaaccatcaacccaggatttgtttttggccctcagctatttgccgactctcttagaaatggaataaatagctcttcagccattattgccaatttggttagttataaattaggcgacaatttttataattacagtggtccttttattgacgttcgcgatgtttcaaaagctcatttacttgcatttgagaaacccgaatgcgctggccaaagactattcttatgtgaagatatgttttgctctcaagaagcgctggatatcttgaatgaggaatttccacagttaaaaggcaagatagcaactggcgaacctggtagcggctcaacctttttgacaaaaaactgctgcaagtgcgacaaccgcaaaaccaaaaatttattaggattccaatttaataagttcagagattgcattgtcgatactgcctcgcaattactagaagttcaaagtaaaagctaaaattaagctttcgagaaaaactttcttttaacccctctaatctaaatataaacatatagcttatagaaatgaatgaatattttaaatagttacggatacaaagagttcattatagtgcgggcagttagtacggtatcgatttatcattggagatctgcagtgttacagaagcactgctcaccagttgtctacggaaggacgttgagatagttttaccacgtttgagctaaaagtttctaccacaagagcctttatttgcacatggcagtgaatgcatgattaaggatatgaagaagaaaggaataactaggaataaattttatttagagagggtatgatgaaaggagagcctcgttatttatgacctgcatttttatcagcatcttctttccagctcccgctaaacatgtgctttacaaaagccattttgtcgtcactagactgggcgcccatctgccccacatctggtgaaaaacttgttattggtagaaccatcacatcatcaacgataactggttctttcaaaaaagagaagaattcccagggcattgaatttgacgattgcaaagactctgatattttcttataaaattttcttgttgatttggacagcgtatcgttatcaacatcttttgctggtgtggtggcactctcactaccttcttcgtcgttcttgtttaggtttgggttgattaacaagatatcgctattgtatcggagcacattgttcatgtattcgaaaataatgtcggagaaaatacctggacccgtccaattcattatatctgagccatcaacatttttgttatttttcaattcggagtgtttgtaggtctcatcatgacgtcttttgtgcctatagtttacgttgtagtcttcttcaaatcttggatcaatcatttcactgacaggaactcctgggttttgtacgctcgccaaagtcgttgcagtaatatttaagatcaattctcttagaattgggtgacctggtttggcttggatagtccattgacaaaactggatcctacgagcataccattcactccaatcatctctgtccggatctgcctcaatgccgatgaccaaacctggctggtgtgatatctcatcacttgagagaagtgagggctttgagttcttataaggaataggtttattcaaatctattatgttgtttagccatgacttattctgagaaggccatgaatcaattggcttcaaaagcatagtatccatatctgagtaaataccacctcttgcaaataataataggtaccttaaaaaatctgcctttaggatatttccaggcatcaatttaaacgcttggatgactatcggaacgggtgcgtaaagattctccaaaaaagggataatagaatcatccgaaatcagagaatattggtaatccggtgaatacgaaccagaccatgttttttgataggttctgaacgaagagggaaaattcttatcatctgcgccgactttccaggtctgccacaccctttgcgggatgggggcctgagagtcgtagggaaacgcaaacgataattgatcacgtaaattatgcaattgattttttttcttgttaactgtaatttgtttcttcaaatttatatcttgtgaatgagaagtcgtagggagaagagtttgcttgaaatcatctttgctagggtaaaactgagaaagcagccttttgtttgacaagtgaaatgtcaacaaagaataaataagaagtacggttacgactattgtttttgatttccttgtagcgatcaggtgggacaacttcctagacatgatctcttctttcttttacttgctttctttttccaaattgctattattgctcttgaaatgaaaacggaatcaaagaactaaaacaacctatccctattaaatataaaaggatgcagatggggagagagaatgtggattggcgagaaataatgtcggtattcgaagaaggcagaaatactaaagtggctaccaagctaccaaactaccttaatgcagaagttttgacgttgctgtccctgcaacgtgaaaagtccaaaaaggcgcgtttagttgaggcccagccaaatcttttcgcggtgggccggccaaatagtttaagcaatttacccaaaaaagaataaagagaggcgtaaagacgttagttaatattttattattccttctccatatgtcggaattcggtgtacatacatatatatagatattgttatatagatttgtgcatttgcaagccaccctagttcatcaggttgaagaagtattattcagctcttatttatccacgacattgatgttgtgggccttcaactcttccttaaccttattgatgacttcgggatcatcgctgatgggtcttgtgtaatccagcaggacagtggtcttataacctagttctgcagcggaaatggcggtggctttgacacaatactccaaagctacaccgacaatgtaaacctcgtctgtatgatgcttttctaagtacttgttcatgtcggtcttatggaagttccagatgtcgtggaaggcggagtagtattcacggtcagtcaagaaacccttgtcgacaatcttaatatgcttagtgaccacttggtccattatttggtcaaccaattgactaccccaggtgtttttcacacagtgtacgggccacaaaataccctcttgcgtggaatcatcgcctggccttggagagtggtaggtgtatgttgaatagggttctttatctttatggttctttgcgaacgaaatatgtctggaagggtgccaatctctggtgaccacaatcctgtgccagtctctatcagcatcttgcatcaaatccgagataggattgattaattcctcaccttttggaacagtcaaggaacctaaaggtgaaataaaatcattttgcatatcaacaacaattaaagtcttcatttttgtactgtattttattctttctaacaaagatatagataatcgtaaaagaaagttttgtttgaaggtttcctcacctattgcatccaaccaggtaccagttaagagtacattgtatatgaaaatatatatatgagtaatatatatatatatagttttattaataactattagcacatcataatcgtatctggagacacatacatagtgggccaaacggaaacccctgccccttgaagaacttttttttcataattcacttttccagtacgtaacaccacgcggcgcccctttgtgggcctgcccctttttttttttctttcttttttttcggaaacattccgcgagatttcggcacgtcccaaatgatatcgagctaacacgtataaagcgataacgtatataacgacgtatgattttagcaacggaagacgttaacaatgacatatggatatttatttatatatataatataaaaatttcattaccctgtgtgccaccttgatccttgacttaatatatttttttctgcttggatctcggcggcagttttttctgtttcatataaggaggatcgtagggaaagaggaaaacaaaaggcataattaaccaatagcaacaatataagcagtacagaaccctcaccaccagaatgcagaagtgtgctggccatgcaccactggtgactgcagcctcgcgggtctcccaagacaccgtagacgctcttttgcaagctattttaaaggcctaccataaattagcttcgatcgacagtcacattaatgatcctgttgaaatagccttcaagctcataaactcttttaagtatctgccaatttcaggctcttctgtaaaagattttgagtcggaactgcgggagttagacgttttttctccccttttgcagtcagccgttactgctgctaataatagcaatatcatatgggaccttatagcggtgttatttgcatacatttccatccataaacagctccatcctttgatcctgcacaatctgaacatatggaaggattttatggcagataatgacgaagaaacggcgacaaccacggacggggactcaatgaatttcggcgtactgtcgcttctttccattgttcaaaattttgaagaaataacgccaaatctatttgagtttctaaagctcggtttgagatccactttactcaagatatgggtagcacaatggcaaagatacgatccttcggcaacgaacttaatcaacggtgatgagaaaatttctagctggataacaaaggattaccaggtggatttttttatcatcacttcattagcatcaacgtcctcattagaagttttgccatctcattattttgtgtacaagatctctaaaaggatctctcacttcccaaatttaattgatcctaaactatatcgatctgcaatttctacaataatggaaaatgggatttcagacaatggtggtggtgagaactccagcgacaaaattgatccgactgatttgtcctttcacttacaagttttaatggaagttattgaccatcctgagttgaattatttgcaggaaaatcgattaattttgttgctcgacattgcattaaattatttaatcctggttcctactcactgtttacattcaaactttggtgaattgggctctactcaaagtttagcatccactttaaatatcattcagttccttctatcgaaattcttaatcaacatgggcagtatttcgcaattaattaatcaatacaacaggaaatgcatcactactaataacatcaataataacaacattaacaacaatggcgttattaatggtagtactaacaccactagtactactactactaccatcactaataacaataataatagcaataatagcagtattagtaataataacagaaaaatagactggacgcaatcatatcaaacgaggtaccaaattccatactggtttgaggactcaattttgccaccaattccgcctatttcgaaatcgcttttcacttttgacaagaacctagaccatgagtcggattcaattatgattgtaaatgatgtattacgctgtttgaatttaaccattcttttaatttctaaacttctaagggattatgatgacctgaagattaacccactaattcaatcatcagatgatcacagtaatgaagacaatcatgtgataatagaacaatacatgcagctttatctcgttccattatttacttcattattattggcccaacaattaaaagaccgaggccaagaacgagatgaaggacataaagagaaagaggaaaatataaatctcatcgggtcttcctcagtcaagaaattattttctcaactaattttttttagctctttgaaattgtgtgaaaatttggtcataaaggaaaaaaatttagcactatatcatttgatcaaattcgcgacaaaggtttctctggatgatttgattttacaaaaaatatccataaacttattgaatcatttgttcttccatcaaattagggatggaagtgatgatgataatttaattaaaaagttatgtttaaaaaatcaactttctttccaagctttgaaagattacatcacattgtggaatgacggttctgaagtttataatgcattttataaggagcttttctatgaagagcaaccaaagattaagccaataaaactaacaacatctgacttgctgaaattattccctgaggatgttcaatttgtgatatccactccaccaaatacaataacttcagcatcaacaagcgataattgtacatcatcacaatcagctgcgcagaaaaatattgaaaactttactacgttatcgaagtacgatgtctactcgtccacatctttcataccgtccacgtcgaaaaacactaacactaacgttagtaagcagcagcagcagcctcaaaactctactccatgttcttccaacaggtttttgttcaacaaaagcagcctaatttctcaggaaagtaatggtagcaacaataacagcggcacacaaggacctggttccatgaatgagagttattctcttgacaattcattcaacacaaccaataccaatatgacgagacaaccaaccaccttaactagagcaaccgatgctatgactacggcacctacgacaccaattccatacaagaacactagtggaagcagcaataacaatctatggattgaatcgcccatgacaaatttcaagggttccaccatcagtaaaagtactaataagagcaaaatggttaatactggtaaaaattatattttagggggccacaataaagttaaaaacaacagtagagctcaatcaatacatatagatgactttgaaaatgagaacaattaattatctctgcggaagactaagacaatcaaaatatgtattcttactatcataattaaatatttttatcgttattaattattattattattactattattattattattattattattattattattatttattatttattaattattaattgttaatattattaattcttgtctattgtcttttgatttatctgcaccgccaaaaacttgtcagcgtatcagtccatgtgtgggaagggcaacggtaaacttcttatgggtggtaatgtttccagttcttgaacttgtgaatccgactgagaaatgggggtttgttgggtggatatagcagtattaatcatattcacccttggtgacaataataacggggttgtacttaacgaactactggaagccatcatttgattttgattttgattttgactttggtttgacgtattttgtgattgcagtagggtatgttgctcttgctgctgttgttgaacgttcagtaatctgttgttcaactccttttggaaatcaggagatgatgaggagaaatgcaagtgattttggttcattacataccccaaagtgtgcaaattcgtaccactagtggatctacttagcattgtcgtgggcgtggaagtcttagatttctttcttgattgctcttgcaaatagtcttgctcaaggttatcgatactagagttagacgggtcctttagtccgtcttcttcatcctcaccaccagtagtaaaatcagagtcagattcgttggtatttctttggccaaccaacaagtcgttcaaacttaaaactgaacttggtctcttcaactgtacggaactctgagtttgtgctctgagacttccattgttgtttggatttgcattgttcaatccttgaaaatccgttaaagatcgcggccttggtaatataacagtgttggaataacgtggtgaaagagaattttgttgttgttgtagttgtttctgttcaggaccgtctatgaaaacagtccttggcgcactgctagcaatgggcgtcatcatttgtagggacgataacgcgttcagtttcagtctactgccactatggctattgctcaacgaagacaaagcagtggaagcggatgaagtttggtagttcatattattcagtgctaaagaaggtggaggcttcaccgagacgggaatcttagccatcgttttgggagaagaaaccatatatgggtcattcccaccactttcgccgatttcgaatttggtttttctaccttttcttgtagaagatcgacttgaattttctttcggagcaatagcaataggaattaaaggcgataggtgttgctgtggtaatggcggtgaaaaatttgccgtatttaaatctggtatactggtagcactagaactagcactatttattggagagcccacaaccttcttctttctgcctcttttacctcgagggtgggagtttgtatgaattcttctgtgtctcgtcagttcatcgcttctactgaaccttttcacacatccggggaagtcacacgcgtgaggcttctcacctgtatgaattctcatgtgtctcgtctgatgttccagtctgtgaaaagctctatgacagataggacaagcatgtggtcttggcgcctctgacttcgcagctactttggacttgcttttactctccttcaatagtgacccatcatcaacgttagacacttgtgtcattggatatgggctttgcatggctatggtagtatgtcgtctccactatactcaactctcgtgtagttacaagcgagctagaataaatggctctcttatcttcgaaatgctttaccgggctttcttactctcctttgtcttcgttaatgagtactggggtgaaaaaaaagggttataataaataaattatccaagaacgactattctcttttcttttttctgcttgctcttccccacttttctcgtccagcctgttgtaaaaatttgttgttgcttctttcgtattagtttttccgaaagaaagcgccgcagggcctttaccatcactccaggttttcccggagtggggtggcagtccgcagtctctcgcgaaatcaaaggcaacaagcagacacgtggagaaaagccaggagaactcaagagctcgaacaagtatgctagcaactaaacaagccggcctacgccactctggagtttctcgcggggcccggccgctacaggtttcctgagaagccattataatggcaactacattcatcaacactccataaaatcctatcgagttacactgctagtgtcgcaattgcgcttttctgctgcttaattgtgggccccaagctcttatcacttgctaccatcctataaactgtatggaatgccatcacaactttcggaaaaataaagcgcttttttacgctatcagtggagatattacgaattaggcacagggaagaaatagataaaaaattcatggggccaaccccagacgtcaatcttctacacgtcaagttttgaaaaaaattaaataaaaaataaaaaaaaaaaccggcgcgaaggaaacgtgctggctcgctaacttctagtcttactgtactgactaccttccagtcctactggttatactgcattgtacggcaacttacacaccccacgcacttactttcctccacaatgccatctagaaaaatcgattacccgctaattttccgggaaaaagtcgattaatgtaggttagtggcagctatgctaagcaatgataaaggaaccatacacgatatttctacagaaggctattaaatagggtgaaataggatgaagcaacaatcaaaaattatgaaagcatccgttttctcgctattctaataatgggacagaactgccaattcttgatctggtgatccatacgattaaaataggggttcatcgcatggaaagtctgtaaatcacacttgcctaccataaggaagtcatcaattcccgaattttaaacgggtttctatgagtatttggaggatgttcattcttggtaacattactgatgacattcagtgatacactgccttcaaggaaacacacgcgatagaggcaaaacaatgttgcaacggcaattaatttctgtcattgtaatgaatttctgctcgttgcttctaaccatatcttgtgtaacgcttgcgttgatatgcaaaaataacgagatggaatttgctgccctctttcagccatatgatggcggcaaaaactttgaaatttgtgcacaggatataataagctacttcttgactctaacgccgtactacagtttacaaaaaatgtatacaaactcttaggattggtcaagaaaagtaaatgttgtactgctccaaagatattgcgatgccgtgataattcaaaagggtcgacccagtctatttcactcgcgcgataatcgttcgttatccgaagctggccaattgatacaattaattgacatcagcagacagcaaatgcacttgatatacgcagcttaaagcaagggtaaattatctgaaaaaggattgaatacaatcaaaaccttcacatacattggtagtaatatcgagcatcgctattagcagagtatctcgaagtctaccacggcgaaagttgattttttatctgaggtgctgatcttcggacgcaatgcgcaaacgtaattccgtagttttcccaattattttattttttaaattacacgtaccaggtagatcacatacatatacccaacacctgttatatagtgaattgaattattcggaacatcaataatcctttgcttataattcttgttatcatccatcttgcatctttatttaattatattttgcacaataagctatctatgtgagctgcgtacggtgactccaaacaatctgttaatttccatataaataacttgtagtcggatcgtacaatggctctatataggtttggaccggtatgtaacctaatatggctgactcaaaacctgctagatagttatccaagtgaatttgagtctcgtatcctttatcacatttttacaatagtggctagctatctttttcatgttaggctcacccggtattctcatgcaagatcaaacaaaaaatggtaaagttttggactttacattgcttacagttgcttttttatgaagattcaaaagattatgtcctcggcggctaaattttccattaataatattatccttttacgcgaccgaaaaagagaagcgttttaagagttgtttctaacaaatattaataataaagctaacgtgaactgaccaggctctatttgaaagatatggcaccgaaaaagaaatcaaacgatagagccattcaggcaaaaggctcagaaggttaagtatttttttacatgctcatcaaataccgccattactaacaattgtaccccgggtattttatcagctgaacaattaatagaagattacttggtgtcacaatataaaccattttctgtaaatgatatagttcagaatttgcacaataaagtgacaaaaacaacagcaaccaaagcattagaaaatctcgttaacgagaaacgcatagtgtctaaaaccttcggaaagattataatttactcttgtaatgaacaagatacagcattaccaagcaatattgatccttctcagtttgattttgaaactgtattgcaactgagaaatgatttaatagaactagagagagataaatcaacggccaaagacgctcttgactctgtaactaaagaacctgaaaatgaagatctcctaacaatcattgaaaacgaagaaaacgagttgaaaaagattgaatcaaaattacaaagtctacaggatgattgggatccagcaaatgatgagattgtcaagcggataatgtctgaagatacgctgctacaaaaagaaatcacgaagagatcaaagatttgcaaaaacctaattgctacaataaaggactcagtgtgcccgaaaaatatgaatgaatttttggtatgtattttgaacatttttcgagaccttttcttttgaatatactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatatagttgtcagttcctgtgctaaaactgaagcaataacagaaaatattgaaaaacagcgaagtaactgcatcttaattgaaaatgtatgaagtaggtataatattttggcacacaagtgactgttgagagcttacaatcattctagaatgaggaatacgtcaaaatggaaacttaacatatcacctcttcttacaactatttatattgtatatttacaagggaaatcaattgcctgatattcagtatattggatctgaaggtatgaaacagtcccttaattaagctttagatgcggacagaagtttttttgttaaacttgcatgtcaaatttcaaactgcgtgtaattaccgtattcggaaattacatggtttcagtaattttgcaataaacgcagcaaccggtgatggcgaagttttaccatcaaacaataacttataataactgaatgccggcaggttgaaacaaattcttgaaaattagtcatttattctattgtgcgaatgtaatccactgaaatcatctaaagcaccattaccattgtctagcctgtgaataaaaaaatatgggagtataatgatagagaagtggatggtagattatacctcgcgaatgaattatacagaaaataatactaaattgaaatatttaaaaatgatttaaaagaaaaatattcattgtacataataagttcgagcataaatcttaacgagaagtagcagcaaccttttggaaagcacccttagcttgttgcttggagaacttagaactttgagtaccagcagacttagccttttcagcctttctagcagccttttcagccttcttcttttctttgttggccttcaatttttcttctctgttagcctttctaacttctggcttcaaagatcttctttccttgatcaagtccaaagaagcaccggtaattggtctttgggccttaacggtttttctagatctcttcttagcaacttcttcggtgatacccttcttgtgatgctttctgaataagacagtccaagcgattcttcttgggttctttctttgcttgaacaaagaggcagatttggagttttggaatctgaagattttggagtcaccacggacaaacaaggtacctctgcctgggtagattttggcacctgaaaaagaatcgatttcaaccttcattttatcactatattaatccacgtttttcaaacatatttgaaaaaaaaaatgttagtaagtctatgcttttcataggtagccatcttgtcaatataaataatggtaatccgcatggttgttcaggcgttcgcaaaattgtaggaagaggagaacgtggaaatatggactttttgcaaattcagaattcattttactaggttcttgcaacatggataacatctcacgctgttatttttcatgcttctccatatcgtatatatgtaatgaagcattttcattgggtttcctgctcaaaggttgacatatattataagttatactggaacaagccacaatcctgtcaaagtctaaattccggtgtattggctatctgaagctctctcatatattaatacattgctttctagcacaacgctgccctcggtcgccattaattatgaatcatcatcatatagggacatacctctcaagttattgtcttggtgtcttgcttaacttggcaatagcaacagcgcaaactgcgtaaacgtactaaaatacacaccatccgttgaatatatcatgcagtacattgacagtatatcacttctggataggacgccaaccgccagtctgtgtggtatttcctcccgtctctgcgtgccagacgggatcagcccgtctattctcgtgtcgtcctgcctggagagactgaacccccatctagcaccgcagtaaggatcattactttgtaggcgggaaataagaggttcaacaaggaccaaaaaaaaaaacactaaaatctgagatcaaaaatatgtggtgcacagatgtaacgttccaaaatgtatggatggtaaggtctttttccaagaaacgtatctttttttcagctagggccgcatttaaatttttttttttttcaattttttttcctattggagacggaatggcaaagctcacgctgggcgatagcacgtaaccacgctggtgtattttcatcctaatcattctctttcatctatttcgataagctacttaatgtcgaagttttaacttccatttgttggaatgttcattacagtttatacttactccttgctcttttataatataaccaaacagaccggagtgtttaagaacctacagcttattcaattaatcaatatacgcagagatggtcagtataacatgattttataactatttcgctttattctttcatgggattagcaagaaggcttggaatacaaacatgaattttcaaagtttattcctgctcttgtgtttgagagagtccgttcaaaggatgcttctccatgactgtgaaataaaagtgagatatgcaaaaactttgaataatctactaacaagttaatacgttattttttatcgtttacatttcaacaggccccagttaaatcccaagaatctatcaaccaaaagttggctttggttatcaagtctggtaagtacaccttaggttacaagtccactgtcaagtctttgagacaaggtaagtctaagttgatcatcattgccgctaacactccagttttgagaaagtccgaattggaatattacgctatgttgtccaagactaaggtctactacttccaaggtggtaacaacgaattgggtactgctgtcggtaagttattcagagtcggtgttgtctctattttggaagctggtgactctgatatcttgaccaccttggcttaaataaggtaagttcaaacgatttgttggaagacaattggtttgatgtgtatttttctataatatataaatcttagactattcattaaccttattttatttaccttctacccgaaaatgggtttcttttgctgaaatagttctttcatgtaaatattgtttaagcagaaggcattctttgccctcttgctcgtgtgggttcctttccgctaataatcaatcattctcatactgttcaatatcataattatctctgcgacgatttttcatccgcctcctccgaaactggaaaaagcgatgagataaaattttcaggaatccatcagcaattttatatgatagatagaagtctattacgttgagcttccaattttaaaggaatactgtccatattcattgaaagcaaaataaaacataaccaggaaatatggtgaatgaaacaggagaaagtcaaaaagcggcaaaaggcactccagttagtgggaaggtatggaaggcagaaaagacaccgctgagggccaaaagcagagtcgttaagaacaagaagttaacatcatgggagttgaaaaaacaaaaaagactcgaagataaacagttcaaagaaagattgaaggctttgaaggatgagaaggaagaagctcgtcaagctaaaataaccatgttaaaggaaagaagagagaagaaggaagagaatgaaagatacgaacgtttggctgctaagatgcatgctaagaaggttgaaagaatgagaagaagagagaaaaggaacaaggctttaaaagaacgttagatcgaaattctttctcaaaaaaaaaaaaaaataaattcatatggataagcacaatggtataaagcattatagaaggctcatagatacacaggtcaataacctacaatggttaatatcttagcagtaattgtatagtaattttatttaagaaatatctctttaagaagaaaaagaggtgcggactcattattaagtcctgacaaggagaaaataagggcatccctagacagttattattcactaaaaactggaaaaaactaaaaattttttgaagcccgtatggcttattatgcgaattctgtggatcgaacacaggacctccagataacttgaccgaagttttttcttcagtctggcgctctcccaactgagctaaatccgcatatattttataggaaaatcatcaacacgtacaaaccacataaagcgtaaggataaaatcaaataacgtttgaactgacactaatcgggccaaataataggagtatttattttaatttattccttgacttgaataagtatgaaattttaacaaccattctaaaaattaaaaattgataattacctgaatgttataatatacaaagtgaaatgataatgtagatatgtaaatgaactgaataatcccgtatataagaagagtaagaagtactcgtgcacatttcaatgccaaacttacattcttgcttcctgtcttctttattttatctttaacctataccctggtgtatttgtagttagaaattagaaccgcaaatttgtaaaacatctatatcgttaatgtcgtaatggaaaagatctaattactgttttctgatcttttatatgcatgtttctctattcgatttagaaaacttatggaaaatattcaatcacaccgaaagattgttcgataccgtaatcaccgggagccttccagtaatcattgtaagtcgataagattgtaacatccaagtccatttcattcaagatgttttggactgcagtaatttggttagcagtggatggaatgttgcctccattttgaataccagacgatgggtaacctgtttccgtgacgaaaacattagaagtaccacaaacaccttgaattaattcaacttgacccttaacaaatgtaccggcagtttcagcactggcgctagtatcaaagtaggcatgtgggttgataccaacgaagtcaatatcagattttttgcacaaatcagggttattttcaaatgagacagggggctcactggtagtaatttggccagaatagccagcttcgcttaatttggatttgacagaggaaattttactaatcaaatcagaaactgaacaccaaccattattgatagcttcatttccaacagtaatgaaatcaaagacatcccaaccgttagtttgaccatattgaatcaatgtggtaacagaatcatctatggaatcaacgccgctactggtgatatacaaaccttggttaatcttaatacctagttttacggctgctggttggacggtttcaaaggaattacagtcggtgccataaacacggattttggaaatacctttagatttgatcaacgttaagtcagaagagacagcgtctgcagacttacaagagccatcatcattatatggtgaatatgcaatagcctttggagaagaagttatagcagcgctgctactagaggaaccttcagaggtggtagcggctgtttcctgtgtggatgaagtagaggacgaagtagaggacgaagtagaggaagaagtagaagaagaagtagaggaagaagtagaagaagaagtagaagaagaagtagaggacgacgtagaggacgacgtaggtgtattggttgattcggtggactcctgagaagcaattgaggtactcgtttgttgattcaaagttgaagtcgcagctgcttggtaagaatgatgctgactttgagtgttgccttcaacattggcttcaccgacaccactcacgatattttgtgtggaagtagacgtagtggtaggggaaggagaggaggagatagaggtagaagtagtagctaattgttgcacatcctcactagtacctgcagaaacagacatagcagtttgttgcgtagagacggcttgcaaagtagattctgcttgaaaagaggaggttgattgtggaatagtgcttggctgcaaagtagaggttggctgcgaagatgtactcatttcagccttttttaagagaactttagtgatagtcgtagttggttcagctgttgggttcacaccttgtggaattaaggttgttgtaaaggtaacactatcgcttattaggaattcgacagttggggcaataacaacttcggtagtagtggagtaaaaatcagtcacaacattagttgtgcttgctgtgtgaactctcgttacaacttctctcttaggaagaatcggtaaagctgaggttagataagttaagcatagcagcgatgatagaaagcttatgggtgaaatcatgatggttttctattagatattatatcaatgagtgtagcgtaataataagtcgataaacagtacagagaatagaatagatttattacagtggaggtatgtcagtaaaggcttattcttctaaaagagtggactgtctttgttgcgtaactgacgattatagtactgttgccttaatatataacagtgtatttggataagcagaaggaaaacacgatcattgaacttcaattttctttccacttaaatagtccctcctcagattcttaatttgttttcggtgcagcatattttgttgtcagtccttacactttaacattttgagatctagtatccagcttgtaaacaataacattccctaacttttattcatcttaccgcagtaaatagaaaagacctcacttcgcaaccattaatccccaaaagaaaaaaaaaaatgtgacatttcataatgcatgtttcgagtgtgttttcgattgtttatttgtctggcttttagctgcaatggcccagactgctagttaccagttgctggtttccacgattttttaactttttctcacagccgcatcgaaatgtaaataaacgcgagaaaaaaaaagctgaaaatgctggctctaactaagagatgcgaggcccttttcgaatagctggaacatttataattttcatcctgcatactggtacatatctggttacatatctgtttatatgactgaaaatatctacatagattcagaagcgtccaaggatgttgacaacaagtgctgtccagcctgtgaaatgctcagcaccagtaccatgaccatctatcggactgtaattttcataacaataaccttgttcttcccaaactttgtatatgttgttactgagattaatctttaaactttggtacagtttcttggcattgctagcctcaccagccacgtcgagaatcacctctgggtagtagtatctcattgcgtcaagacacaagtaattaatattcatccaaattgggcctctccaatagttttcatccttgccgaaatagtcgtcttgtctcgatagtgataacagcccgtagtctgaaaagattttttctgggtcactcatcaaagcaactactttctctagcttgggtgagtttttggggattagcttcaatgcaaagggcaatacggagacgtaaccctcatgacatacaaactccctaatctcatcgtcttctggatcgatgctaatatcacagtagcaattgtcattttcactccagtgtaacaaatccagattctcgaccacctcttgctcaatttgtgcatatctttgctcgtcctgtgttaacttcaacacgtgagcaatttgcttcatggatcttgtcataacgcccacccatgctaatgcgtctacgttcaattctgctacatctggtggttgtgctctaggatagtcatccataccgcttggcaaacaatgagtgaaggtacgcccaacccatctataaacttcgttcttatgaatcttatcccatattccttcatcttccaatatttcctcatattcatcaataagtcctgtttgagattttctgaaccaattatagtgcttcaatagcttaggataaattttcttggcatattcggttagcaagccaggattggcttctagattgttcgtcataaacttggctgtcctactattgaacatgacttggtggtagctgtcactgttgaaatcgccgatgttttcaatggccctagaaagcatttcactaaatgctagcaataaagttggcggattagcaatattgggattttgcacctgaaattcctgcggaactttactccttgcctcattacccagtataatttctctagcaatccaaccactatcatcttcgatcatttcaaaccagctcgctaagatttcaaaggcaaggtcaaaatcatactccataatttgtagaagatggaaaccttcatcccaatagaatccacgtgggaaaaagccacggctcggaacgctggtaaacagttcaaatggaccttcctcttttgcattcagcagtttgatctctgtaaactggctctcatcaaattctgtttcacgatcaattagttgattcccatagaaataaccgattcctcctaataggtttgatagcgtctctaaagcaaatcttcttttgacctccacgctttcaattgagtcgggaccttctccaaaactaaactgcttatcaaaacgcgcgtttatctcatttagtgaccaagtaatcaactccgtaacttgttccctggtggaaatactttgagtagtgccaagtttattgtaagtgatatcaaattggaacccatcttttttggtcaaatcaaatgtcttttgtatataatgaaaattaccaggattaaaattgtacaaatttctaatagttaaaacacttggtattaaatcagcaggacgctgctttgtctcttccttttccagtatatcacgtatcgaatcgctaactagagattggaaaacatcacgagccttccaaacttctttatccgggatttgaagtgataaatgacttgttttagagcagtcacttcctggtgctacttccatggtttcatattccggatttttgaagtagtgaccaaaattgtcctttactgtaagatgatactcgcctaattctttagaatatccgaagaatttcatgtcattagggccgtcatgacctatcattgctaaggaagattttccatctatctcgccaccattttgactaaagtacaatacgacagatgctgtagatggtctcttgggatccaaaggctcaccttgaactctcactgaccaattttccccgttcttgctctttacaaaataaacagtcaagttcaagttatttttttcatcaataaaaacttctttaccaccaattcttggatcatacacttcccaaccatacttttgcaatttatcctgaggcgttgcaaaatgtcttaacgaatgtaagccatcctgactcaaactgttgaaccacatgatacccataattagtggactttcatggacatatctgggcctcataccaaagtaacaattggatctatacggtgcccacagtaaagattcattcgtgaacttttgatattcttcgaattcttgtagtttactaatatcaacggtggcagatgccaggagaactatgctggttagtatccaaaatgttttaaacatcttagattttgaaataagcattgtgaagcaacctgaaccgttattatccactacttccttattaacagttgacgctaatatagtgtgtcacgcatacaataattgaacttttaaattacgcgaaaatgtggctgttctgaccgaaatgatctaaaattggtcacgatactaatcttgagcaaattgagaggtaaaagagctgaatatgctaatgtatcccgatcgtatattatattcgtctatgtagttaaaaagctaaataaaagcgttccttatcagatattactcattaggcagatgggtcttcttcgaatctcaaatcccaacctatctttggacctaatttcggcaagacttcagcgacactttggacatctttatcacctctaccagaaatattgataaccaaatgttgatcaggcttcatcgtcttagccaattcgcaagcgccataaacagcatgagaagattccaaagcgggaataataccttctaattgagataataatttaaagccaagcagagcctgagcgtcagtagctgcaatgaattgagcacggccagtagatttccaatatgccaattctggaccgacacctgggtagtctaacccagcagaaacagaatgagtatcatggacttgaccatcactatcttgcaagacataagtcttgacaccatggaagacaccaggtctaccggcagttagagtagcagagtggaactttgtatctacaccatcaccaccggcttccacacccaataacttaacggaagtatcatgctcgaatggtgaaaacatacctgtagagttggaaccacccccaacacatgcaacaactgcgtcaggtaatttaccattgttcatggcagcaaactgttccttggtttctttaccaatgacactttggaaagttctaaccaaagttggatatgggtgaggaccaatggcagaaccgacgacgtagtaagtagttttcaagttagtaacccaaaatctgaatgcctctgaagtagcgtctcttagagtctttgtaccattagtaacagcaattactttagcaccgagaattctcattctgaagacgtttaaagcttggcgacgaacatcttctgcacccatgaacacagtacaggttaagccaaatttagcacatgcagtggcagtggcaacaccgtgttgaccagcaccggtttcagcaataacgttcttcttgcctaatcttttagctagaagaacttgtgctaaagcattgttgatcttgtgagatcccgtgtggttaagatcttctctcttcaaccagatttgagcaccttgacaatgctcagttaatctctcagctttgtgtagtgaagaaggacggccaatataagaatacaaggatttgaagtcttcccagaatgtgggatcggcgacagcttcatcaaaacccttttccaactctcttagacatgcatgaagagcttctgggacatactgaccaccaaagtccccaaatctaattgggtgcttgtgattttcatcaaattcgtccagtatttccttcttaacgtttgcggacttcaaggactctttttgaaaggcaaagaattcgtccttggacagaaccttatgcttagcaccatttagaattccctgtacatattccttagcaacgtcgtaccttttgccctctggagcatctccacataatgtgacgattttggaaccaatcactacaccgtcagcaacactaccaactgattggaaatgttctctggtagagacaccaaacccaacggccaaaggagtatccttggtgtactttctgactctagagatgagttcatccaaatcactggccacagaactttgaacaccagtagtacccattctagacacaacgtagacaaacgaatcggcaatatgcgatagtaattccaatctttcgtcggtggtagaaggagccactagtgggatcaggctcaaaccattatcattgatgtagtttctgaccttcaacgcctcctctggtggcaaatcgacgatgataaaaccattagcaccagccttggcagcgtcctgaataaatctttcttcaccgtagtttagaatagggttatagtaacccattaggattatgggtacggtaacaccttcatttctagcttgggagaccatttctagagtttgaggcaaggtaacaccgttttgcaaagccacagtattagataattgaattgtaggaccatctgcaattggatcagagaagggcatacccaattcgatgatatctacaccaccatcctggaaacccttgagaatagggacagtgtctttgactgttgggtaacctgcggtcataaatgtgaccaaggcgttcctgttttcttttttagcgttagcaaatgtttgtctgagttgttctgacatggtctgtcggtgtgctatgtccctttttggagcaatcgatgtttacagtccataaaaagtgtaagaatctcgatgattcttatatgacaaatagtaaaattagtcattcttccacggtcaagaagtgaaaaaaaataaaaaataaaaagaaaagcctttcgggtaataaggtataaagaatagaagattatacagataattactatcttggatacatagatgcaccagtcacaagaaatccatgttcagaccacctaattccagattgttcaggtctagagaatccagttctttccccccgttattcatgttattcatgcccatattcatattgtactgtggttgaggctgctgctgctgctgttgctgttgctgctgctgctggaaatcgttattcatgctcatatttaggatattagcaggggttagattgtttaggtttaattgtgactgtagcggggtgttattggagtttgtatttgtatttggattggatccattgccgctgccattgaattgtgacatagatacttgtcccccttggttttgagctcccattgagtatgcgttccccatgggagacatcatgttggtcagcggcgtgcccataacatttgtgggcgaaacgctgttaatcatgctaggagttgggttgggtagcgcggctgccatcgatgctgttattggcgtctggacagtcgactgctgtgcgtagacctgcgcttgagcctgcgcttgagcctgagcttgagcctttgccttcttggtttgtcttggttttcttggctttttaggtgccgcaatcggtgcagctgcagtgctattatgtacggttggagttcccatagtactaccgctttttggacctctcttgccggccaggggattatgttgcattgtagcggtgctatttggattcgaaagcgagtgcgcatgtgtgatgggatttgcatgaggggtggcagttgtggtgggtgtcgaagcggccgcagagtggttggtgcttacaacagttgctgtcgagcaaacggcgttgccatttttgttataagtactcaacggttccaaaagctggaaacttctgtccctgttatctgcagtcttcaagtattctggtacagtgctgaataaaggttgcagtgcttctaaatgcgaagacaaagtctggaatctatcgttcagttgcaaaatcttgtctctgatatgtaggtatttggccatacggtcagcctgcttggatccttcttggtctatgtttgccattatctgtatgaattcattgaactgcaatcgcaacggcagaatttcatcgcgtgcttcgttgatctgcttacacactttgtccctggtttcattctcgttcttagccaatatcacttgtaaatcatctagcttgacgcctgccggtataatcgagtccattccggttgtctttactgctgttgtgtccgttttgcgctgcctaattgaagaagtcttggtgactgtttctgttgttctctttaaaatttcgctcggcgccataccgaaaatcctcaggaaagtgttagtgttatatattatattatattatatcatattatattaagtttattgtatacataatggtcatacatcaatagtgtacatcctctcttcgcttgtctcgcaaaaaatgttcatcagaaactactccaattccagtttgcaggcacagagccgataacactgcccaaaacatcattaccttcttcttgttctccccccgtattctcattatctgcttcttcgtcgttcgacttcacctggatgggcgttgttgtgtctcgatcaaccgtggcatgctcttgggacgaaccgcccttctttggtctgaaaagagcgttcatctgcctattcttgtagtaattgcgtaatttcttcctattgtcattatcgtcatcttcgccctcctcaacgtttatgttatcctcgttcgtgtttgcgttatggttcgtggttgaaaggttctcgtactcgaccagacagtcatcgcatattttacagagagtgccaccgccatttatgccaccgttgtttagttcgttgatcattataaaatttgcctgcgagtccaggtacagccaatggcgcaaatggtcttgacaaaagatgtccccgcaatgcctgcaatgatgtttcctttcccacagggtaaaaggcttatggcagtaacgacaagaattcctcttactgtccggaatccagtggtccttagtgggcgggtttactctggcagagtttctgtttgaaatagttggtattaagttgattctgtcgctgttcggaatagaattcgggaacaagtacgaggatattttgtttttgtagctttccaagattgacgatgtgttggattgtacgctggattgagaagatatgatccgtaggttgttcgcattctgaacgctagcggattgcgacttgcttggattaaagccatgttccaggttagatgccttcttgtagtaagacgacaatgttgcattcaacagatcgtcattagttatgtttgtctctgaaactttcctcagcacggcggggatgtatagcggttttttagggttactgatctgtcttacatttgatttatgtttattggaattaaaattcagattagtgctcgaagcaggctgcggtaaaaattccagcgagggtttccttagcatctgctgatgcggcggtttcgccgcatgattcaccgaatcaataatgacgttcgtgttgccaaaccgcagttgggacatcgagctagaattcgttgtagtcagcttgtcgacaatattttccaccttcgacgtcgacgatgacgacactgaagacgtggacgaagatgaagactctttcgccttgttttctttactcaacctcaaattagaactagcattcattttgaacgacgacaacttgcgtaacgcctgcgtggttagattcttttgtcgaacctcgtcatcgtcatcggcatcatcttctaactcattgaacacagttttgctctttgtattcttgcccctgctaacatccaccacgctattggtgggatctagttcagggttcgatctttggtcatccgtgaatggcaacgtcttgccgatctccttactagcagaagccttcctaccatctatctgcccttcaccgagcttgctactgtggctgctgcgaacattctcctcagcagagttcttcctcaatatggacaccatcgccggagattggatctgctgctttctgtcaacaaacccagtgcctgcccctgttgagctctcttgctgcaactgctgctgacgatgttgatttaccatcgatttcaatgagatgctgctcaaaatactctgttcggaatgcgttgacgccctgggcgctatcttcttcttttcaaacgtgatgggagatgtcacggtgtcagcaccgctttcctcatcacctttcctgccacggtagtcatggttccttggtcccaggggaactcctctgccgtctcgctcatcaccgtcctcctcctcttccttgatcgcgggcgttttggacacactatgcaacgcagtcattctggtctccactacaactgtgctgcccagtcctcctcactggcgcttcgtacctattccaggtctcaatagtcatatcataagctttcttttacttctcttcgcctctgctaaatggtcaccatcgacggttgctttttcgcgctggtcgagaattgacaaaataagacacgaacaaaagagcaagtctgaaagaaagaaaagcagcaaaagcacggtctaattcaacgtgacatagcatccgcaatcgcattcacagccgtaaatcctaactaccattcgtcattatcacagctgccatgggatccgaccggtcgtgtgttttgtctgtgtttcagaccatcctcaagctcgtcatcttcgtggcgatttttggggctgccatatcatcacgtttgtttgcagtcatcaaatttgagtctattatccatgaattcgacccctggttcaattatagggctaccaaatatctcgtcaacaattcgttttacaagtttttgaactggtttgacgaccgtacctggtaccccctcggaagggttactggagggactttatatcctggtttgatgacgactagtgcgttcatctggcacgccctgcgcaactggttgggcttgcccattgacatcagaaacgtttgtgtgctatttgcgccactattttctggggtcaccgcctgggcgacttacgaatttacgaaagagattaaagatgccagcgctgggcttttggctgctggttttatagccattgtccccggttatatatctagatcagtggcggggtcctacgataatgaggccattgccattacactattaatggtcactttcatgttttggattaaggcccaaaagactggctctatcatgcacgcaacgtgtgcagctttattctacttctacatggtgtcggcttggggtggatacgtgttcatcaccaacttgatcccactccatgtctttttgctgattttgatgggcagatattcgtccaaactgtattctgcctacaccacttggtacgctattggaactgttgcatccatgcagatcccatttgtcggtttcctacctatcaggtctaacgaccacatggccgcattgggtgttttcggtttgattcagattgtcgccttcggtgacttcgtgaagggccaaatcagcacagctaagtttaaagtcatcatgatggtttctctgtttttgatcttggtccttggtgtggtcggactttctgccttgacctatatggggttgattgccccttggactggtagattttattcgttatgggataccaactacgcaaagatccacattcctatcattgcctccgtttccgaacatcaacccgtttcgtggcccgctttcttctttgatacccactttttgatctggctattccccgccggtgtattcctactattcctcgacttgaaagacgagcacgtttttgtcatcgcttactccgttctgtgttcgtactttgccggtgttatggttagattgatgttgactttgacaccagtcatctgtgtgtccgccgccgtcgcattgtccaagatatttgacatctacctggatttcaagacaagtgaccgcaaatacgccatcaaacctgcggcactactggccaaattgattgtttccggatcattcatcttttatttgtatcttttcgtcttccattctacttgggtaacaagaactgcatactcttctccttctgttgttttgccatcacaaaccccagatggtaaattggcgttgatcgacgacttcagggaagcgtactattggttaagaatgaactctgatgaggacagtaaggttgcagcgtggtgggattacggttaccaaattggtggcatggcagacagaaccactttagtcgataacaacacgtggaacaatactcacatcgccatcgttggtaaagccatggcttcccctgaagagaaatcttacgaaattctaaaagagcatgatgtcgattatgtcttggtcatctttggtggtctaattgggtttggtggtgatgacatcaacaaattcttgtggatgatcagaattagcgagggaatctggccagaagagataaaagagcgtgatttctataccgcagagggagaatacagagtagatgcaagggcttctgagaccatgaggaactcgctactttacaagatgtcctacaaagatttcccacaattattcaatggtggccaagccactgacagagtgcgtcaacaaatgatcacaccattagacgtcccaccattagactacttcgacgaagtttttacttccgaaaactggatggttagaatatatcaattgaagaaggatgatgcccaaggtagaactttgagggacgttggtgagttaaccaggtcttctacgaaaaccagaaggtccataaagagacctgaattaggcttgagagtctaaattggccacacattaaaggaaatgactaagataaaatatacatatataaaaagataaacaaataagtataagtttggtttcccttcccgttattatgatcgctcgtgacggatcgtctttgccctttttggtaaaacgtaaacaaaataacaatagaaaaaataacaactttatcaatgtttatttttatttattaagtatttgatgtgaagtagtttttctaaatgctacttcattttgacattgtaattcaattactatcaagtcatacccttaaatcgcaccaagtagagccccccatggattttgaaacgtcgttcgaagaatttgtcgaagataaacgattcattgctctagaggtatctgataatgatgacgattgtgacactgatttgactgctgacacagctgacgagctggaaagctctgctatcttaaagatgagggagtctgatgcatctttaaatgttaccaccggcaataatacatcaaggaaaacgacttccaattccaaaaaacgatggtctctattatccaatcattctgctgtttcatcatctaaatctaagaaaagatggtctgtactttcttcaagctttaccagtgaatctcataaggacagggaatcgaggaacgttttgcaacaaaaaagaaaatccttgcagagttattcaagcttagatacggtagcatctaatagctctatctctgcttcttcttctttgaaaagatcgtccactggtctttccctcagacaattgtttaccaagataggcataaacgatgatatatcacaacctgggatcgggattccgcaaggtaaggaaaatctgcctccaactatgggcaaaaaaaattcatcaattgcttccactagttcggaaaacagacttaggacaccattgaagccgcttgttaatcattctaaaaggcccacttcacaaccacaacagcaacaaccactatataatgcatcattgtcctcgagaagatcgtcgatttcttccactgtctcttcttccagctcgtctaaatggagattctggaagagaaataagaaccagacacctgcattgttgcaaccagaccaccattctttaaaaacctttcctgcagtaaaccgtcgtgattccatgacgcccgttgaaccaagaaatatggtaaaacataagacatccttttcagatttccataagactatcttcagttcaaatacgtattctgaaagcagcgatacaatatcttccatggaaattactttgaaaaacaaagcttcttcctcaagtctatctttgaacgtgttgaagaaaaggaattcgcaatcaagtttgaagcacaaaagttcacatgcatccttacaaaaattcaaaagaaacaaaggaaagtcctccatgatagcaccatcgacagcaactaatagcagcaatgatgactcttgtagctacagttccaaaaattctacgttgagtcaccgaatatcgttacctgtaccggaccaagtttcccgtgataaaattcagaacaaattaagatattcgacctcattactctcattaaattctaaatcatctttaccgatgaacaaaaatgatcatgatgagacacttctaagacagattttactaaattgtgatataaagagaattttaaaccccgcaaaaggagatgtattgcctttaatcaacgatgtaaaccatttgtcatcaatacaattaacatcaaatgtttggcaaattggtgaagtaatctgtaaaaaagtttctctcggtactattgatgacattacatgggatagaaagttcttatctttgcaggaactggaaaaactcaaaatcatgcaacaaaaatttgatggcataccgcaactattgaaaagttttgttgttaaagaggcaaatggggggttgtatttgtacttactattcaaagatcacggtaccccaatttcgttaatctcactgaaaaactggaagcagattctaaagattttttggtcttgtgctggtataattcatgggttggaaaaaaatttgaaatttgaacatcgtaatcttactttggataatattttgatagatggtaatgggaatataacaattattgattttaaatgcagtagattgcaaactcctcaagatgatgttttatatctacggctagatcatccactcttttttctaaatgggaaagacaagagtaaaataaacgaataccagtatcaatttgagtttgaaatctatcaaagtatgcggatcttgttgaacatggacgcgtcagcttttgagcccatgacaaatttgtattggttatattacctgtcacgcgttttactaaagtttggtgacaggaagcttggtaagaatgatgcaaacagggataaaatggcaagggtgataaaccatttggaaatgaacttggcagttcataaaagaggggggcagttattcaaaagattggagacggaggacattaagaatactggagatttactaaaactttataaataaaacaaataggaatgttgacatttatatttcattttctttctattgtatactccaatacataaacatattatatatacgtacataatgtaataacactaatctaaaataatggcatcgtcgacagcatccaaggctttctcctcttgagtctccacagatgcaggtgcttccattttgggagtcaaaaacaattgcttaacgataaattccacgccgttgatgacattcatcaatgcccaaacccagattcccaaagagacactctgtaaagccatatcatcaaacttggaagcaccaaatttgccctccattatatgccatttctgagaaatagtccttagaggatgcaagagaacatataaccagccttgagaccaaacaccacttacaaacgtagggaacaaggtgctagtcgaggaactcaacttgtaaactggtgtcttgccgtacataatcttaaacacaaaaaatggcaccgtcaatgccaataacctgagtttgtgaagatgggcctgaaaggctttattttctgattgtatttcgtccttcaagttatttatttctttatctaacgagtccaattttctattgttcttagtccatttggcataattatcctgcgcggagatagagttgttgaattcttttaattcgtgacgttctttgaccttggctaagtattttttggataattcatttcctggtgcaaatttagagatccatttctcgtggtatttgtttgtatactgtagaaactttgtgaccacaataaagaatatcgctaccgctgctgcccaatgcatttctcctatttcaatcaactagacgtagttcaaggattgcaaactgtcctgctttcttttatctggtctttttatcccgaggtattgttgtatataccactactctgtgattttttttcactcttgggaaggaaagaaaaagtgaaaacatcaactggtaagtgtctaatgacaaaaacaggaggtagttggtacgtgcaaaacacgatagtgacgttaatccgaatctgtaaattggtgaattggtatttagaagcgaccattagctaaaagagagagaaaactatgtcgcaagagtttgtggaagactattcacgtacagggtcctcagacgacgaggatagtggagcttatgacgagtggattccatcgttctgttccagatttggtcacgagtacttctgccaagtcccgacagagtttatcgaggatgatttcaatatgacctcgttatcccaagaggtaccccactaccggaaagctctggatttgatattggatttggaggctatgagtgatgaagaagaggacgaagacgacgtggtggaagaagacgaagtggatcaagagatgcagagtaatgacggtcatgatgaaggcaaaaggagaaacaagtcgccagtggtgaacaagagtattatcgagcacgcagcagaacagttatacggattgatacatgcaagatttattctgaccaagccaggcctgcaagcaatggctgaaaaattcgaccacaaggaatttggaacgtgcccccgttactattgtaatggcatgcagttgctgccttgtgggttgagcgatacagttgggaaacacaccgtaaggttgtactgtcccagttgtcaggacttgtatcttccccaatcatctagattcctgtgcttagaaggtgcattttgggggacaagcttccctggtgtgttcttgaaacatttcaaagaattggaagagtatgtggaaaggaaaagtaaagagtcctacgagttgaaagtttttgggttcaggataaatgatgaggcagtatctggtcctagaatgaagtggttgagacaatatccatccacggaggaggactgggaagaatttgccaaatgcgagttcgagacaccggcggtttaacccttgatttattttcctctttgccctaccatatacatatgtactttacctatttacattgtttcagtttttatatcaccactattattattattactattaccactttggagtactttagtgattcatttccaattgttttcctggagcccagtctttgaatgccttggccaagttgtaccagtactttagctccacggtcaacttcactgcggcggcgtaatccttgtcattgtagcattgtcccaactgggcttcaatatcttgaattctttccttgttttgcttttcaagcagcttcacaccagcttcgtcgtccatctgggataattcatcatggatgtctagaactttcaatagtaactgtggatcactggtagttacttcatttgaggtctgttcttgcgtcaaatcgatattgcgcaagagttttagcatatattgtgaccttctaaggggatctttgagagtatggtaagcttgattaagagttgatgactgttcactaccttgttgggccatgtctggatggtgctgtgcttgtaattgcctatactccttccttaatctggattgatcgatagtccaaatgggtagctttttggggaaggtctttgggaacagctcgtaaaatgtagaagtgaatcttcgttgaaccaagtatttcaacattgtgcttgtggggcttcttgatacctgtttccattatcagcctcagcctttaatttcgcatcatctttttagtttccttttctttttcgttttttttttacctattgttaagaattacgctgtgagtttcattgctattgttacaaaagacaagatagtctcaagatacaactgagaagaagcacaattatgtccgatagattcgttatttgggctccctcgatgcacaatgaacctgccgcaaagtgtgggtattgtcacggtaataaggggggcaacatggatcagttgttcgcattggattcgtgggctcatcgttatatgaacaaaatggacgttgtaaagattgaaaactgcacaattggctctttcgtggaacatatggatgtagccacgtatgatcgcatgtgtaatatgggatttagaaggtctggtaagtttctttataaagtggacccgttgaggaattgttgtaggttatacaccattcgaactgcccctcaagaattgaatatgacaaaggaattgaaaaaatgcatcagccgctttgctactagaataacaagtgaggactactgcccagccgctgttgcaagcagtgattttgtgggcaaaattgttaatgcagagatgaattctaaaacattctatacccgatttgagcctgcactttatagtgaagaaaagtatcacttatttgtcaaatatcaggaaaaagtgcatcaagactacaataattcgccgaagtcctttaagcgattcctatgtgatacgccctttggccctgaagcggtgttggggacacaagaatcatgggagcagttaaacaattggcagcgaatgaagccaggcgagaaactgaagcatatgggtcctgtgcacgaatgctactactatgagggtaaattaattgccatcactgtgtcagatatcttgcccagtggtatatcttcggtatattttatttgggatccagactacagtaaatggtccctagggaagctcagtgctttgcgcgatcttgccatcattcaaaggacaaatctgcaatactattacctggggtactatattgaggactgtccgaagatgaattataaagcaaactatggtgcggaagtactggatgtgtgtcacagtaaatatatcccattgaaacccattcaggatatgatttctaggggcaaactctttgtcataggtgaagaagagacgaaagttactaaggagctctacctcgttgactctgaaaccggaagaggggagggatttcccactgataatgttgtcaagtacaagaatattgctgaggaaatatacggtgtgggagggtgtgcgtttaaatctgcaaatgaatctgcattggaattgaaagaactttacggtataccgtacgaagaggaagatttagataccatctaccatttgaaagaacacaatggccatgctccaaatggtattcctaatgtggtgccgggattactcccgctatgggaattgctggacattatgcaatctggcaagatcactgacctggagggaagactatttctcttcgaaatcgaaacggaggggattcgaccattaattaacttttatagcgaacctccgaatgtcaagaaacgtatttgtgacgtgatacggttatttggcttcgaaacttgtatgaaagccgtcattttatatagtgagcaaatgtgagccttcaacacactattctaataacaatcctaatgtataacattttttagcattcaaacattctcaccatcgcgctgagataattttatatagttgatggaatagttttggaggtgatttatccattaaatacctgatgcttttttgtctcctcatcgcgtgaaaaatttgagaaaaagctcgaactatttgtagcacttcactgtattgctaacagttcttaaaaacttcagaacatatagatattgctaaacacagatttgaataccatagtaactagtctcttattcttagtttttgatgagctccattcacgaggttgtggctcttattgaagagctgtactctcctcatccgaaacatgatgttaatcagattcaacagagtttacagtcaatccagaaatcagagcaaggcttccacctagctaatgagcttttatctgatgacaagtactctgcgaatgtcaagtactttggtgcactgactttaactgtgcaactaaatacgcggggtgaaaacgattatgaaaccctatggaatgttttcaggtcaaatttattgtacttgacgaaattcagtacattgtacgtttccaatcctaatatgtacgggcaatctctaatcataattaaaaagttaatgtcaaacttgtcattgatcttcactaaaatcaacgatccgcagcttaataacgctggaaatgaaaatatgattaagcaatggaacaatcccataaatacgtttattcaacttatgtcggttcaaaatcaaaacattaatgcagaccaactgttgcttgactcaatcaactgctccttaacatacgagcaactgtctcaatttgttagcctatctcagaaacataatgaactggcattgacgtttacagaagttattgtggaagatttgacgaagttccaaacaaagaggcattcaatgtctcaaatccacgaagtagtccatgagcatttatatatttcaactatggctttgatcaacttgaacttaactgcacaagctgtcttcaatcctaccgtatttgattgtattactgcttggattaattatatctcattaaccagaagcgtatcttcaagtggtagaatggatttgtcggaaatttttcaaaacctgattgacttgatgtatcagtctacagaaggatcggacggttatgagaatgcggaaaagatcctaacaatatttggtaatgtttttgctaatgatccattattaatgagttacgatttgagacaacaaatcgagtgtattttcttaggtgtagtaaggcctgattctggcataaccgacatatctaacaaaaattcttggatgctacaatatatgaattatttagttaccaatgattttttttccgaattgaaggaattggccatttgtattgtggatttcttgcaaattaacacgttaagtgtttgtaataaattatttactaacattcaagcagctgataatggtcaagttcaagatgaatatattcaggaatacatcaaagtccttttgcaaatgaccaatttccctttaactcctgtcttacaagagttcttttctgttagaatggttgatttttggttggatttatcggatgcttacactaatttggctagcgaaactttgaggccaaattctattgagctgtctacacaaatttttcagcagttgatcaatatttatttacccaaaatttctttgagtgtgaaacaaagaataattgaagaagagggtgagagcacttctgtgaacgaatttgaagattttagaaacgctgtcagtgaccttgctcaatctctctggtctattttgggaaacgataatttaacaaatgtgctaattgatggtatgggccaaatgcctgctgcgagtgatgagactctcatcatcaaggatactgatgttttgtttcgaattgaaacgatgtgttttgttttgaatactatattggttgatatgactctatcagaaagcccatggattaaaaatatcgttgatgccaacaaattcttcaaccaaaatgtcatatccgtcttccaaactggtttccaaactagtgccagtacaaaagtcagtcaaattttgaaacttgacttcgtaagaacaagtacaactttaatcggcactttggctggttattttaaacaggaaccttttcaattaaacccatacgtggaagctttatttcaaggtttgcacacttgcaccaattttactagtaaaaacgaacaagaaaaaatttcgaacgataaacttgaagttatggttatcaagactgtttcaacattatgtgagacatgccgtgaggagttgactccatatttgatgcattttataagctttttaaacacagtcattatgccagactccaatgtttcacatttcactagaactaaattggttagatctataggttatgtcgttcaatgtcaagtctccaacggtccagaggagcaagctaaatatattttacaattgacgaacctattgagcggctcaatagagcattgtttggcttcatcggtacagttacaagaacaacaagattatattaattgtctattatactgtatatctgagctagcaacaagtttgatccaacctactgaaatcatcgaaaatgatgcattactacaaaggttatctgagtttcaaagtttctggtccagcgatcccttacaaatccgatcgaaaattatgtgcaccattgataaggtcttggataattcaatatattgtaaaaactccgcctttgtggagatcggttgtttgattgttggtaaaggattaaatctgcccgacggggaaccgtacttcctcaagtacaatatgtctgaagttatgaattttgttttgcggcatgtccccaactgtgagcttgctacttgcttgccttattttgtttatttattagaaaagcttatttcagagttcaggaaggaactaacaccacaagaatttgatttcatgtttgaaaagatccttctagtctattatgatgcatatattatcaatgatccggaccttttacaaatgacaataggttttgttaataacgttttggacgtgaagccaggcttagctattggcagtaaacattggacatcatttattttacctcaatttttaaaattaataccttcaagagaaaagttcacaattgttgcggtggcaaaattttggactaagttgatcaataataagaaatacaaccaagaagaactcacaactgttaggcaacaagtttcctctataggaggagaccttgtgtaccaaattatgtatggcttattccacacacaaaggtccgatctgaatagttacacagatctgctaagagctttggtagccaagtttccaattgaagcaagagagtggctcgttgctgttttgccccaaatatgtaacaatcctgcaggtcatgaaaaatttattaataaattacttattacgagaggaagcagagcagctggaaatgttattttgcagtggtggttggattgtaccacacttccaaattaccaaggatgatttgttaagaatttctccgctgagggtgaaggctattctttgttacattttatttagtaatgcgttgatcctttttgatagattttttttttgtgctttaaagatagtagcagtatatatgtgtgtaaaagctaatcatcagaagtgcagcattcattgctagtatttagtgataaaaattttagaatttccatttctaattgtaattgcttttcattccaatacatgtttgagcttctggggggtaaaaatacatttccagacagggcgtcaggttgaaagcagttactgaaacatagagagtcgacgtcaggaggaggcttcaaatggttttctgaaagtgattcggtcttatttttccattttctaaaatggtgaatcctttctctggaaatgtgtgatccctttgccttttgtgaaaacttttttaacgagctttttaggttattagttgtctcaagaaggtttatgggcccgctggtctcgatatctgcgtaatttaatggacgtatcgtgtcttccatggagtgaattgtgatttgtgaattatatctgtccaataccgttgccttgttgggagctcagatagaaaagacatcttaattccagacagtctattctctgtctatttctctttgtgactgcaaattttaatttgtgacgccttttcttattactcatgtatttgtcactcttgacgattgttttttttctatattttttttgttctggggtcctccagagaataaaaaataatgatcaatatagtagatagtatagttatattcttattcgttgcaccttgtttaacaaatcactcagactcaaagagaatatcggttggttatctctctccgaaggtgaacagcaaacagtacctcacgtcttttttttgaatagtttttttttttgttgaaacagaaaaaaaactttcttccgtatattacattgtacattatttttattgtattttagtttccaacgttaggatttgagccgtcattaatattattcgtttttgtacactattccagacgatttatttttagtacacttaaaattcctgttgatattgtccactagttctcttttcatattttattttcgcttattctttaggttcttttaagagtctctgttcattttccgttcttactgtttctttgtcctcgatatcttttaagaaagagagaactaagcgctgtaacatttttaagtggacctacgttatgtctacaaaaggtttgaaagaagaaatcgatgatgtaccatcagtagaccctgtcgtttcagaaacagtcaattctgctttagagcagttgcaactagatgatccagaggaaaacgccacctctaatgcatttgcgaataaagtttctcaagattctcaattcgctaatggccctccgtcgcaaatgtttccacatccacaaatgatgggtggaatgggcttcatgccctactctcaaatgatgcaggttcctcataatccttgtccattttttccgccccctgattttaatgatccaacagcaccattgagtagctcgcccttgaatgcaggcggtccaccaatgttattcaagaatgactcacttccatttcaaatgctgtcttcgggtgctgcggtagcaactcaaggtggacaaaatctaaacccattgataaatgacaattcaatgaaggtattgccaatcgcatcggctgatccgttatggactcattcaaacgtaccaggatcagcatctgtagccattgaagaaaccaccgctactctacaagaaagcctaccatctaagggcagggagtctaataataaggctagttcgttcagaagacaaacttttcatgctttatcaccaactgaccttatcaatgcggccaacaatgtaaccttgtcaaaggacttccaatctgacatgcagaatttttctaaggctaagaaaccgtctgtaggagctaacaatactgcaaaaaccagaactcaatccatatcttttgataatactccctcctcaacgtcatttatacccccaaccaatagtgtttctgagaaattatccgatttcaaaatagaaacctcgaaggaggatttgattaataaaactgcaccagctaaaaaagagagtcctacaacttatggtgcagcatatccatatgggggacctttacttcaaccaaatcctattatgccaggccacccacataatatatcctcccctatctatggtattagatcaccttttcctaattcttatgaaatgggcgcgcaatttcaacctttctctccgattttaaatcctacgagtcattcactaaatgcaaattctccaattcctctaacccaatcgccaattcatcttgcaccagttttaaaccctagttcaaattctgttgccttttcagatatgaagaatgatggtggtaagcccaccaccgataacgacaaggcgggtccaaatgttaggatggatttaataaatcctaatcttgggccatcaatgcaacctttccacatattacctccccagcaaaacaccccccctcctccctggctttatagcactccacctcccttcaacgcaatggttccgcctcatttgttggctcaaaatcatatgccgttaatgaatagcgccaataataaacatcatggtcgtaataacaatagcatgtcaagtcataatgacaatgacaacattggtaattctaattacaacaataaagacacaggtcgttctaacgttggtaaaatgaaaaatatgaaaaacagttatcatggctactataataacaataataataataataataataacaataataataataacagtaatgctaccaacagcaacagcgcggaaaaacaacgtaaaattgaggagtcgtcgagatttgcggacgcagttttagaccaatatatcggaagtattcactcattgtgtaaagaccaacatggttgtcgttttctgcaaaagcagttggatattctcggcagtaaggcggcggacgcaatttttgaagaaactaaggattatacggttgaattgatgactgattcattcggtaattatttgatccagaagctattggaagaggttaccacagaacaaagaatcgtactcacaaaaatatcttcccctcattttgtcgaaatttccttaaaccctcatggtactagggcattacaaaaactcattgaatgcatcaaaacagatgaagaagcacagattgttgttgattctttacgcccttatactgtccagttgagtaaggatttaaatggtaatcatgttattcaaaaatgtttgcaaaggttgaagcctgaaaacttccagtttatctttgacgcaatctctgatagctgtattgatattgctactcatagacacgggtgttgcgttttgcaacgttgtctagatcatgggactacagaacaatgtgacaatctgtgtgataagttgctagcccttgttgataaattaactttggatccatttggcaactatgtggtgcaatatataattaccaaagaggctgagaagaacaaatatgattatacgcataaaattgtccacctgttgaaaccaagagccatcgaactttctatccataaatttggatcaaatgtgattgaaaaaatcttgaagacagctattgtttcggagccaatgattctggaaattttaaataatggtggcgagacgggtattcaatcattgttgaatgatagctacggaaattacgttttacagacagcattagacatttctcataagcaaaatgactatctctataaaagactatcagagattgtggcgcctttactggtgggccccataagaaatacacctcatggtaaaagaatcatcggaatgttacatttagattcatagttgatacatatatcctcagtttagctttttttacgttagcctcatataatatcttttgtacaatactaaaatacatcattttttttttcgttgaggatcaaatgaatatccaaagcaaaaaaaataggaattttcactttatggtatactggtaaatagtgttgaagaaataagagaaggagatgccctagaaaacagaatgttcttatttaaataagtaaactcaaaagaaaaaaaaaaggaaggaagtttttgagaacttttatctatacaaacgtatacgtttaactatctggataaacgtcgctccacaggatactgtagaggtcctcaagatcaccgttattaacaaattcatctagtgtccccaaattaaaactagttgcagaaaaattgttactgttgttgttgttaatattgttaatattgtttttattgttgttgttgttgttgttgttgttattgatttcatttgtgttcataaatggtacttgtactgaagtgggtatttgctgctgagcattgattggtttattagattggacttgcgtattattttgcccatttgttggttgcgcgtaatcgggattgatcatatcagacacggataatgacctaaatgaaggcaattgtgcaaactccggtagtgagttgtttctcactggggaaggtgctgagcgaccattgaatggcaattgaggcgattcaatgccatttagtaagcatgaagtgcccgtcttaagacttgggagatccggattcaaattttttcccgaattatgcttcatctgcttattatcttcatttgacattagtggttcctgaaactttctatttttcaacatttgtgagaccgttaaatggaatcctgacttctgaacaggttctaataaaaatcgataagcgcaagagtttgtatccaagacaagttctattataccttttaaatctggcgcattctcatcaatatatttggagataacatcgaggttggtgctagaggactctccgtatgccaaaagcatgatacgagtgacgattgtcaggaaagaaaaagctcttgtatagtctttaaagctttggctgttgaagacatgctcattggtctcattttcggaaaaaatttttatatccaaaaatcttttgaagactctaatcatattcacaacgtcatttactttaatgaattcggccactgagaatgcttgtgataccaaaataatgcaactgatagaataatgggcgaacgaacggtatacggaataatcgttgtcaaagtctaataagattttgttcatatcggtccatgatttgtaaatcttgtgaaggtatattttcaagttttcaattagtattgagggccttctgtgcacgcataatctggcgacaatattatcagattcgttaaccattctgcagaaatggtgctcgtaaaatagaacaaattttgaagccataatcttatcctctcttgaaactttgagttcagtactatctttagagaatgcaatatcgaacaattttccagtttgctctttgatagcatcatatttcatttctgtttcgttaaaaatctcgagtacctcgaagagtagtttctctctaacaacagatggttttgatgtattcctaattgacgtgaatttttcattgaataaaacagatgatgagaaatggctgactatttgtaagacagctaattcgccatagtattttaagtcggatatgcacatgttgtcaaaagcttcgctcctgcgaactaagtggacgttctcgataaaatctctattatccaagaacccaacatctcgaaaattcttaggtaataaacaattgattttggagtcatcaatgttcgaaggatagccaagtttagaggctaaagttttctcgaaatagaaagctttccaccagagatttcttcttctttcagcaaagttttcatcaagacccacgtaaaattcccaccttgataaaccaactcttgaaacaaaatgaactgctacgttcaagactttttcaaaaccgtatatttccgatagccaaaatagcagatccaaaaagtatagaagttgctctaaatgcgttatgtcgcatgtgaagtccacgtagttgtataatgtagaattataatagctgtaacataaggcgattagcgcctctccagcttgacaataatggatgaattcctgcaagacatcaattgactgcgtgtttttagccacggaggggttagatgtgatttccattaggaagttctggtaggaatttttatgcatatccaacatcttcaataaaatgccaaacatgctgatatcattattcatttcgcttagtagctcagaattacttattccggttatatttctcacaaagggctgcggtaagtgatttatcactaacgcaacatgcgattttgtgtgtgctgtattcgggctccctgcagatgatatcgaagatggggttgaaggtaaaagattcattttctgtaggtagttttccaggggattagctatggagacacagccttggttgatgtgatgaaaacaaacgtcgaaaaaccttaacatgatgtatatggtttccttggcggtcctgggaaaaatctcgcatttggatttggatctataattttggaaacatttaccaataccttgaagtgacaaaaattggaaaggagagtacaaaccaaagatttcgtcgatcaaaggttgactagaagtatcttggtccttcttattgtttgaccaagcggcatatcttgtcaaatgtaccacatcacagtatttgtttttcatcaattgagtttctattgatttattagggtaaaatttcgttgttgctaattctttggtcctcactttgggttcccatcgcttaagcaagtcacttatctgaagttcaatgctctcgatggctgaggttacatgtgtacctaaatgagccatctccttcaaatttttcagagtggtttgtagagatgtcaaagttgcctgtgattcgctatcgtcttcataaaaaccgtttctattcacatcgtcgtcattcttcccatcacttccgctattatcaccactactacgaccacctagcttgaaattctcaaaaaatttcgttggttgttccactgcgcatggcccgtctgtacatcgctgaggattagaaaaagaagtcgaactggaatctgtttcctctttgacttgtacggttgtaccttccaaactcgtcttgtgaaggttttttattcgagcgccaccttgtctagtgctgaacgtgcactcacatgaatatatctcacagcttgcgcagggaaacttcccattacattttatctttctttttctacagttatcgcacgctttacttactttcgaccttggcttacgaatcttgccgctgaaacctgtagaaaagttgctggagtccgcggacgattctgtatccggacccgtctcaatatgtacaccgttcttaggtgtcaagcctcgcatcttccagtttcttggattcttttctgtatattcttggctgagatgaatagttagcaagtgatgtgcaaattgtctttttttagccaaaactcactcctggtaatgtctatatggccgctatggtcctgctatcatgctattgttgacaatgaaagagtggctgatcatgtgtaataggcgaataaggttgttttgaagagctttaattagcgcctcttattgccactcattaggtcttgaacaagaaaagaaactccatttagggtatgcgtctgtttccaacaaagccctattggaccctgagaatgtaaatcagggctcgtttcttctcgtttaataactaaacgagactcatttctttttcgttccttggcgctattttcgtgcatcccgtaattgccggtattacgcgatcgtttggcgttactatggaaaagcagaattatatatcctcgaggaaaaattaccaaacagtggtaataacgtaggaatgtagttcagttatgtagataggcagatacggatatttacgtagtgtacatagattagcatcgctatggcaaaggataatagtgagaagctgcaggtgcagggagaggagaaaaagtccaagcaaccggttaatttcctgcctcagggtaaatggctgaagccaaatgaaatcgaatatgagtttggtgggactactggtgttattggtatgctgatcgggtttccactgctaatgtactatatgtggatttgtgcggaattttatcacggtaaggttgccctacccaaggctggtgaatcgtggatgcactttatcaagcacctataccagttagtcttggagaacggtatcccagaaaagtatgactggactattttcttaacattttgggtgtttcagatcattttctactatacgttgcccgggatttggacaaaaggtcaaccattgtctcatttgaagggaaaacaattgccttacttttgtaatgccatgtggaccttgtatgtaactaccactttggtcttggttttgcactttaccaatctttttagattgtatgtcattattgaccgttttgggaggatcatgacatgtgccattatttcagggtttgccttctccatcatattgtacttatggactttatttatctcacatgactatcatagaatgacaggaaaccatctatatgatttcttcatgggagctccactaaaccctaggtgggggattttggacttgaagatgtttttcgaggttagattaccttggttcaccctttactttatcactttgggtgcctgtttgaagcagtgggagacttacggctatgtgacaccacaattgggggttgtcatgttagctcattggttgtacgcgaacgcatgtgctaaaggtgaagaattgattgttccaacctgggacatggcttacgaaaagtttggatttatgctgatcttctggaatattgccggtgtcccatacacttactgtcattgtacgttgtatttgtactaccatgacccatctgaatatcactggtctacactgtacaatgtttcgctgtacgttgttctattatgcgcctactacttctttgacacggcaaatgctcagaaaaatgccttcagaaagcaaatgtctggtgacaagacaggtaggaagactttcccatttttgccataccaaattttgaagaatccaaagtatatggttacctccaatggatcgtacctattgattgatggttggtacactttggctagaaaaattcactacactgccgattggactcaatctctcgtttgggccttgtcttgcgggttcaactcggtgttcccatggtttttcccagtattcttccttgttgtcctgattcacagagccttcagagaccaagcaaaatgtaagagaaagtacggaaaagattgggatgagtattgtaaacattgcccttacgtctttattccttatgttttctagttattttctttttctatccacttcattaacttattttacagtttgtatataaaagtattgatgtatttacgcgacaaaagggcttgaaaagattcgattttctattacttgatctactttttcctataaaataaatcctaaatgaaacgtgtccatacatatattgagtgttgacgcgtgtgatttcacattatgttgtggcaggaagtatgttaatcttgttcagcaattgctactagcctttcttcgatgttctcagcactcaaggtaaagaatttgtcctttgtagcgacaccgacttccaagtcattctttgaaaattcggtacccagtgcgtcaatcatatgagtaatagcaaattctaccaccttctcccatgattcttcattaatatggtcgattttactctttttgaaatggttttctaagtttgttgtgatctcctgttgttttggtcctgtcgcagtagctttgtagccaacgtaataacctgcagggtcagttttgtaaatggagggacccaattcttcatctaccgaaacaaatgtgagtataacacctaatggtctcatatatgctctttgagtatagatttgggaaaggttagccattctcttagccaatacatcgcatggcatatcataaccatatttataacggaattctgcagcctcagccttggctcttagggccgcatttcttgcatccggtattggtccgttcactaccataccaattgttcttgaaatacaaaaaatatacgaaacagtagttggatccaacagtttatcagggacctttttctgacttatcaccactgtacaatctttacctctgaccgctagtgagtttatgttagtttgattagtcgctttaaaggcatattctacttgatataaacgaccctcgggggaaaagatagtgatgtgcctgtcataaccagcagcagatgcagcagcagcacccgacatgattgtaatatgtttttttcgctttgcttcgtctctgcccttatatgatttagcatgaagattataatgagttagccatttaacttactctatccttacggtggcaaattggtgtgtgcccttcgtctattgtgatatcataattaaggatcgcgattaccattataagaggatggggaaaaggaatgccaaggtaaatccaggaaagtgaaacttgggagtttgtttggaggatatgtatataaatatacgaggttttgagaatatagtctcttcttctgttataaaagaataaatatgggcgaaggtttgctggatttaagatctcagcttggattttacaagttttaccaccacaatcctaagaacgttttgatccattccatatttgtccccacaatcctatttagtggtagctgtatgctccacagagtcaaaatatatcagagtatttcattgactgctgtgctaagcgttttattttccatattttattgtcttctgtatttacccacagggctattagcaggagttctcttgcttttgttaaatcttgcactcatcgatcacagggttgatttaacatttaagcaggaactgggtttgtttactattggttggattttccaatttgttggccatggtgtctttgagaaaaggaggccagcgttaattgacaatctagttcagagcttggtgctggcaccatattttataatgttcgagttccttttcaaattgggtttcatgcctagattaaaggcaactctcgaacatgatcttgaaattaagcaaagaaatttgcggatgcaaagacaataaagagggataatgttgcatttaaagtacatgttcctctgtagcattcacaaaacctgcatgcattaacaagggctagcattataaacttcatcaatgatgttatagtcaaataaataaataattagtgagtacgttagattacgtattaataataaataagtagtttggttttagaaaaggatggtgtgcttgtcgctgagacacatgttattgacgccaggtttggacgttgtttttcactgtctaccaatcctggtggactttatcgaaagtagttgtaacagcttttctttttggaacgttgtcaaattttaataattttgatccaccttccaagaatgagtatttctctcttctcaaagcttcgtatctggaaatgtattcttccttttgcaatgtaataccaatatcatcaagaccgttaactaggcagtgctttctgaaaggttctatttcaaaatgatcaacgagcacattgccatcggaatccaaaattttttgatttggtaaatcgacgcagagcttaccacccttattagcaatagggatcaatttgtcaatgattatttgttgatccaatctaataggtaataagccgttcttgaaagagttgttgtagaaaatatcaccgtaagaaggtgcaatgatggattttataccaaagtcttttagagcccatggtgcgtgttctctggaagaaccacatccgaaattgtcaccagtaacaaccaatatttcagcttccctccaaggttcaacatttaatacaaaatcggtttcttgatccttaccttgatcgtctttacggaaacgccattcataaaacaacccttttttcaaacccgttctcttaattgtctttaaaaattgctttgggataatagcgtctgtatcaacattggccttatctaatggtgcgctaataccttccaaagtcaaaaatggcttcatgccggaagagctaggtttagcaggtgtatcatctgacttcactggaatatcttttaattcatcattggcaatatcttggggagcgtcttcgggttggacaggttcagcgtgatcgtaagcagcactttcaagctctttttcatcttcggaagtgacctcaacctttggactactttggtcttgatccttatattcgaattctctaatatctacgaagtgacctgcgatacctgcagcagccgccatggctggggacattagatgtgtacgagacaaggcaccttgacgaccttcgaaatttctgttggaagtagaagcacaacgttcataggcatccaaaatatcagggttcatacctaaacatattgaacaaccagcttctctccattcaaaaccagcttcttggaaaatcttgtccaaaccttctgcttcggcttgttttttgaccaaaccagatcccggaacaaccatagctaatttgatgttactagccaatttttgacccctaactacagctgcagcacttcttaaatcttcaatacggccattggtacaagatccaataaagactttatctactttgatgctctttagcggtgtgttaggttccaaacccatataggctaaggctctttccataccagatttctttattgggtctgtaacattttttggatctggtacggaaccagtaattggtaaggcatcttgaggagaagtaccccatgtaatagttggaatcacgtcgacagcttcaatgttgatttcgtggtcaaatttggcaccttcgtctgttttcaaagttttccagtaggcaacagccttttcccattcggcaccttttggagccaaaggtctgcctttggtgtattggaaagtagtttcgtctggtttaatcatacctgctcttgcaccagcttcgatggccatgttacacatggacatacgtgcttccatagaaagagcttcaatggcttcacctgcgaattcaataacgcaaccagtaccacctgcagtacctatcagaccaataatatacaaaatcaaatctttagatgtgataccaggtgatagcttaccattaacagtaattctcatgtttttcgatttagcttggataattgtttgagtggccaagacgtgttcaacttcagaagtaccaataccaaaggccagcgaaccaaaggcaccgtgagtagaggtatgagagtcaccacaaacaacagtggtacctggtaaagtgaaaccttcttcgggaccgatggtgtggacgataccttgtctggcatcactcataccgaaatatggaacgccgaactgtttaacattattctctaaagttttgacttgtaaacgcgaatcagtttgcttgataaatgtgtctagtgatttgaaattctttcttgattcagttggaatattatgatctacagtagctagagtacaatcaactcttctgacctttctgccggcattttctaggccttcgaaagcttgtggagaggtgacttcatgaaccaagtgtctgtcgatatacaacaaaaaggaaccattttcatcttgatggacaacatgtgcatcaaaaaccttatcgtaaagagttcttggacccttggatggagtgtaaaccatgatttaaaacagcaaataataaaaatcgatagcgacaaaaactgtcaatttcaatattctttatatttgttgactgcttagatattttgagaaaattcagcggaaacagcgtgatgagtgagttaagttctgctgtttaaataagtattcaactactattgaagccgactcatgaagccggttacggacaaaaccgggcaaatttcgccggtcccggaattttcgtttccgcaataaaagaaccgctcatcatcatagcgccagggtagtatactatagaaggtcagactaaactgagtcatctagagtaatgacgccttagtagcttttacatcttcataagaaaaggaaacttgtagaatggcctggcgatttgtttgctttcttgtgatgaagaaatttcgatgcgattaaccggcaaaatcagtaaaggtatttcgcggaggcggccttcaatcatcgaatactacgtcttaatatgatgtactgtggttcatattttcaagtagtgttagtaaatttgtatacgttcatgtaagtgtgtatcttgagtgtctgtatgggcgcataaacgtaagcgagacttccaaatggagcaaacgagaagagatctttaaagtattatagaagagctgggcaggaactattatgacgtaaagccttgaccataataaagacgattctttgtccctctatacaaacatcttgcaaagataccaaatattttcaaatcctactcaataaaaaattaatgaataaattagtgtgtgtgcattatatatattaaaaattaagaattagactaaataaagtgtttctaaaaaaatattaaagttgaaatgtgcgtgttgtgaattgtgctctattagaataattatgacttgtgtgcgtttcatattttaaaataggaaataaccaagaaagaaaaagtaccatccagagaaaccaattatatcaaatcaaataaaacaaccagcttcggtgtgtgtgtgtgtgtgaagctaagagttgatgccatttaatctaaaaattttaaggtgtgtgtgtggataaaatattagaatgacaattcgagatgaaattttaagcaaactctagtaggaaataagcggcttattcttgttggctcctaattctttttagtgtatcagttcccattgataaaaaaattaaaattaaaattagaaaaattaaaccagaaaaatcaagttgattaaaatgtgacaaaaattatgattaaatgctacttcaacaggattaggtttccttttcgtgttgagtagagactctttgcatagcagccatgaagtcttcgacacttctggtagacttcttttccttcattggcttaccgttcatcaatctgtcaaaggcttcagaagtggacatttcgtagtagaaaccacccaaaacacagaagataccgatagaccagatccagacacggacgacagtaacaatatcagtccagttttcagaccaccaaccgaataaggtaaacatggtagcgatgatgtcgacagcgaagacggcaccagccaattgccaggatgggatagaagaccagaatggaccagcagctctggtaatgaaaatcaaccagttttcagtcaaggaaatttgcaagaacataataccgttcatagcaccgaagttttggataataccaccctttggtaagaacatagtagtcaaggtaatccaagaacctatagctaaaactatgcccaaaataatagacataccccataatcttggtaggttccatttaacgggctttggagagtaaggagcattatcgtaagcaatagccaaagtagcaacatcagcgaaaatagcgatgaaaacaatcaaatcaatgtccaaagagttatccaaaatagcaatccatagacccaagaagatttccaaatgtagagacaaagcaatacggtaaacaacgtaagagtacattctgtgaaaaatttgtctggaggtcttcaaagcatcaataatagcagatagaccaggagccaagaaaacaatatcagcagcagatctggcagcatcagtagcaccttcgacagcaataccagtatcagccttcttcaaagatggagcatcgttaacaccatcaccagtcatagcaaccaagtaacctctgttttgcaagatttcaacaactctgtatttatgttgtgggaaaacttcagcgaaaccatcggcattttcaacaaaatcagctaattcagaacctggcatgtcaccaccgccacctagacctaatctttcagcgttgtaaatgttggtacccaaacccaattgtctacaagtttccttagcaataccaacagcatcaccagttaacatcttaactcttagacccaagtgtctagcttcgctaacagtttgagcagtatcgtctcttggtggatccatacatggcataacacccaagatttcccagtgaccttcacctctctttctagcaacacctaaagcacggaaccctctagaagccaattcagcaaccttgttttcgtagttttcatggacatcttctgggattgggtgatcttcttcgacagtcttcaagacgaataatggagcacccttaacacaaacaattctttcaccttctggagattcgacaacggcagtaaccttcttggagacagggtcaaatggatggaattccaaaaccttgtacttggtcaaagcgtccttagcctttggatattgcttcaaagacttcaagaaagccttatcaatagcatccaaacccttcttctttctggaagcagccaaacaagcagtcaacatcaagtcgtctggagaaacaccttcaacagtgtatggttcgtgcaaggacaacttgttcttggtcaaagtaccggttttgtcggaacacaagatttcgacaccagccaaggattcaatagcagacaacttttgaacaatggcttgtttcttagccaagtaagcagcaccgacggccatagtggtggtaacgacagctggcaaaccgactgggacaccaataatagtaatacctagagtgtatctcaagattctaacaataccgttggttctgtagaaacaagcagtccagaccaacaacaaagtggcaatgaccaaaaccaataagataataccaataccgttcaaaacttcagtgaaatgaccttgaccaccagcggctttgttaaccaaagcagcagctctaccaacgaaagtgttgtcaccggtagcggtaacaaccatgaaaccttcacctctcttaacagtggaagaagagaaagtttggtcaccgtaatgtttgtcgacagccaaagattcaccagtaatagcagattgatcgatttgcaagaaacagtcttcagtgacaatacgaccatcagttgggataacagtaccatcttccaattgcaaaatatcacctgggacgacttcgttggctggaatttcaaccaattgaccgtctctgataacaacagcagtgttagccaaagtctttttcaattcatcgacaatagaaccagcttggaattcttgaacgaaaccaacaccagcgtttaacattaacaaaccacagataacaccgaaatcgacccaatcggacaaaccggcagccaaaatagcagcggcttccataacgaattgaattggaccgacgaaaaacataacgaacttaacgactaaagattctttttcgtcagccatttgattcaaaccgtacttctttcttcttttcaaaacttcatcggaagttaaaccgtaagatgggtcagtttgtaaatattcttctggaactggtctagcttcaccggcggcaactggaccatcgttatcactgtcttcgtcgtcgacaccgtgattagattgtagttcttcgattaaagcatcgatatcgtcatcgtcagaagattcagatgcagcgtcatcgtaagtcttagcaggcttttcttgagttggctgatgagctgaaacagaagatgctgaagaggatgatgaagaggatgatgtatcagtcatattgatattgtttgataattaaatctttcttatcttcttattcttttcaatgattttctttaactagctggggtatattttttttctttcttttgaatgtgtgtataaaagagagaaaaaatggttattttccaattaattaattattaacgattgttaaagaaaaaatttatcaacgaggttgatagaaaaaaaaagtttttgtagatatagaagaaaaaaagattttcactattggtgttataggaaagaaagagaaaaaatttaagagaaattagatgttagacgataatgataggacatttgaaaataatacaatatttggcctttttatataatcgaaactaatggaggggagcataagcggtacccaccatcgaccacgtttcgtcaccggtcataattggaataaacaaaacaaacaaacgaactaaagagtgtgagagtaacaatttccacagaggtaaaaaaaaaaaaaaggaaaacagaaacaaaaaaagctcatagttctactatagcttcttcagactttctgtgaacgagggaaaaagacaacaaaaaagcaatggataaacggtctcgagagatttttcatgatggaaaaggaaggaaaaaaacccgaaaggcatatggataacattctgaaaatgtctattcctgtcaaaagcatgtcagaggtctcgaggcctggaagtgccgcattaggaaatacagatgcaatgcgcgcgagtttacgaaattctcgcaggagtttctccggccatgtgcggctggttctacgtctcgtgtatgggtttatttctgcggtaattatcgccggatctccgcttcgagaccgggtttgttttcaaattaccggaaaaggtcaggcaaaacagagtgatgtatgggtgatcccagcaatgcctgtttatgtttctccgtttcaggaagcttgttttgttttttccccgtcagcgatggtgacgtaaacgactttttgcactttagcaaagctgagttaatctcggaaaatctctgtgtccttcctttttcttctagcttccgttccgagtctcatcttctttcccgtgccgtcgggtttagtaaagaaatgtaaagaaaaaatgtcgtatcgtacccgagaaatatttcaattctcttacgtatgcgatagcagttggaaagatctgattcgttacgatgacttgataagcgcgggctttttcgccctatacggcttgggcctgactaaaatgtgattctgtgttttacgtatatgcgcgtatatagagcaattgattgacttattacgcagtttatcaagataaattctttgttcttgcttacgggagtgtggtaagcatgtatacgcccgtttaaaaacccgatggaggctttttccccaattctcgtactccattgggcatatgatttctttctttttccctttttttttttttctatttccctaaactaacagaacaagcttcaaaacaaatgacggagagaaaaacagttttgatttaccaaatgcggcaaacttattgaggctagacacagctctaccggattcgtccgagcacttttttgttttcttttctatatttactacaaacataacaaagttttgtgcgtcttccctaaagcagctaggatgaaaatcctatgctctcatctcgctggttgccatctcatcgcatccaatgctgtctgtaatcattttattggacttttctttgtttgctaatcccccttttctttttcccgttcttttcttgtccttgtttttcattttaactatatttctgaaattaaggaaaaataaggcaaaaagtgggtggatgcatctgcgacttctctagttttgcgcctacttgggcgcgctaataataagggtttagcttcttaaaataaaaatgtcagtaacagttgtacgataaggtctttactttttttctctcgagaaatgtctttttctaattaatctctcttttctgttgttggttactgccttccatagtccaagaccattcgttatatggtgcagtgtaggatcgaggagaatcggctcacggtgcttatattattgcccggcttcaagtatatttacatcagtctccatagttgttttatcttattcttggcattgatctgcttattaaactatttatcggttctctcttctggtacagaacttaacatgatcttgttttcactattgtgccataagctgaaaaggctaaaataaaattaagatagtaaagttcactcttaaactaatcaagcatgaataatacaaaataaatatttgagccaaaggggatgatttaattatcaagtttttcttttcatacttcggtttacaagcattgtttacggctcttcttttcttagttcttggcagtttgtgttttcttgatgagaataagaaaagtatcgatcttacggcaaaacataaataaaacacaactttatctttttttgtcgcagtagtgtggtcctacagctccaagcctgccgcttttaaaatagtgagctgtgcatactgatatatgttctattttacccatttgaggggcctaaattgtctattaatttttttactttaatacagtttgtatagaaacatgtggcactaacagctttatccgcccgcagaaaagataaaaaaaaagggtttttacccggcaaagaagcttctccatcatttgtcagggggaaaagaaaattaggaggctcaggccctagaagcgccctccacgctttttaaacaaatgctaatcttcataattcattatcatcgccacttggcattgcatttaatgggcgccttccaaaaacattcaaatagtatcagcccccccccaaggaaaggctttatttgaattgcgttaaatattcgatttctttctagcaattattaccaaaataaattgcaggcttaacgaaaaattaaataatctcttcagattttttcacttccccaaactacattttagtcaggttggcacgattcaattgagaaggcttaggttaagaataaacattttttcataaatttgaggaagaaggggcttttctggtaattttcattcaatagaaaggcttaagaaaacgtcaaaaaactcatgcgcctccagtaaaaactaagtgtattaagagaattgtatcacatatatacgacattgaattaaagaaataaaacttgaacaaataaagtttagaaaagtggttctaaaaaaaaaaaactgtgtgcgtaacaaaaaaaataatgtctagacaagacgaaaattctgctttactagcgaataatgaaaataacaaaccatcgtatacgggaaatgagaacggagtctacgataatttcaaattatcaaaaagtcaactttcggatcttcataaccctaaatcaataagatcatttgtcagattatttggatatgagtctaacagcctcttcaaatacttgaaaacagataaaaatgcaggcatttctcttccagaaatatcaaattatcgaaagacaaaccggtataaaaattatggcgataattcacttcctgaaagaataccaaagtcttttttacaattagtatgggctgcttttaatgacaaaacaatgcaattactgacagtcgccgctgttgtttcctttgttttaggtctatacgaactatggatgcaacctccacagtatgatcctgaaggaaataaaattaagcaagttgactggattgaaggggttgctatcatgattgcggtctttgtggtagttctagtgagtgccgctaacgattaccagaaggagttgcaatttgcaaagctaaataaaaagaaggaaaaccgtaaaattatagtcataagaaatgatcaggaaatattaatttccattcaccacgttttagtcggtgatgtcatttcattacaaaccggtgatgttgtccccgctgattgtgttatgatatcagggaagtgtgaggcagatgaatcatccatcactggtgaatctaacacaatacagaaatttccggtggataactcattaagagatttcaaaaaatttaattctatcgatagtcataaccatagcaaaccattagatataggtgacgttaacgaagacggtaacaagattgctgattgtatgttgatttcaggttccagaattctctctggcttgggcaggggtgtcatcacgtccgtgggtataaactcagtttacggtcaaaccatgacttcattaaatgccgaacctgaaagtactccattacagttacatttgagccaattggctgataatatatccgtttacggttgcgtgtctgctataattcttttcttggtccttttcactaggtacttattttacataatacctgaggatggcaggttccatgatctagatcccgctcaaaagggttctaaatttatgaacatttttatcacatctatcacggttattgtggtggctgttccggaaggtttaccattagctgtaactttggccttagcgtttgcaacaacaagaatgacaaaagacggtaatttagtacgggttttaagaagctgtgaaacgatgggatctgctactgcagtgtgctctgataagactggcactttgacagaaaatgtcatgactgtcgttcgtggcttcccgggcaattctaaatttgatgatagtaaatcgttgcccgttagcgaacaaaggaagctgaattctaagaaagtttttgaagaaaattgttcgtcatccttgagaaatgatttattagccaatattgtcctgaattctaccgccttcgaaaacagagattataagaaaaacgataaaaatacaaatggtagtaaaaatatgtcaaaaaatttgagttttttagataagtgtaaatctagattatcgttttttaaaaaaggcaacagggaagatgacgaggatcaattattcaaaaatgtcaacaagggtaggcaagaaccctttattggctctaaaacggaaacagccttactcagtttggcaagattatcattaggattacaaccgggagaattgcaatatttgagagatcaaccgatggaaaagtttaatatcgaaaaagttgttcaaacaattccgtttgaaagttctcgtaaatgggccggcttagtggtaaagtacaaagaaggcaaaaataaaaaaccattttacaggtttttcattaaaggtgcagcagaaattgtttccaagaattgttcgtacaagaggaattcagatgatactttggaagaaatcaatgaggacaataaaaaagaaactgatgatgaaatcaaaaatcttgcgtccgatgctctcagagccataagtgttgcccacaaagatttctgcgaatgtgatagctggccccctgaacagctgcgtgataaagactcaccaaatatagctgctcttgacttgctatttaacagtcaaaagggcttaattctagatggtttacttgggattcaagaccctttacgtgcaggcgttagggagtcagtacaacagtgccaacgtgctggtgtaactgtgcgtatggttactggtgacaatatattaacagcaaaagcaatcgcgaggaattgtgcgattctttctactgatattagttcagaggcttattctgcaatggaaggcactgaattcagaaagttaacgaaaaacgaacgtataagaatcctgccaaatttaagggtcttagcaaggtcttcgcctgaggataaaaggttattagtagaaacattgaaggggatgggagatgttgttgcggtcactggcgatggtacgaacgatgctccagctttaaagctagctgatgttggtttctcaatgggtatttccggtacggaggttgccagagaggcttctgacattattttgatgactgatgatttctcagctattgtcaacgctattaagtggggaagatgtgtttcagtctccataaaaaagttcatacagtttcaattaattgttaatatcaccgcagtgattttaacgttcgtttcatccgttgcatctagtgatgaaacatcagtactgacggcggtccaactgttatggatcaatctaatcatggatactctagcagctttagctttagccactgataaacccgatccaaatatcatggacagaaaacctaggggccgctcaacttctttgatttctgtgtcaacttggaaaatgattctatcacaagctacattgcagttgatagttactttcattttgcatttttacgggccagagttattcttcaagaaacatgaagatgaaataacaagtcaccaacagcagcaactgaatgccatgacattcaacacttttgtttggttgcaattttttaccatgttagtatcgagaaaattagatgaaggtgatggtatatcaaactggagaggcaggatttctgccgccaatttgaatttcttccaagacttgggtagaaactattattttctcacgatcatggcgatcattggcagctgtcaagttttaatcatgttttttggtggcgcaccattttctattgccagacaaaccaaatcaatgtggataaccgcggtactgtgtggtatgttgtctctaatcatgggggtgctagtgagaatctgccccgatgaagtagcagtgaaggtatttccggctgctttcgttcaaagattcaagtacgtatttggactcgagttcctcagaaaaaaccatactggaaaacacgacgatgaagaagcgctgttggaggaatctgatagtccagagtccaccgccttttattaatagacgcgctctatatgtttatacaaatgtaagtgaccaaatgaaaagatgtgtgtaatagttatattttcaaaattgtacactatattatataatcaataaaaagaaactatctgaaatagcatgtcctcctaaacaaattcctttttacccttttatgcattacaagtggaccaaaaggactggaaatggtaaaaagaaataagaatttaaacatgctataaatttcttttgttaattgcaaattttttgtttttatcaccgattatgatatcataccatcgtcaatattcttggttgataaataactttgtgcttttgattttatgctctccgaaaagttgctatactcagcaaagaacttatctaggcctttaaacagacatttcagttcagaaagtgaatcaattctcccaatcaaatccttgtttgtttcatctttagcctcgttatcaatcgcagagcttaaagattcatcgattgtatcctctaatgctttcaatgatgttctaaaatctgttatcgaaagatctgtccccgtgctggttgtattattttctctaactgtcgaaatattcgtaacggtcctaacttgttccaggtaatataccactttttcaattctctccttaatcaacattaaactttgcagttgttgcctcacattggtattgcgattattttcgttatctagatcgcttagtttctcagttacattatgcattcctgtttctaatgctcttacagcacttgccaacgtatctaagtaatattcaagcttcgatgattttaaggattcagtagaatacaatgaggaatcgttctgttctgcttctttgtgatacctagaagatgcccaagttcttggtaacgtttgagataatttatccaaattccatatggtgctttccaactcttttgtaaggttctttgtgtaaaaatccaacctggttaatagcaatgaggatactgattgcgtttgaatctgatcttcgtttaaggcatttgataagagtatatcaacgaatgcatggggaacgaactcctcatcaaaaaacatactcaatatatcatcatcatcacccgtaattgtcaactctaccatattctgcttagtttggccttcttgttcttagtgaattgttctattttagacatatttcatatggaaataaaatgcattatcaccctcaaagcgcattacgccaagctcatgcagcgaagtgaacttttttgaaaaagttactagtacgaaagaggttaaggattacttaagttatacaaagcgcagaagttgttttttccaacttcaagcacctccccatttgattcatcatcagaaacgtaacagaattggctgacctcatcgtcattggaaactaaaaaggtgggcgtctcaaattcaatagcgggccgttcactttctgggtctgaaataatgtcaagcttaatactggtgtcgaatccagaagatacaaataaggctccggctgcaaagtagacattgtttattggggtgccttcattaattaaaaactcaccaactgggcattccggtgatcttagatcccattgagctagcattccattttcatatccggcataaatatagtttgcattattgccatcgactgtcaatgaattacatgaacatgtgaacttgcttgggagttgaatagtttgctctttggaaaatacattatgtacagtaataacaccagaaacgtgaccagcaatcacatattttccatatgttccaaactctagattatttttcttggaagtagaaatttcatgtaattgtctgtctgtccctacgaacagcgctatgctgttaacaccatcatgcgggttttcttttctgttaaacgtgtgaattgtcgttcctgtgccgcactcccaaaggcgaattgtaccatccaaagaggcagagagcacattccttcctcggtctattatggcaatatctgtgactgtcgccctgtgtccaattaacgtgcgaggatttgagccgtcttttactgaccagatctttaattgcatatcctgtgaactagatatcaaagcttcaccgcttggaaaaaactttagttttgttatttcactaacgtgagcttggtcaatttctctttgaaggttgaaatttgaatccaatactttaatatcgccttctgtagtgcctaatatgaaccgtctcatctgaagtttagctgtgtctacggcagtataatccgccctcttgagcatctttgaaccatctcttatgatagtattgaataaaaaatcatgtccatccaaccgcgccttgtataagtgggagccaaccttttcaaatgtatttcctttgcctgcatctacacccctgctatttcctaacactactatcttatgctccttgatttcatttaggtttttgtcaacattgatgtaaaattcatcgtcattttcatcattttcttccagaacagctttaaaatcatactggatatgagcaactgtgatggtcttagtcattgtcgtttctattgtacttcgctatttctttttactttctgctcttagggttgaaaacttaatttttcgaagcttcttttgccgatttctagattattcgcccatcctgacgcctgtaatatgtcatgttaaaaacatcacaaaagttaataaggttaactgagccttattcccaaatcctgacaaggacaaatgccatttttaatgtgcaagaaaaaggttccatccagttttctaataactggatgacgaaattttaacggaacttattaaccgtctctttttatattgttacgtattttgtatgcttggtaggtacgttaccttagtacataagtgttatcgttaaaatcttctcactgaaacaattgaactaatcaaccgaccttgttagatgagtgaggtgtaagtagaactatatgaactactgggcattcgcaacaacaccatcagatatactagtacacttttttttacagaatttttgagatgatattactactatgaaaaccctttactaacgtatttgattaaatgcgtcaaatattaacgaatttggctgtaccttcgcttttggtttatcaaaaagtttccaatatcgcaatgtttcatctccagccccagaaaccaccgtggttccatcattggataacgttaaatgcagaaccctgaaactatgacctttcagaattgcaattggatccatagagttacagtcccacaaggttaagttatattttgagtaaccatgtgatgtcacaagctcgttagtattctttgaccataccatattacatatttgagagccgctatctatatcactcatctttattgacgtattaacgttccagatttttagtcttctatctgctgtaccaccaccggtagctagcacacctcgtttatgaggagaccaggccattgccttaacagcagccttatgttcgtcaaacgtcaagattggagatttcgacgttccttcgtaaacatggacgacgttatcgttaccacctgaggcaagtttgttgtccgctacattccactttaggccacagacttcctgagtgtgcgattctatagtttcaaaaaagggatctggcatcctaacatccctatgcagtattcgatgatctctactcccagacgtcaaaacatgattattccaagataaacacgctactctgtcaatatgtcccgacaacgtcctaatacattttcttttcattacgtcataaatttctacaagtccatttgcttgacctactgccagatgagagcctgctccaatccagcttaagcttgtgtattcgttttccgtgtcgcataagtgaacaacgtcgccagtgttattatcggttaaaaaaatcgattttccaagagcaactgccaaaacatcagtacttgaccaatctatcaagctgtagtaaaaatcgtctgctaatgatggggcatctaaaactctatagggaactttagctatttgtctaaattgcttccccggtgataataggagctgtttggaatccggcctaactggcgacatggaatcaaaaaattgagattgtaacaaagaggccgcagatagtcttctacctttacgttgttgataagtcaacaggctggcgcccctaactgagttgcttgagggtctcgtgatttcatcttgctgtgatgtaaaaagacgtcgaggagtgactggcgtggaatgtggcgaaaattcctctaaaccagcagcttcaggaggtggagttgatactcgttccagttcataaccatgtctagttgtattttctgcgtgcacattgcctctagtagatggtctcgtattcttaatgcgatctatactgctctctgagcctaccgtatccttgcttagcatctcgccaaaaagctcattcttcagcaaagtattataagtttcatgtgcctgtctttccttttggtattctacttgatcttccgtactcgatggattaagggctggaacgcttgccatactactgatggaaacgatggaattgaaatctatatctgttcgggaaggaatatacctatcaccatatactgtagacggcctcgatcgcctggagggagatgataatagtgaggcggacgaagaactagatattggccttttcgataccctcttactttcagaacccttgagtggggaggaggaaggcgtattattcatgaatgggttcaggtttgtggacatgcaactaaatttaggatgaagactagaaggaagggtgacaaaaatcggagttagaggatgaaccaagtttgagatggccaagtctaaggtattgtaaatccatgaggttcttcttcatcgcaatattaatgctagaagcggtgcaaaaaaccattttgtgtgggataaaaaaacgtcgtggaattagaaactcgttcttcgggtaagaaaccaatatcgacacaacaagatatggggtgtatagttaaaatctctactgatagactttattggtgaggttgtgaacagattgttggcgctttcttccttatcgcctcaatctgaaaggatctagatttgccaatgttatcacactacatcttcctggcattcgttttattgccattcagagtttccgcgttttacttctatggttatggtggagacagaaaatgcttcctgaaggaactatccaaagacacccttttaaaaggttcttacaatttggaagtttacgatgataagttggcagattatgcgcttcccagttataatgactatggcattgtcatagatgtggaagaagtctttgataataatcatagggtagtccaccaacagggctctccttccggtgacttcagctttctagctttggaatctggagaatataagatctgtttacagtctagggtaaataactgggtagggaaaaccaaaacaaagttagaaatcgaatttgaagtcggttttgaagcaatgttggacatgcaaagaaaagaaaccttggaaagtttgcacggaaaagtcagtatattgaattctaagatcgtggatatcaggagagagcaacaactgatgagagaacgtgaagaatcctttagagacatatcagagtctgtgaattctcgcgcaatgtggtggacggtaactcaagttactcttctcattataatttgtgtatggcaaatgaaaagtttacgctcgttttttgttaagcagaaagtattatgaccgtacatatcaaaaaattgaatccttagcaggcatacatgagaatttcgttgtttcaatgatttatttctatttatttacatgcattaccccgacgcttcatagtgtagtcattaaatgagtgtatacatatatatactaacctagtcatcaagatgttttaggtgtttcaattcttattattcatctataaagacagaataaatatatacggtgcgtatcagatatgctatttcaacatactatctttcgataatcggatcaaaaagctcctaacgattgccattacaaaccttcgtccatccaggccaacgttttgttaattccttcttcaataccaactcttggtgtgtagcctagcaactttttggccttagcaatgttgtgataacggtatgcacacacaatcttgactctgaatggagtcaaacctggctctttacccagcatcttggatacccattctgaaagataacctgcacaaattgcaactggccttttcaaaacaataacatgtttatcaatatgaccatctgccttccacacagtacgggccaaggcccaaaaataggtgggggtatcattggtaatgaaaaaagtttcacccgagacagcagttcttgtttttggatcgagaagtttctgtgcagctaacacatgcgcgtcagcaacatttccagcataagtccaatcaaatagattgttattatcaccaatttggaacttcgactgccccaatttcgcaacctgtcttagaccaggtactaattgcctatcacctgggccaaaaataccagctggacgaagagcaacagtatagaaatcactgcttggatcattcgccttcaagaccatatcttcggcgatagctttagtctcattgtacgcatccataggaacttctgggattggccaggtttcgtctgcattgtgcacatcttgcccattaaaaataacaccagcagaggaagtatatacaagtatattaacgccacatttcttgcacatatctatcacgttacgggttcccttaacattcactatgtcataaatatctggattttgaccatgcattggagaagcacaatgaacaacaacatttgctttactttcgttaattgcgttttccatatcatcaggtgatgttaaatcacccttatgaaattttatgtcgtctacattaaaagtaaactgttttgaaagtttttcagggagatctctaacatcaaaaatgtggatgtctggcttaggattaatatcaaaaaattgctgaattaagtgcaatccaagaaaaccagaaccaccgataattaaaactgaatctatctttgacatatttatttttgtttgcccttccaggtagagttgcaaataaaattggacaaaattgacaatctatattgttgtctattctattttatagctgcagcataatcttttccttgcaggcttatatgagatttttaaacgataccatttctcgagagaacaataaacgatctatagggactatcggaccgagaaatataaaatccacaaacaccgacaataaaatagcctctaaaaaaaaaaaaaggtcctggagaaagcaatattcataccgcattaactttcattgaaccgaagatctacaaatatcctttccttgcattataattatccaatactttgtcgtcaatattctttcaaagaaagaaaaaatatgaaatcaaaattaaacatttttctgtaatttccgtaatacaaaaaactattttcttttcggaaggcaaaaacaaaaattataataaaaataaaaatatgtataatataatttttatcttctaactttttatttattgaatttttatatagtaaatataacacgtgatatatttgaaatgtgattatattatatatattgatgtttacatattttttatgtagtacaattaattttcaaatttatcgaagctcttaaaaagctcaagaagcaaatttccatgaactacattcaaaatttgcgtagcacctaaattcgttactcaaaccattagaatgttcaggaagaaaagttgttattcttgtgtcagaataaactttggatatgacttcagacattctttcaccagtacaacttatgaggcggtgcttaaaaactcctttcttagttttagagttgtcatttggcgctaataaacactttgcagtgatagaggctattttatatcaatgaataacagttagtaagatgaaaagatactggaaaaaagattaaaaaatgagtagggatatgtttatgatatacatacactttgtttgacaatcttcatttaaaaaaggtgggtcaattaacaatctatcaacttttcctttaatttcatcactgaagtccagtggtttattgtaatcataaaaaaagaaatgatctcttccagctaacaactcgaatctcttatcaaattcgaacaagtagatatgttcggttggaatttcattagtaggtttcttttgaatggcagcatagacggatggcgcactaactattgcaattacagtgttttcgtccgcaccttccaatatggcatctgctaaaattgcggctgtgtcatcgctgtaccaaaactgggaaagctgccaatcttccttgaaaagcttcatcccttcttctttttttttcttttggaagtcttcatccgtttcgtcgtaaagcttttgaaaggcttcttgatgttgttgttcctctcttttgaattcttcaagggcagcgagggcattagcagaaagtgtcctattaagtttcgtgttagttagtaattctacgttactgtgttgaaaatatcctgtacttacaattcataatcggagtcggagtcggagtcggacattttatcagtgattctttcggtttcattaagatgtaaagtgactgattagtatattagtcaagattaatatttttttttttagttcctccagttcaaaaaaattttgttagatttaaccggcataaggttcagcgatacagacgaaaaaagaagcctctaaatgaatgggaaattatatatacatgtatattatgcagttgatattctatgagatgacaatactaaactatatacctatatacattgcccatcttggattttgctgccttacagatgacaatataagttatttagagattgagggttactagtgcataatatttgcgtgatttccgaaagtacctctgaaggtcccatgttgtacaccaaatattataaaacagtctattttacgcaaaaattttaatcacatacgtgctagcaaaaagcattttctgatgttcacttggtgattgacataccagcttcgtatttgtcaacgtgtttttttaaatcgataagcgtattgatttttttcaaaagctcctcttgtctttccattacatcaaatgagggcatcacagggcgagaaggtaacgataattcttgaagaatggcgagaattttgttctgcagcgcaggtttgaaggtcgataattttgtagatcttaagtatacacccggcgatagcttctcaccatgcgtaatcacacctaaagccttcctttcatctgaattgaaatctttcagcaattgttctgcatatgcgctttctgactttcttttgagcgccgtttgcatttcctgtctttgtcttttggttttcttgggggagagattttccttgacttctgacttttttacattcagttgttgaagttgcctatgttgggcaaactgctgttgctgcttcatccaaggattttcagggatgttcaaatcgtgcttccgctttctagttttatctgctagaagcgcgttatataactgagacattccctgagaggtaaggtattgtgtaattgtctgatctgaatgtggcgagtccaacagtcggagtaatgattctctttctgcaagtgttctcttggcagccatttcaaattttttggactctactacgagtgcctcttcttcagcaatttctgctgcagaacgagaaagaagacgctgtaaatacttttttctctctatctccttttcagctgaaaaattcaaagaagataaaagcggattgctaggatcacttgctttaaaataattcctacaggtgtaataaaatttttctttgagatcttcaagtgttcttgaattattataactgtatctgtcaaagatcaggaaccaacgtaaatcgtattttttgcagagattgaacaggtattctatttcttcaaaagaccagctatttttactttcatccttcttttcattagtaaagttttcgttatggtttttttcactttctacgcttttttgagttccttcgttttcattcataaaagcctcgtactcctccttggtgaatgatggaatagataaatgctgattgaacttagaatatggcgattcttttggtgtgtctcctattaattctttggaacccttgacccaatgacgcagagtcacagagttattagctttgaactctacaaatgaccaaggagatggcttggacgtcgaaagcattttttctttaaagttatttccagacttaataacaacggggggttggttctctcctagcaggttaaatagttctctttgcatgcccgtcacttgaggcttgggccggttggctgccgaggacgaaggcactgatacctggccattagttggacttctggatttttgcttaatgtttagtacatcaaagatgtctgatgatgacatattacctgtggtttttttactaaattttcgtattatcggagaaatatgttatgaatgcttgttgctattaaaatacaaagtggattcttgatttatcactaaatagctacccggagttggcgcatcgcaacttcattaaataagttcgagtgtgcgtattctaatctgattcatataaagtatactctaaacgggctaactcaaatctgaaattagggctactatatgataactaataagaaaataaagataagtgtcccagaaaaactcggtttgtcagaagaatcttttgaggaatcctgggaaacagttaaatatgccattgatcatatatacagcgatgacatggccgacctttccttcgaacaagtgtacaagaccatttatactatcgttttaaataaaaaggggccaatactttataacagattgaaagattatttaatccaaaaattagcgcttttgagggaaacgatagtcaaggacaatactcatgattatgagtttcttggaactatggcacggttatgggaggtgcaatgccattgttttaaaataacgggagacttaatgatgtatatggacaaagtttattgcaaaccaaatagatgcatggaggtatacgacatgtgcctcgatcttttccgaatcgaaatattgcaaaaatgctcatcttctctcatctcagcactgatatctgatatagaaaggattcgtaatttaggatctgtcgactccgaacatactagtttgtggaaagtactaataggaatgatggagacattacatgacaatagagatagttttttcttaaccgattttgagccggttttgattagcgcgacagaagaatactacaataaagctattgatattgaattattaacgccaattgagagcctggaaaagattaggaagttaaggcagtttgaaagtatgctagactcctcttttctaaatgtggattctcataataagttgaagactgtattagaaaatgtccttatatggggaaagttgagtgatattattgaagatctaacgcacgaagcaatggtaatttcaaatggaaagctactccaagaaatttatgacttgtcaagcgaggaaaaatatcgcgttactgtcattgaatctattaaatcttacatcaataaaaatgccataaatattccttttaatgaaggtaaccgcaaaaaagggcagaatgcgattacttggtcttcggaaattgtagagctatatcgcagtcaacactcgtttttggaaagtattgattttggttctgttcgtcttaataatttgaccggggatgtatctaatgcaatacttggcgatgttttctcaatgtatttctctaaagaaggagcattaccatctgagtatctttctacctacgtggaccattgtatgaaacgaaccaaggaaaaagatgctgaaatagtgaagatcaagcaagatttgcttgatagtaccaaattaatcggactcctaactgagaaggatatatttgaaaagatttacaaaaaacaactctccagaagattactgcagcagaggtctttagtggaaattgaaaaatggatggtgcaaatgataaagaaggttctaggaactttttttacctcaaaattggagataatgctgcgagatatatctttatcctctgaaatgtatcaagcattccaacactcaacaatcaacagcatagaatatttgagttttgcaccacaagttttgacgagaacgagctggccctttcagagtactaatccaattgatgaaggtatttcactacctcctagaatgtcacaaattttagctggctttgagggctattacagcttaaaatacaaagaaagagtgctaaagtgggctcatcatctaagtgtaattgaaattggctgccaatttaatagcggttactacgaaataagtttttctgtttacgctggagtgattttccttctatttgaagattatgaagaattaacgttgggggaaatatatgaactaactcatattcccatagatgacgttaagtctcttgtaatgtcaatgtcgacaatacccagatgtaagattttgaaaaaatcatccagttcaggaaatatgaaattttcagttaattatttcttttcttctccaaacaggaaagtgaaagtgccggttattgcatgccctctaccatctcagaaatcagataatttggcaaccgcaagttccgtggacacttatgataatgaaattgttatggagcttagtgctattattgttcgtatcatgaaaacagaaggtaagctaagccatcagcaattacttgaaagaactacgaaacggacacagtctcggctcagtcttacaccgagcattttgaaacgaagcattcagcttttaatagagaaagaatacatccagagaaacgcagatgacccctcttattaccattacctttcctaattgcttataatgaaaatcacaggtataaggtttgcagaatgccaacagtatatatagatggcagttcctatccggctgccagagcgaacaatattaagaggatatgcgtcgatactaattgaatgttcatcctgcattccttagtgaaactttcaaaatatataataacatagttatggtagactatatatcccagtcaaacttgaatgtaatgtggagtgggtaatcgatatctcttgaagtttattatgcctcattatatttttataaaaaacttctaggaatttgttgagtcaaataatttctttcttaatcattaagtaagttaaagttacgagcctttcagacctgcgtagcactgcttcaaaggaactattatcaatagcagcgccttgctcttttttttttttcagatgcttagcggccgtatttcacttttcctggtagaaaaatatatgttgaaatttacggtataagagaagctcaccaaaattattatcaataaagcggcacttttaaatttggtattcttccctggttgtcaagccttggtttccctttatttgatagtatgagcgaaataaataatgaaaatctagagccaacctcaagtacagtagctgagtctacagaaagcaagaataaacacattcgtagcgctttaagaaaacgaagaggtaaattaagcgcccaaacttatgaggaagatcaagaggctattttatcatctcctttattgacttcaacacctaaaacagtctccaggtcattagtgaggttatacccatatttaattgttgtggataactttctaagtatcatcacttggtccaatgacaatgtctctgcaaacttgcttggaatattcttatttacggtttgtgttctatattttggatttattacaaggtattttggacatttaatgatcgttggtataatatgggtatatcttttaattgacaagcacgttcaagaaacaatggcatcttgcccttcattggatgatataatacacgttatggatagggtttctatgaaatctagcgctgtgttatctcctattacgattttgagcgctcaggatgttagaagactgttatttaccattgccttcctatccccagtttatatttttctaacagtgtttgtgctatctccaaactatttaatgttaatagggggtctgtatgtgcttacgtaccattctaaactaatccgaagaatgagaagatacttgtggaaatttcgcgttgttagattacttgtatttttcataacaggattagaccttggtggaccagataataataggcgcttgtttgcttctgtcaataagaaaataaggtcctttgtttggaatgaggtagggaacacatctaacactaaaaagactgtacttttcaaggttgctctgtttgaaaaccagcgccgctggcttggcatcggatggacatcaactatgttgagttatgagcgcgcatcttggacagatgaattcctaaatacttctccaagcccagaagtgtttactttaccagaggagcagtcgggaatggcttgggaatggcacgataaagattggatgcttgacctaacaaatgatgggatcattcaacttcctgcttctgctgctaagacaaaagttaagccaggtgcagatgaaggtttcatatattatgataacacctggaataatccctctgcaacggacacatataaaaagtacacaagaagaaggaggtggatcaggactgcaacagtaacaacaacgtatgacgatgagcccactgtagaaaaagctacaccgaattctcatgctctgaagagtgaagaaaataatagagttagaaaaagaaaagtgtcatttagtacagcaaatgaagtgcatatcataccttcctcggacagtagcaaattaatacaaatatctgatgtttcaatgtctccttctctataatgagtgcatgccccatatggacaacaacgttcacactggtcggtgcaagggcacacagcaatctcagagtttctttcattggctgcatggagcacaaattcaatcttgtgctttaaagtatctgcgcggttatggcaagttctccatcagtctcttattccagcaagcattcttttacggaacttcaatgcatctaaatacatatgtacagatagccaaaactaatagagacataataaattaaacaaaactgtaaattttaaaaagagtatatatagggctcaagaaactgcgtaaatataaaattaatgaagaaaatctgattgtcaactaaacgacatcttccatttctatttcatcttccaagtcagcctccgcgtctccttgcgcattgtctccagcggaacctgtttgctcatcagctagttcacctaaggttgcctttctctcctcctctttcaactttttatactctggccttaaagtgtatttgaatgcatatgggcccttcttcactagagtggcaactttatccaaacactcctttaaatgtgcttcaggttgcctagtacgttccttcaaccccttcaaggaccagtagtcatactcatcaaataacttgaacaagtaatccaagatttccttctttggcatacgaatagatttaatattgctcttggccttctcacgccccactttcaagaaattcgagttgtctgacctcatggacatacctgtgtggctcatcgtaacaccaacggtttcatccaaagttgtgatcctttccttattattaagcttgacaatatttcttctctgttcaacaatcttgtgataattaggatcattcattgatggcataacctgacattcgtggcaaactgtacccacaatggcggtttttttgggaatcgtcttcacatatggtatatatctatctctaccatccctatctgtcataactctgtgattaaacttttttctattatttctacgtttttgctgctgctgcttcttcttaagttcctcttcacgttcttgcttcttcaggtaagcttgcctttgcttttcaggatctgcttccaactcctttttacgttgttgatatttctttaaattttgttctgtgaaaacatattcattttctactactttctttgtaagttctaaatcatattcgtgcggtatagaatcgttatcattttcattcaatagaagtgtgattttactcccatccttgtttatcctaattttacccagttcttggccatgcaagttgtttctgtccctccatttctctgctagaaacatgggcaatctaactaaccagacttgtctattactacgttccaagtccaaatctaaggattcttcataaactttggtttcattattctcaatatcattaccgtcaaaaacttcctcctcttgcgaaagatactcatcaccggaaatgttacctgatttctccttcgcgacagagttcgtggaattattagaaagtgctggtgcccctgctgaaccactgctcatggtgttaagttggtcttctattttactcttaatattgcgttatgcgttgaagccaacagcatatgtcttattcttctaatttcaagcctgataatttattcatttcgcgcaagggaagatgaaaaagttaagaagagaatcgacctttggaaagggccccaatggaaagaacttcaatgttttttcctctacaagtaataagagcataaaatggacctagatctagccagtatcttaaaaggtgaaatttctaagaagaagaaagagctggccaactctaaaggtgttcagccaccatgcactgagaaattccagccacatgaatccgcaaacatagacgaaacaccgcgacaggtagaacaagaaagtacagatgaagaaaacctgtcagacaatcagagtgacgatattaggaccaccattagcaaattagaaaatcggccagaaaggatacaagaagcgatagctcaagacaaaaccatctctgtaatcattgatccatcacaaattggttctactgaaggaaaacctcttttgtcaatgaaatgtaatttatatattcacgaaatattatctcgttggaaggcgtctttggaagcttatcatccggagctgttcttagacactaaaaaagcactctttccactcctactgcaactacgaaggaaccagcttgccccggatttacttatttcccttgcgaccgttctctatcatttacaacaacctaaagaaataaatttagccgttcagtcctatatgaaactcagtatcggcaatgtggcctggcctattggtgttactagcgtagcattcatgctcgtagtgcacattcgaaaattcaaggaggccggaatgctgctaacataatgattgatgaaagaacgcgattatggattaccagtattaaaagattaataacttttgaagaatggtataccagcaaccacgatagcttagcctaattgttgaactattgttttcgttatcgcgtggcacgatatcatgcggccaaaataagaagcaagaatgcagatgttgatagcctttgttcaattttccagagacaaatgctttacaggatcgggacttgaaatatactgactggatgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatggataaatatcagtgccaatatgttgttcatggtgatgatatcaccatagatgctaatggagaagactgctataagttggtgaaagagatggggcgcttcaaggtagttaaaagaacatatggcgtaagtactaccgagattatacatagaatattgacgaaaaaatctttgccaccgactcatcctgattattatcccaccacccaggaattgagtttctattctgtcgcccaagatgccgtttcaaaacattgttatgtctttcagagggatttggacaatgtcttggtcaatggtggatacaaattcgatgcagaagattgtgtttatgttgacggggattttgacttattccatatgggggatattgatcagttaagaaagctgaaaatggatcttcaccccgataagaaattgattgttggtattaccacaagcgattactcgagtaccattatgacgatgaaggaacgcgtcttgagcgttttaagttgtaaatatgttgatgccgttattatcgatgctgacgccacctcaatgtctcagtataactgcgagaagtatcatattggcacggctgtcctcactgctgccggaaaattcagtgaatacttgactaaagagcttattgtgaagagggtggaatcgcaaagggaggtttacattgcgaggaaccaaaaaaagggaatgtccatataaacaaatgttgaaaacttcttcgaacgtaaattaaatggatgtaagaaaactgtattacataagtcatgaagtaggcatgcaagtatatacctatagatgcatataaatcagtggagaaggccactatccttcagagatcaaaaaacctttttttatcttgaaaacgccctcattccttttggacgttttcaaacttttgttcatgcgattgcaaatttgagcctcttctatctttcttgaacactgggggtatttcaccattatcaattaagtcatcaatctcatcgcctggcttaccccaattacccttgccggaaccttgcttcttgatgtgatttggagattcaccgtagttaccagtgtgcgaaaagtactttggatcagcctttccttcacgttcggtccacttgtttgttctcgtcattttttctgattggttgtacacttgagcggtttgttactgttgattgttcgtttatttgtataattgagtttacacaacaattgttacaatagtatgggtaattagggccaagagagtgacaaaaagcaaacttataaatagtccttttatacaaatgacaagtgttcgcttctgcgctcgcagccccctgttttcgaaggagtttcttagcctaagctaggcaggcgcgcccccattatctatcccttcattgcttactgagaggttttcctccccccctccgcgtatatttcctccgctggagaaaattagttgtgggacggatagcatcacttaattctgtacctttttgaaactggcttggtactttctgttggatagcaacatttcccgctgggatacttcaacatgggctatgaattttcttttgtcttttatcttttatcttttatcttttatctttaaattatttgagctcggttaagttcataactattgcgtgcccgaatggtattctttcaattcacaaccaaacattaaaatgaagaaagcatactcttatattatatcaatgtctttttctttacttatttgtctttgctcataaatttctacataatggtagtaatggtgatgaaatgttgttacttgtgatatattacatagtttttacaggcatattctatctgatacctgccaacctgttggtattcatatggagattgatatctagatcatcagtgctttcctcaatgttgttgagacgtttttgctgagagtctaattctttaccagtggtcaaggccattttcttcaatctgttgctaacctgctgaatctggtccaaattcctatcaatttccaattccatttcgtcatcttcttcatcattctcaaactgatatctctttgccttttctagaacattcttcctctgatatctttcccgcacctcacttatgttattatttgcgttcatagcaccctctattctttgagtggactgagacaattgttgacttgtttgctctctcattaatttttcttcaattttcctattcttcagctgctcttccctctcccttctccttctcttggaattaaacggattagaaacatggacagccaatatactacggttcaatttttttagttctgcaactttttcatctgcaactttattttgcaccttcattaaatctaagtttccttctacgttattcaattgttcactttgatgacccagcatacccaatgtgttcatacctgctctttcggcgtcttgagccatttttagtgtatttctagtagaggctacggaactctgtttcgtaaatttgatctcctgcttgatttcatctactgcttcatcttcttcctgctgctggcgagcctcctcttctttttgtatttcttcaaatgttttgtaacccctttgatctccatattggttatttgttgcgttaaagtgttgctgttgctgttgctgctcatccatgaaccactgttgctgctgctgctgtcttgaactatgatcaacttcggacgcatttaaatctattgaatcttcattcgtcattactgcattcaaatcaggctcatctaatgccgctctattttctgcagacttgtcagcataaacttcttcaaaatcaaattcacctgttctaggttcttcatttaaatcaacttcactattgcgtgctgcttcatcagaagcaataaaagagggcgtataagtcattggagcttgttgcgattgcggttgacgcacacttctactagaatatggatttgcagacctgttcaaatttccattactatatgagtcgttcgccatagaggcgtatggatttgcattcttggagcttccttgtcgagtaccgctagatctattagtattggagtcatacgccccgccataactattcatatcagcgtaaggatttctcttttcttgcatcgggtttgctaagggacttctttggtcaagcgataagctgttggtcgacgttgaaaccggcggttgccttgtttgcctcgaaggccctacgtttaaagtgctgtttgaatgatttaaactattacggccattcgcattcacccagctgtttgaagtattttggttactatacgggccatcgttattatatgaattcagagatgtgccattgtacccccctccataatcaccataaggcgcagcattgacgctacctctcccattacttttattagcttgaaaccttgcataaggatcgtcatcatatcggtaatcatcattttcgatagcgtacggatcttgcatagaattggattctgctccatttccgagatcttgcgtgccacttgaacctctattagaaccagcagttgcctcgttagcattggcatctaagggagaagcattcaaatcctcaagttcatcctgtggcctagcatactgctcataacctggtggcgcgtataccttatcttcagctttatcatttgcaaatttaccgtaggcggcaaatttctcttttcttttcttgctagggtttttgacactaatacccagttccatcaaagtatccttgttctgttctggtgtcgcttcctctggaggcttaatcttaaaaaatttctttaatcccattcttttggtgtcaatggtgtattattccgagttactccaggctaggttcaggagtaccaagaatgtactttatttatttatacaccggagcaagtcatataattacgcaaacgattcgaaattgttaaaagcaggatcaacgtatctcatttctttttgaaagacgggtaatagaaagtctctgagtcgcaccccacatggatatcgtactattcgtatatggaatgtaaaatactcgcaatacgattttatttagcttcacaatctctcaaacttatcgtcttgatcaatctttacgttttaccaaataatcgcctgtttctggccattttttgcttataccatctaccatactcgctgtccatatgtgacggtgtcgtctccaagaaaaataacaatgtaaattgacccagcgtgacgacagtagactgtaagttatagtacaatcatactctaccttagtcactgttcctccactgttaagtagagagagagagagagtttaaagtggagaaggcaagaaaaagtgcacttattacgtaatggatcccaccaaagcacccgattttaaaccgccacagccaaatgaagaactacaaccaccgccagatccaacacatacgataccaaaatctggacccatagttccatatgttttagctgattataattcttcgatcgatgctcctttcaatctcgacatttacaaaaccctgtcgtcaaggaaaaaaaacgccaactcaagcaaccgaatggaccatattccattaaatactagtgacttccagccactatctcgggatgtatcatcggaggaggaaagtgaagggcaatcgaatggaattgacgctactctacaggatgttacgatgactgggaatttgggggtactgaagagccaaattgctgatttggaagaagttcctcacacaattgtaagacaagccagaactattgaagattacgaatttcctgtacacagattgacgaaaaagttacaagatcctgaaaaactgcctctgatcatcgttgcttgtggatcattttctcccataacatacctacatttgagaatgtttgaaatggctttagatgatatcaatgagcaaacgcgttttgaagtggttggtggttatttttctccagtaagtgataactatcaaaagcgagggttagccccagcttatcatcgtgtccgcatgtgcgaattagcatgcgagcggacatcatcttggttaatggttgatgcctgggaatctttacaatcaagttatacaaggacagcaaaagtcttggaccatttcaatcatgaaataaatatcaagagaggtggaatcatgactgtagatggtgaaaaaatgggcgtaaaaatcatgttattggcaggcggtgatcttatcgaatccatgggcgagcctcatgtgtgggctgattcagacctgcaccatattttgggtaattatggatgtttgatcgtggaaaggactggttctgatgttaggtccttcttgctttcccatgatatcatgtatgaacacagaagaaatatccttattatcaaacaacttatttacaatgatatttcctctacgaaagtgcggcttttcatcagacgtggaatgtcagttcaatatcttcttccaaactctgtcatccgttacatccaagagtataatctatacattaatcaaagtgaaccggtcaagcaggtcttggatagcaaagagtgagtttattacaactctgatactgcagcagttcaaatttaccactttcctcttcaaggtgcatagaaaaaaagttcctggatgcacgatttaaaatgtttacagcagagcaacaatcatgtgaacaatgtcaaacatttattttaacacttaataattataatataaccacaccagcggtaagtttcataaggaaaacctttcagacaaacattccagtgaatcgtatacgtaaatcagcaaaattagcttataaaatacagaatccgaagatacttgatctactcgcgttactattaatgcgggtaatgatctatattgaattttgcacgtctatagtaacttaaaagtcttgtaatatttgaagtaacaatgccgtataatactgcataatagccctatcaatcggaatataccaaaacatcctttatgtcctgttctcaaaataagacttctgtcagtctggcctggcgtgaatgcatatccatcgcttccgtcctaattggcgcgtatgcatcatacaaatactataagctgttcaaaacacgcgatattccacgtccaaaagaaggcgttgaagaactcataggaaacactcctctggttaagatcagatctcttaccaaggctactggagttaacatttacgctaagttggagttatgcaacccagcaggaagtgctaaggatagagtggctttaaacatcataaagacggctgaggaattaggcgagctcgtcagaggtgaacctggctgggtatttgaaggaacaagtgggtcgactggtatctctatagcagtggtctgtaatgcgttgggttatagggcacacatttctttgcccgatgacacatcgctagaaaaattggcattactagaaagcctcggtgctactgttaataaggttaagcccgctagtattgtcgatccaaaccaatacgtaaatgccgccaaaaaggcatgtaatgaactaaagaagagtggtaatggaataagagcagtttttgccgatcagttcgaaaacgaagccaactggaaagtacattaccagaccacaggcccagaaattgcccatcaaactaagggaaatattgacgcattcattgctggctgcggtactggtggcaccataactggtgtggcaaaattcttaaaggaaagagcaaagataccttgccatgtcgttctagcggatccacaaggatctggcttttataatagagtcaactatggcgtgatgtatgactatgtagagaaggaaggtactagaagaaggcatcaagttgacactatcgtagaagggattgggttaaacagaatcactcataattttcatatgggcgaaaagtttattgatgaatcaatacgagtcaacgataatcaagccattagaatggcaaaatacctatcggtaaacgacgggctattcgtggggagtagtacagctattaatgcggtagccgctattcaggttgcaaaaacgcttcctcacggctcaaacattgtgattattgcatgcgacagcggttcaagacacctaagtaaattctggaaagaagctaaagaaatcgatcacgacgtgtcattagaagaagtaataaatatctaacatagatgtataaatcagtactgagttatcttctattaaattgtaggaacaaatataaaaaagcagttttcgctgctacattttttgctactttccgtggtaatgatgcccgctaaaaagtgcaaaagtaattagatagatcaagaacaaaaacagaccaggaccaaaatcaagctcataaaagttccttaagagtacgtcgatttacagaacatgagggatattgtatttgtatcaccgcagctgtatttgtcatcacaggagggttggaaaagtgattctgccaaaagtgggttcatccctatcctcaaaaatgatctacaacgttttcaggactcattaaaacatatagttgacgccagaaacagcttatcagagacactgctaaatagcaacgatgatgggagtatacacaattctgaccagaatactggtttgaataaagacaaagaggcttcaatagcagataacaatagtgctaacaagtgcgccacaagctcttcccgttaccaagagctcaaacaatttcttcccatttccttagaccaacagattcatacagtatctttacaaggtgtctcttcatcattttctcgcggacagatagaatcattgctagaccactgtttgaatttagcgttgactgaaactcaaagcaattccgcattgaaagtagaagcttggtcttctttttcttcgtttttagatacccaggacatttttataagattcagtaaggttgatgaagatgaggcatttgttaatacgctgaactactgcaaagccttattcgcgtttattagaaagctacatgaggatttcaagattgagttacacttggatttgaacacaaaagaatatgtcgaagaccgaacaggaactataccgagtgttaagccagaaaaggctagcgaattttattctgttttcaaaaacattgaagatcaaacagacgaaagaaattcaaagaaagaacagttggatgactcttccacacaatacaaagtggatacaaacactttaagtgatttgccatcggatgctttggaccaattgtgcaaggatataatagaatttaggacaaaagttgtcagtatagagaaagaaaaaaaaatgaaaagtacgtacgaggaaagtaggcgtcaaagacaccaaatgcaaaaagtttttgatcaaataaggaaaaaccactcaggagccaaagggagcgccaatacagaggaggaggatactaatatggaagatgaagatgaggaggatgacactgaagacgaccttgccttagagaagagaaaagaagaaagagacctggaagaatcaaatcgtagatatgaggatatgttacaccaattacattccaatacagagcctaagataaaatccattagggctgatatcatgagtgctgaaaactatgaggaacatttggagaaaaatcgctcattatatttgaaggagctattacaccttgccaacgacgttcattacgaccaccatagatctttcaaggagcaagaggaaagaagggacgaagaggatagagctaaaaatggaaatgcaaaggaactggcgcctatacaactatcggatggtaaggccatatctgcagggaaggctgccgccatcacccttcctgaaggcactgtgaagagcgagaactataacgcggacaagaatgtgtctgagagctcagaacacgtcaagatcaaattcgactttaagaaggctattgatcactcagttgaaagctctagcgaagacgagggatacagagagagcgagctacctccaacaaaaccctccgagagaagcgcggcagaggaccgtttgccatttacagcagatgaactgaacataagactaactaatctgaaggaatcgcgctacgtggacgaactggtgcgtgaattcctcggcgtctacgaggacgagctggtggaatacattcttgagaacatccgcgtgaaccagagcaaacaggcccttttaaatgagctaagggagactttcgacgaggacggggaaacgatagctgatagactgtggagtcgtaaagaatttcgcttggggacctgaaacagaagggccttggcgcgcgtcccaaaagggaaaggctcgctctgaaacaggcgaagacacgaaaacaaattaccgtttcggggcgttttgcagcaagtggctagacacgtcgggcgttgccagatcaaaatagcaccagtgggtgtttttttactatctcatcttcgtgctgatatatataacttttatacatttccatagtaccaagttctttatttcctgcatttttacatttataatagattaccaaaactattcgacctcaccaagggaccccataatattgctaaaataatcttacctgttttttaccatttttttctttttttccagaagtaataagctctctcttagaagaactaaaagcatctgacttcggctcgttccaaccgaccaaaatatttgtgaaaatattattcattcctttaacgacttattgtgtattctgttcatctctagctggcttccacctcgtttcctatttttattgacttttcattaggcttcctaattatacccatctatgcagtttccattcgcttgtctcctatcgacccttgtaattagtgggtcattggcccgggccagccccttcgactttatattcggcaatggaacgcaacaagctcagagccaaagcgagagtcaaggtcaagtttctttcaccaatgaagcttctcaggatagttccaccacctctttggtaacagcctattctcaaggtgttcattcgcaccagtctgcaacaatagtgagtgccacaatctcttccctcccatctacttggtatgatgcgagctccacttcccagacttctgtgtcatatgccagtcaagaatccgactatgccgttaatcaaaactcttggagcgcgtctactaatcaactgccatctaccagtacgacaagctactatgcgccaaccttcagtacatcggccgattttgctgcttctagtgtaaatgcagcttctgatgtctccactgccagtgttcccattgatacgagtgctaattctatccctttcacaactacaagtaacatagagactacaacgagtgcacctctcacttcggacactccacttatttccactagtacgatgtccgcagctgataacgtattttcgtcagcaaaccctatttctgcctccctaacaaccaccgatagttcagaaagttttgaccaaacttcgactgctggtgccattccggtgcaaagttcagcagattttagtagttctagtgaaattttagtacaaagttcggcggatttcagtagccctagttctccaactactaccgatatatcgctatcagctgccccactgcaaacaagtgaatcaagcagttttaccactgcatcagcagctctaccagtaagttcaacagacgttgatggctcaagcgcctcacctgtagtgagcatgagcgccgcaggacaaatagctagctcaagcagcacagataatccaactatgtcagaaaccttttcgttaacatctacagaagttgatggttccgatgtttcatcaacagtgagcgcattattatcggctccttttttacaaacaagtacttccaacagtttcagcattgttagcccatcggtatcttttgttccatcacagagttcctcagacgttgctagctccagtactgcaaatgtagttagttcatccttttctgatattccaccgcaaactagtacctcagggagcgtagtttcggtagcgcaatccgcatctgccctcgcatttcaaagttcaacagaggtatatggtgccagtgcctcgagcacaatgagttcattattatcaactacttcgctacagtctactactttggatagctcaagtttagctagctcctctgcgtcgagttcagaccttacagattatggcgtctccagtacagcaagcataccgctgttgtcagcctcagaacaagcaagtacttccagcagttttagcgttgttagcccttcggtatcttttgttccatcacaaagttcctcagatgttgctagcaccagtgctccaagtgtagttagttcatccttttcttatacttcactgcaagcaggtggctctagcatgaccaatccctcttcatcaactatagtatattcaagtagtactggcagttctgaggaatccgctgcatctacagcttctgcaacactgtcgggctcctcgtctacttatatggcaggaaatttgcaatcacagcctccatccacttcaagtttgctttcggagtctcaagctacaagcacttcagctgtgctagctagcagttctgtttctacaacttcaccctataccactgcaggtggtgcatctacagaggcctcatccctcatatcatctacatctgcggaaacttcccaggtaagttattcacaaagcacaactgcattgcaaacttcctcattcgcatcgtcttcaacaacagaaggaagtgaaacatctagtcaaggtttttctaccagctctgttttagttcaaatgccttcttcgatttccagcgaattctcaccctctcagacgacaactcaaatgaattctgcaagctcatcatctcagtacactatatcatccactggtatactttctcaggtttcagacacatcggtgtcttatacaacttcaagttcgtctgtttctcaagtttcagacacaccagtttcttatacaacttcaagttcgtctgtttctcaagtttcagacacaccggtttcttatacaacttcaagttcgtctgtttctcaagtttcagacacaccagtttcttatacaacttcaagttcatctgtttctcaagtttcagacacaccggtttcttatacaacttcaagttcgtccgtttctcaagtttcagacacgtcagtaccttctacaagttccagatcgtccgtttctcaagtctcagacactccggtgccttctacaagttcaaggtcgtccgtttctcaaacatctagctcactacagcccaccactacatcctcccaacgtttcaccatttccactcatggagcgctttctgaaagtagttctgttagccaacaagcttctgagattactagctcaatcaatgcaacagcttccgaataccatagcatccagacaaccgcggctactcaatccacaactctatcttttaccgacgcaaacagcagttctgcttccgctccattggaagtggcaacgtctacgccaaccccatcttcaaaggcatcctctctgttgcttacaccatcaacatcctctttaagtcaggttgctacaaatactaatgtacagacgagtttaacaacggaatcgacgaccgttttagaaccatcaacgactaacagttccagtacgtttagtctggtcacttcaagtgacaacaattggtggattccaactgagttaatcacgcaggcaccagaagctgcatccactgcatcttctaccgttggaggaacacaaactatgactttgccccatgcaattgcagccgcgacacaagttcccgagcctgagggctacaccctaatcacaatagggttcaaaaaagctttgaactacgaatttgttgtatcagaaccaaaatcatcggctcaaatcttcggatacttgcctgaagctctgaacacaccttttaagaacgtattcacaaacattacggtactacaaatagtgccattacaggatgactcactcaactacttagtaagtgttgctgaagtatactttccaactgcagaaatagaggagctgtcaaatctaattaccaactcttcaagcgctttttacacggatggaatgggtacagcaaaatctatggctgcaatggttgattcctcaataccgctaacgggcctcttacacgatagtaacagcaactctggcggatcttcggacggatcctcctccagtaattcgaactcaggatcttcaggttcaggatctaattcgaactccggtgtgtcttcatcttccggaaattcctatcaagatgccggtactttggaatattcatccaaatctaactccaacgtatccacttctagcaaatcaaagaaaaaaatcattggtttagttatcggcgttgttgttggtggatgcttatatattttattcatgatttttgctttcaagtatatcataagaaggcggattcaaagtcaagaaattatcaagaacccagaaatttccagtatcagttcaagtgaatttggtggagagaaaaattacaataatgaaaagagaatgagcgttcaagaatccataacacaatctatgcgaattcaaaattggatggatgatagttactatggtcacgggttgacaaataatgactcaactccaaccaggcacaatacatcgagttccataccaaaaatttcaagaccaattgctagccaaaactccctgggttggaacgaagtttgatagcaatgtctgcagagactttctccgcttgcataaccttataaacttataacgatacctacttatttcatatcttatgtatagttctccttcaaggagacgttgttttaatacttttatctattccatttatcattatctactttgtaatcaaagatcgaagcactgctgtgtgcgttgatttgggcctgacacgagaagaaagtgcgttacgtacatcaagattttattcaaaatccagcgtctcctccgcaaaaaagttcagaatacatttgaatgagtcctctggattctccaacagtaaattatgcccagtattaaattctcggacatcagcacagggaaagttatacctcaggagggaataatcattgttaataaagttagactgcaggcctttcatgaataaaactttacgactggctgtgcctttttggaagaagtccctttggttcgatagatccggccattttttcacttcatccaacaggttcggcatgctggagagaggcattgagtaatttatataaggatcatgctgttgttgttcatagtgtaactgtgcttggtgtacattattggattttacagaaagaaaaccgttggcaaagtagagtgccacagctccaccacatttcctcttattacattccaaacttttgaaaagctcaagaacttttttctgccagctgggggaacctcttaaaatcttgacatctctgcggataatccgcattattaagtcatagttttgtaatatcatgggatctaattctggggtttcataaggcggtaaatcaattgatatacactttcgtatattaatattcttgtacaatgtggttaataatgcaattttaccacccatagagaatcccagtaaataaataggtctctccaagccaatatgagtttcaataaaataaatcaaatcattggtcagtgtagtgtagtcataaggtattgcttttggtgaaatgccatgatttcttacatcaacagaaaaaatatccgcgtcaagcttccttgaaagaagcttattgagagaatgaaacatcacgtgtgagcccaaaaggccatggatgttaataattgcaggtctttgctcgaattttattagcgatgaaacatctgagggtaaacgcgttctatggaatgataaatcgacaattattttataaggtagcgctttattatgcgctagtctcgacatttgtaagccctcttcccacggttccttttattttgcagtttgtatacgtctcgaccttggcatgagacaaaaacagtttccccaaaagacgcgctgtggtattcagtaaaggctggtttctatgataggttgagtttagaataatttttaaacaggatactaagataaagcaaatatttcaatcatgtccagattaagaagattcaatagaaagatcttaagcttgagttctgactacactcatgacggtgaatctgatcaagaagatgtatccatattaccattagatacagaagagcaggaagaactcatacaaaaatttgagactaatgctcacatcacaaataagctgtacataaacctgttaagcatattgtatttgctatatggcggactgctaatgatactcgtaagaaaatcgcgagggtatattaagttagcacttcttgctggcgctaattctttgatctgttcgtgcatcacacttagatatgatattgtaaacgactatcttttgttcaaaaagtttaagttaagagtgagcaatttttctattaacataataaacattattttactagtacttatggcttggataagtttcaatcatgtggtcgaagataaaaaaacggtgctctgtttgcaagttccaatgtttttattctgggtcgctgtgcttgtgaaaagatgggctcgaaatatcgaagatgaaatcgcagatctaagatgcttgaaatacaaatacaaaaatgcttagttctatatcgcgacgtattgtaatattcattggttagtatattccggaatatttattactaatattacaaattgattggttggcagctccttatttgtgaacaaggccaaaaagtactgctacgagcttattcaagcatacatatatatagctttaattccaaaatcatcgtcacaggaatctgctttaaaatccagtaaaagactaacctagtcaaaggggacatagaatagcttacaagaggattcagtttggagctaacactttcttcggaactttccagcttcgtacaaaagtgcagatacgttaaaagatcagtttatccgtatgttttgaaaaggctatctagtgcagaagtctctaatttcaatataatagcttgctaaatagtcttcgaggcgttgcatatctatcaagaaaacaacatgaccaatgtacctagaattataattaagtagatgatgccaatgaggtgagcgagcaaaaccatgtcaattggatagtatgaataaaccgccattaatcattggtgacacgcctgttatgtctttctaaggtacataaaatacagcagtgataatgtcgattacgtccaagaggaatgtttagcaatattgccgtcacattaacaatactaatcttctcgttgcggtccattcatttccgcggagtttactgtcgaaaggttttttttttttccgcagcatttggaaaacaattgatgtgagtaatttagaacaaaatatacggcagtaatctcccaaatttgcgatactaccacaattcaagatcgtgcgcgagagtaagtcgagcacggtgctgtatattttcatacattatacattcgaggacctttcaccaaacaagaggaacttagctgatactaaacgaagattagaaaaagagcaaaaaaaaacaaaaaaagaaccaccgaaacattaaaagtgggaataatgtcgcatcaaatggcgccatggatacccatgtttattcaatcgtgcaaaaataacactgaaccgtttgtatcatttcaatttgctactgttgacgaactaacgaacaaaccacgttgtagaacggtagtgttcagagattttttatttcatgacaaaagaactaatgtgttgacttttaacactgatatgaggagctcaaagataactgaatcatttataactccaaattcaaataactctagcgacagcaaaagatgtgagactccatttttcgaagcatgtttctatttcccggaaacttgggagcagtatcgcttcagtggccaatgctttacaatatctaaacaatttaagaaaataccggctgagattgtaaccaagtatgacatattttcaccgcggttttcagagacaaatgatgacagcactgacgaagaaatagatactccaattaacgacgacgacgacgacgataaaaataatgacgccgacaataatgacattaacgaagataacaaacttatagaatccatagagaacgatgaacaccatgaggatgaagacgactactaccctcaaccacaagaatgggaggctgaattactaagacaatggtcctctctatcaaggcataccaagtcattgtataggaagccagccccgggccagaaacttacctctgaaactagcaaacaactggacaaactccatagaggagttgacggtgctaaagaggacgctggactggaaaactttggtattgtctgtctttgtgttgattctgttgattttttgaacttgaaagagggaagaggtggtgaaagatggattttccagaaaaccgacggcaaagacgaagatctgtgggaggaacaagaagtgtgtccgtgagaaatgtcaatcattattgctaacgttcgcgatggttaatgctttgtattcgcgctatctcgatttctacctatatagttaatctctgtacaaaaacaatctttccaactatccattaatcatagtatattatcagcgtcggcgattttaccacgcttgacaaaagccgcgggcgggattcctgtgggtagtggcaccggcagttaatctaatcaaaggcgcttgaaggaagagatagataatagaacaaagcaatcgccgctttggacggcaaatatgtttatccattggtgcggtgattggatatgatttgtctccagtagtataagcaagcgccagatctgtttactgtaaaattaagtgagtaatctcgcgggatgtaatgatttaagggaatctggttcaggttttcacatatatttgtatataaggccatttgtaatttcaatagttttaggatttttccttctcccaaaatactcacttactgtgttacattacagaaagaacagacaagaaaccgtcaataagaaatataactaagaacaatgtctatttgtgaacaatactacccagaagagccaaccaaaccaactgttaagaccgagtccattcctggtcctgaatcccagaagcagttaaaggaactgggtgaagtttttgacacaagaccagcatattttttggctgattatgagaaatctttaggtaactatatcactgatgtggatgggaacacatatttggatttgtatgcccaaatctcttcaattgcacttggttataacaaccctgctttgatcaaggcagcacaatcaccagaaatgatccgtgctttggtcgaccgtcctgccttaggtaacttcccatctaaggatttagacaagatattgaagcaaatattgaaatctgcgccaaagggtcaagatcacgtctggtcagggctttccggtgcagatgccaatgaattagcgttcaaggctgcctttatttattaccgtgccaaacaaaggggctatgatgccgatttttctgaaaaggaaaacttgtctgtcatggacaatgacgcccctggcgcccctcatcttgccgtactatcgttcaagagagcgttccacggtagattgtttgcctccggttccacaacttgttctaaaccaattcacaagttggatttcccagccttccactggcctcatgctgagtatccatcttaccaatacccattagatgaaaattctgatgcaaaccgtaaagaggatgaccattgcttggccattgttgaagaattaatcaaaacctggtctattccagttgctgccttaatcatcgaaccaattcaatctgagggaggtgataaccacgcttctaagtatttcttacaaaagctaagagacattaccttgaagtataacgttgtctacatcatagatgaagtgcaaacaggtgtcggagccaccggtaagctatggtgtcatgagtacgccgatattcaaccacctgtggatttagtgaccttttccaagaaattccaaagtgcaggatatttcttccacgaccctaaattcattccaaacaaaccatacagacaattcaacacatggtgtggtgaacctgcaagaatgatcattgcaggtgccattggacaggaaatctccgacaagaagttgactgaacaatgttcaagagtaggtgattatttgttcaagaaattggagggtttgcagaagaaataccctgaaaactttcaaaacttgagaggtaaaggaagaggcacattcattgcctgggatttgcctactggtgagaagagagacttactattgaagaaattgaagttgaatggttgcaacgttggtggatgtgcagtccatgcagtgagattaagaccttcattaacattcgaggagaagcatgctgatatctttattgaagcattagccaaatcagttaatgaattatgattgtatattagcgaggccgtgtcacgttcccttttttggtctttatatatgtgtatcttgttataattttaaagaaaagttttatattactcatcagttgtgtgtgaaaaatatgggcgggtattcacaataggaaaaaaaaaatgggtttggtgactgcagtaaagacgtgctaaaaaaaaaaaagttgtttttatctgaaccttaaatatatcatttatgagtgtatatattatacaaacgcaataacagtggctcccgccctccacctccgcctgctactagtaatctaccagtaattgtgtttgttttgggaaagatcgttcgcttactcaccgaacaactttctgactctcttcaatacagagtccttttcagggtcgtagggatgatctttagatggaatttctaaaatagcagggaacgcattggtgaaggagtccactctagctcttatgttttccgcgatatgttggttgattagaaggatggcaatatcgtctctctcttcagtaaagtgattaaacttgtcagtgatttcctccttagtagtcttaccttcttggtaaacaaaaaagttcttttcttgggtttcaggagtgatttgtccaatcccggctaacaataaaccagttgtagtatcttcgtcagctatcacagctataagagtacgtttctcagccatgatttagttactatgcgtcagtgagactagctatgaatatagaaatgtagtgctctattttcttaattctttgtcaactcgatataataaatgtagtgcttgcaattcacgttggttttcctgttatcgttcgcctttattttttttttttctttcgttttcctacttccctttaccggcgtaagcgcagtgaaatttttttagtacgcacgtacgcaagtttcagcagcaataaggggaaagatgatgataataactaagaaaaacagcaaacttggtatgaacgcatcaaaaattggaaaatgttggtaagaaataggtatctgggtgaactgctcaaaaactctcgatcgtttagtgtgctgaattcctcggtacgttcaggtcacaacaaatggtcaaccatcaagcacggtaaagccaagaatgatgcggaacgaaacaaaattaataacaagtttgcaaaccagatagcaatgtcagtcaagttaggcaacggtattacggatccgagcatgaatataagattagccaccagcatcgagctagcaaataaaaacaatgtcagcaaaaaagttattgagaacgccatccggaaagcttctggaagcagcgcatcgggcaaggactcaaacgcttctgagctatgtgtatacgagggaatggggcccggcggggtcgctatagtggtggaagcgctgacagacaacaagaacaggaccataggtctgataaggagtgcatttaataaagctaatggatcgatgactccaacgttgtttttcttcgacaaaaaaggatacgttacaatggtacctccgaagatgttagacactgaggacaaggtgctagaaagcgtactggagattcaaggcatcgaagacattgcgcctgtgcaggaagacgcagaagatttagagtgtgataccgaaactgaaactacaggccaaacttacgaggcggtgatggaacctgccgataccaataaggtggccgccctactgaaggagcgtggtttccacatcagagacttgggcatcggctacaatgccaagccggatatggaagttttcgtgcaaggcgatgaaacgctcgagaaactacagaaactgaccacagcgctcgaggacatcgacgaagtgacgtcgttgtacactaacgctagcaacgcttaatccaaccaaaccgtaaataaataatcaataccacaaatacctgtatatactaaacaaacagtagtaataactgtaataaagagtaaaaacaacaacaaagacaatcgtacgtaaaaacaccaagcggacaccagcacttgcctgctgcggactgttgtctgcggactggcgggggtcgagcaagaaccgacgaagtaaccgacggaaggcgggcggagacggagacgcagccgagatctatttttactcagcggtaatattagatcatggctagggggatctggaagtacaatgatgtgctctccccctctcaaacacaacaccaggatgaactaagggctcatctcgaaagtcgaaggtgcctcattcaggttattagtggtgcctgttgtgtcttccatgaacaaggagcacttaattacttgttgttgcatgagatatcatttttttttttccctctttcttggggtcttgacagtcatcaaatcgaagtttttagtttttcttcttcgggaagatcaattttaggtagaaaagtgtagatgaaaaacgaaggatactgctatttactgtaagtactcttcggtccatattggaagaccaaggcataataaggatatattccgaggagataattgggatataatcctccattgcttccgaaatttgtttaaacacttctagttcatttcgggttggttcgatcttcgtttccacttttaacttactcccagttagtataatataagtagttaaggtatggcaagctgcaatccgaccaggaagaagagctctgcttcaagcctatctatgtggagaacgattctcatggcgttaacaacactaccgctaagtgttctttcgcaggagttggttccagctaatagcacaacatcgagcacagctccttccatcacttcgctttccgcagttgagtcatttacgtccagtaccgatgcaacgagcagcgcaagtttatcaacgccgagtatagcttcagtatcctttacttccttcccacaaagttcttcactgcttactctttcgtcaacattatcctcagaactttcctcttcgtccatgcaagtttcgtcgtcttcaacatcgtcgtcttcttcggaggttacgtcatcatcgtcatcatcatcaatatctccttcctcttcatcatcaacaataatatcatcgtcatcatcactgccgacattcactgtggcatcaacatcttcgacagttgcctcctccacactttccactagctcatcgttggttatctctacgtcttcgtcaacgtttacgtttagttcggaaagttcaagctctttgatttcctcttcaatttcaacatccgtttcgacttcttcagtgtacgttccctcctcttcaacttcatctccaccttcgtcctcatccgaattgacatcatcctcgtactcatcatcctcatcctcatccaccctcttttcctactcctcctcattttcatcatcctcatcctcatcatcctcatcatcatcctcatcctcatcatcatcatcatcatcatcatcatatttcaccctctccacatcttcctcttcatccatatactcgtcttcgtcatatccttcattttcatcttcatcttcctcaaaccctacctcatcaatcacttctacatccgcctcatcttctattactcccgcttccgaatattccaatttggcaaaaaccataactagtataatagaaggccagaccatcctctctaactactataccacaataacgtattcaccgacagcatccgcatcttcaggaaaaaattcacatcactcaggcttatcaaaaaagaatcgtaatattatcatcggttgtgtggttggcataggtgcccccctcatcctaattctactaatattgatttacatgttttgtgttcagcctaaaaaaacggatttcattgactctgacggtaaaattgtcacagcttatcgtagtaacattttcaccaaaatatggtatttcttgctgggtaaaaaaattggtgaaacagaaagattcagctcagattcccccatcggcagcaataatattcagaattttggtgatatcgatccagaagatatacttaacaatgacaacccctacacccctaaacacactaatgttgaaggctacgacgacgacgacgacgacgacgctaatgatgaaaacctatcatccaacttccataacagaggcatagatgatcaatactcacctactaaatctgcatcatattcaatgtcgaatagtaatagtcaagattacaacgacgcagatgaagtaatgcacgatgaaaacattcatcgtgtttatgatgacagcgaagctagcatcgacgagaactattacacgaaaccaaacaacggcttaaatatcacgaactattaaatcatagcgaaagcagctttgccataacttttcttcttaaaatcaccctcggtcatttcgttcttctttttccgattcaattcctaataatttatgcatattacagaacttttttttccctttttctgtcacaggtttcccaatttttttgacgactaaataataacataaccactacgttcacttccccgtatatatacatatatacttaatattataaacgcatatacttttataaacttggaataagtattatatatttattttgaccatccggaaatgctttattttacacttggaaagaaaagtgcatttggaaaacttttacatgtcacccaagtgcatactgctgacgatacaggtttagagactaaagagagcgcatggaagaaaacttcaaaggaagagaagaaggatcgcagagttcaaaggaactcttaatttgggcccatcttttgaaaatattgtctctgcaaaagcttcgaacaccattttggatcctctggagaaggcaagacagaatgcagaggaagctaagaaattaccttgttagcttaaggttcctgttcctaagggtagcggtcaccacaaatggaaaagcgactttcccaatgtaattatttttgtttgttccgcaagtatctaacaatatgatatattgctagttgaaaatcgaacactcgagttacttccgtgatagtttaatggtcagaatgggcgcttgtcgcgtgccagatcggggttcaattccccgtcgcggagatattttttatcatcacaaaaataagatagcaaaactgaagaaacgatgagttagttttaacttttaaaagatcgtccaatattaacataaaggaacccagttctttggaaataacaggaaagtgcagaaagttcattagaaatcaacgatgatctgatatacatatatatatatatatatatatatatatataaaggttattaatagccttcgaacaactcatctatctgtgcgatgacgttaatatgaagtatttctccttttcttgttactagtgaaccctttttaaacatttcaggttcattattgtagtttatcccacattcagaaaatagtatttcctgtttctcattactaaatgttccacatagtttcttctcggattcctggggagttaagccacactttattattaactgccaaaacgtcgtattataaagattgtttatatgtgtatcgacatatctccaggataaataatcttttatcgtttgtaaattagggtatgctacacaccttgaatcgaaatatggcaaatgcttgatattcaacggcttttctgggaaaaacttggcccataatgcgacgtaattggacgtgaaaaaagaaccaaataaagtcgcaagcttgtctttccttctgttaaataaagttgtacttgacttcaaaataaatgagtattcgtcactctccccgaacgccaatataatatcatttttgtacttgaggacaaggttcttagcacatgcattcattaacttcaaagcattttcatcgtttggcttggcaaactcgtagaacttggaaaattcatgaaacttcttgccgtctattcttaccacaatataacactgaggcaaaataacatcgtgtgtttcaaattgccttacgtatccaaatttagagtttgccatcccgctcgcattaggaagtagaatctttgaacattaaggcacatgactggctatgagccctttaagtttttctctatccgcatgtcttcaattaattctccatcagtgatttttaaaacaataaaaactttcaatccgggtaaaactgaagaatatagagcgaaaaaagcgtatgtgcaggacaagggatacttacgccaaaaaagaccatgtccattttattataggatacccacttgcacggcgtcaaagtactcaattggctgtgcttcttcaaaaaaactaacatacacaagaaccaaatttaaattcaacttggttacccaaagagagaattcattatagaaagatataaaaattttgtagaaaaaaaacaacaacgttggaaatggcgaagactatcaaagttatcaggaagaaggaccccaaaaagaagaacctatccgatcctttagcaaaacaaaaactagtttggaaaatcggacacgttttaactttagtttttggtttattattttctatcacgtatttctaccatgtcctaatcttcttcaaatatcgttcctggaagtggttgttcttaagggtcaataaaaattactcgtttattcaaagtaagagatggtacatgaaacttttgagttggagcccacaggtaatgtaccgtttgtcattaattggcgtatttatgtctgagtccgtcacaatgcaacagaactgggttggacttaaccctacttggaatgaccttttgtcctctgagaactttcatacccttttgattgcctgtttatggttctttggtggtggtaagtctttttacaagattttgccttacatgattttaagttatctacacctaactaaaatgaactacgaattgaatgctaacaaagaagaaaagatccctttaacacccaaagacagaaaaatgctacacttacttgcgtactctgaattacttgttatcttagcgctaacactagacactatattgtttaagacgggtacatccggatttatgctcgtcatttatgttggtatttattggttgaggttgaacttctctccatacgcacaagtggctgttttggagttacttgtcaagtttgaaaaatacgtccccaaaaaatatagagacaaatggcaggttataaagaactttatttatatgaaaatgaaggagcacgaaaagagaacagaagaagttgccagatacgcgtaagaaattctctaacttaagatgaccagatgtcatgttcgtttacttattttcctctcctcttaccttttttggccactaacgctcgtacagaaatggacggcatacatacaatttaatcaattctcttaaataccgttttatacctcatttctgacttttcagccgttaatgttccttttttttttagactattgtatgtatcacttcctgaatgatgtcttccataacacaaacgtgacgtgcaaataaacatacataaaaatattattgaaaatacagattatttaaaattatataacccgttccctgtttattcagaagcagtagctctggtgtagatagcttgcttggagtgcttggagattggcttgatgataccttccttttccaagtgtctcaaagcaattctagctaaagaaccaccaatctttaatctgtcgaccaaaacagagacagaaacgtatctgtaagttggaacttccttcaagattctgtcgtacttctcttggtctaaaatgacagcgtgttgagctctgtctttcatggactttttggaccacttcttcttagacttcttaccaccagcaagggcagcagcggctttggcagctttagataattgttgctttggaggcatgatttattaaatgttctatgataaagtaaaaagtaaaaacatacttgttagtaaaaaaccgaactctagtagaatttgggataaagactatttgctaatgacttgaattgtagattgaatttaactgtaaatcaccactaagtacgtagtttccttctctcaaagtaccatgggtagctagatctgtgctatggagcatataacagagacatggatattcatcccattaaggtagaacaggcttttatgacatattaaatcctggattggccagtcactatttcatcttatccgcctaatattggtttcaaatttatagatacatacactaaaactaacagggcttgacggttttcgataacaaagaatacgatttcaatattcaactgagcaatcttaatagtattaaatgcttcgtgaactttaagagatacttcgtgaagttgttctgtcgcacaattcttcctgtagaaggcgtccttcgtttttttgtcttcgcgcgttacagggtaaatgaacctctttatgggtgaatgggttacacaaatgcacggatgcatatataaaatatagaattttgctttatattattttgagcgggctagaatccactcagtgtacaaagtactattcattatattgaactgaagaggcaagaactatttagctcaatcaaccaccttaataaagtatttggagtgatatatcggcttgttttagtttaattcttgtggatatttagatatcaaggttgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtatattctgtatacctaatattatagcctttatcaacaatggaatcccaacaattatctcaacattcccccatttttcaaaggtaatttttggaattccttgcaaagctgtaattaggtatacaaaatacactagatactctactcgacgatatagtaatcctcataagggaatcggtatttctaatattacgttatttttattttcttttactgttttctatgttgtagttcataattccataacattattaatcctagtgcttcagcttccattgaatctgatgactttttctctgttggaataaaaatccactatcgtctatcaactaatagttatattatcaatatattatcatatacggtgttaagatgatgacataagttatgagaagctgtcatcgaagttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacatatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaaactgctcagtcacattcaccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtacaatatggagacttttactgggtatctaaaaggtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattgcacgaccgtcgcgaggactctatcctcgatgtatttaccacgatactagctttcattaaaaaccaatttcaggccagtgtcttggttatacaaatggaccgtggttctgagtatactaacagaactctccataaattccttgaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgatacaacaatgtggtatggaagaagttcgtggatggtcatgcgtatttaaaaacagtcaagtgacaatttgtttattcgtagatgatatggtattgtttagcaaaaatctaaattcaaacaaaagaattatagacaagcttaagatgcaatacgacaccaagattataaatctaggcgaaagtgatgaggaaattcaatatgacattcttggcttggaaatcaaataccaaagaggtaaatacatgaaattgggtatggaaaactcattaactgaaaaaatacccaaactaaacgtacctttgaacccaaaaggaaggaaacttagcgctccaggtcaaccaggtctatatatagaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggcaaccaaccgtattataaatcacaaattggcaacatatatttacttaatggaaaggtaattggaggaaagtccaccaaggcttcattaacatgtacttcaactacggaagcagaaatacacgcgataagtgaatctgtcccattattaaataatctaagttacctgatacaagaacttgacaagaaaccaattaccaaaggattactaaccgacagtaaatctacaatcagtataattatatccaataatgaagagaaatttaggaacagattttttggtactaaagcaatgagattgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacatatttctcattctcaatcttcatggtatcttttttacaccgtatatgataaaatacaagtaatataaataccagccactggatgacattgaaattttattctaataaatgcatcagctctttaaaaacattgctatttagctatttgaagccagaaattttcacagattaccatccgatatagtgtaacggctatcacatcacgctttcaccgtggagaccggggttcgactccccgtatcggagtgttctttttcttacctcttgaaaaagaggtagtaaagtcaatataaattcttggctgaagtatttcaatacaattggtcaaggaagttattatttttttaatgacttatatctgtccaacacaacaggttacaccatataatctctatttactggacaggcggaaatcgatagtttagctttcctaaaaatcgttatattatagaagcgtcttgacacgttttcaaaaaaggaagaagcaagaacgaaaagagataaggattcaaaagaaaggaagcccaatgtctcgcaaatttgatttaaaaacgattactgatctttccgtcctagttgggactggcatatcattatactacctggtcagtcggctactcaacgatgttgaatcaggaccgttatcaggtaaatcaagggaatcaaaggccaaacagtccttgcaatgggaaaagctggtgaaaagatcaccggcattggcagaagtaacattagatgcatatgaaaggactatattatcttctatcgttacgccagatgaaataaatattacattccaggatattggtggcttagacccgcttatttcagatctacatgaaagtgtcatatatcccttgatgatgccagaagtatattctaatagccctttacttcaagcacctagcggtgtcttgctatatgggccaccaggatgtggtaaaaccatgttggcgaaggccctagccaaggaaagtggtgctaattttatctcaataagaatgtcatctataatggataaatggtatggtgaatctaacaaaatagtcgatgcaatgttttcattggcgaacaagttacaaccttgtataatattcattgacgaaattgattcattccttagagaacggtcttctacagatcatgaagttacggcaaccttaaaagctgaattcatgactttatgggatggcttattgaataatggaagggttatgattatcggtgctactaatcggataaatgacatagatgatgcgtttttgaggaggttaccaaaaaggtttcttgtttcattgcctggttctgatcaacgttacaaaatattaagtgttttattaaaagacactaaactagacgaagacgaattcgacttgcaactgattgcagacaataccaaaggattttctgggtcggacctgaaagagctttgcagagaagcggccttagatgcagcaaaggaatacataaaacagaagaggcagctcattgatagtggtacaatcgatgttaatgatacttcttccttgaagataagaccattaaagacaaaagattttacaaaaaaattaagaatggatgctacaagtacgttgtcatctcaacctcttgattaaggaaggaaaattagaaaaaaaagaagaaagctttttattcacgcatcatatcatatcagataagctagttttcacataatatgtgtatatgcagtatactcctgtacataacttcctttatttctgctttataattatatactagttatttttcttgggccgcttttattacggcaactattctatcaggtttagtcataatctaaatctaaagatggggaaaagccaaaaacactcaactttcaatgaatacaaagcttcatgaaagcaatagataaaatgacggataatccaccacaagaaggcttaagtgggaggaaaataatatatgacgaagatggcaaaccgtatgttggattacgcaaagcaattcaggatctactgatccaatcaagcttgtgattttttattaacaaattctctataatagttgccgatcatgtaacaccctacttgactttcagtacgtgaccgggaagatatctaatggcctgaagaacctctcatctaacggtaaactagcaggtacgggggctctcactggcgaagcttcagagttgatgcctggctcaagaacatacaggaaggttgaccctcctgacgtagagcaactaggtagatcttcatggacgctgttacactctgtagctgccagctatcctgctcaacctacagaccaacagaagggtgaaatgaaacagttcttgaatatcttctcacatatttatccttgcaactggtgtgctaaagactttgaaaaatatatcagagaaaatgcaccacaagttgagtcaagagaagaacttgggaggtggatgtgtgaagcccacaataaagtcaataagaaattgaggaagcccaaatttgactgtaatttctgggaaaaaagatggaaggacggctgggacgaataagtacaatctcagaattctgaaggaacacataaaagacaatttatacatatttacagattctcgtgtatataacactccaatcgtattgatcagtcatatgttggcttttttatttaggcttgagctctaactttccagatgaatgacttttctactaatatatgttaggattaatagttttatatgtataaaaatatttagtcagtatttagctaaaaagtttactttcaaagaattgtcatgtttgcagctagtgcctctggtcttttgagtattcccagcccttgtttagaggtcatcaagaatgaacttgaaattagccgtatcagtggtattaacctcttctaagaagagcagaaaaagaaaaaaatctccgcgacggggaattgaaccccgatctggcacgcgacaagcgcccattctgaccattaaactatcacggaagaaatatctgtgaaatgtgactcttatagcatactattttagttatgaattgtgaaaatcctccctgtcctgcgttctacaatttatttagtacttgtttggcaaaaacgtctctcagtgccatttactttgtaaaaagtgcagactacatcgcatcaacggtcatattaggagccacttctatttttaactcaacatgatcattcaaaaatgtcgatacacttgcattttattgtacatactagttggaagaggcagcgtcgattttgctgaaatttctagtaacttgtagcagcaatacattatatcataaaaataacctgacttgtaaaagttgaaaccctaacttttattatttctttcaatatttttcgattagacgtgaaagatgaccaagcacaactaacaaaaaatttgcatcctcataaaaagcaagactttttgtatgtcgaaacaaaattattaaaaaacacgcattaacacagacacgaatttggcatactttcattttactttatatctagtgaaaagtagaaattgtttaagggaactacttcacagtgaccactgatactagaatatggaaataagaaaagttgctaagtaggagcctaacaatctttttttatatttttccatattcctttattgtcatgggtcaagactgtatatgttagtgaaagttttagggttcttgtgacaaacttcaccaacataaacatggcctcttcgaagatccgtagattttgcatttttgcggtggtttatggattcaaagcgaggcctaaattaacgatcatgtctttgctattatatcagagggcatatcattgaatttccgatttccaaagggaagaaaataaataaagttgtgctatttccatgcatccttttttctttcattcaatgacacatacttcttgtagtaggaacaattggtagttctgatatcgattaagccttctaaaaatgctttatattataaagtacaaatgcaagaagtagctatggatgctaaagagctggtcgatttattgtttggtgaatgaatgtaggtttaaatcaatgatctctgaatcagaaacaagggtgaccaaaattggaaccttgagcctttcttcctgtagttcatttctgccttctctttttatatcgaacgatgttaatttattccactgataaattttcttattgttcttaatataaccctttttaaatatttccaaaatacttaacattttttgaatatgtggaccgtaagagaatatacaaactacttgttgtagacccaaacttctatctgccatgttgatttgtttatctaacttatttacagacttcttaatgttatcgttcttcgatatgccatgatactgtattgatgtactgttgttaccattatttgctaaggacggtataactgtttctttgagaaaccgaagacattgagtggaggaagagatatccaaatctctactaatttcattgtaatatacgccattgatcattttgatttgcttttatctttttttcttcttcttcttttcaatctcttccaaacaatcttggcctcatcttcatggaatttttcgaaatactcatcagcaagtgtccgatgccttctcaattttttccaagagcgtgcgggggttggttatccagtacatgtgttgcttgaaactgccaacaaaaaagaaaagaaaataagaatatattagtacgccaatagtaaacgtcaccccgaggtttaaaaactaaccgtgatatacgaggagaattggtaacggtacaatgatgatactgggtaaagccgggatcctggcacagtatgggacaatatatgtgagacaaaataccattcggaataatttaagttcctgcatttttaagcagtcactatgtgcctttcattcattagcaaaggtgctgcaacaaaagcaagtcccactggacctttcatatgacataatcaagagagatgcagtaaaaactggggatgaagggaagccaagaccacctattatcatacttcacggcttattcggtaacaagctcaacaaccgaagcattggccgtaaccttaacaagaaattgggaagagacgtgtatctgctggacctaagaaatcatggatcctcaccacacagttcagtccataactacgaagtcatgtcggaagacgtgaaacactttatcacaaagcacgaattaaacaccaatggaggccctattataataggacactcaatgggtggtaaagttgccatgatgctggtcctgaaaaacccgcaactttgttcgatgttagtctgtatagagaacgctccggtgagtttgcgccctaacgctgagtttgtcgaatacatcaaagcgctgatggaaatcgtcaacgacaagggcaaaactatccgcacgctgaaacaggctgatgaacaccttgcagagaggatcggcggcaatgagctagtaaggcggtttctcctaacggcgctgaaaaaggtcaagatggacaattcatcgtctgtgtcgtcatatacattcgaagaacgaattcccctcgcaacactgaaagatgccattgtcaaaggtgaaattgccgcgtggcccctagatcctgctcgtgaacgatggacgcggcctgcgctattcatcagggctactcaatcgcattatgtggtagacgagtatcttccgatcatcggcgcgttctttccacgctttgaaacacgtgacatcgatgcgggtcactgggtaaatgcggagaagcctggggaatgtgccgaaagcatcgtcgattttgtggagcggcacgaggattaaaggcaagcgccccggagcaaggtgccagtagcaccagtcggtggctgtgcgcttgccgtagcacatgacatacggactattgtgtgagtggtgatggggtgtaggcagtgccacaccagtttaaaggcctagtaacggcaaatcgccaaaagagatgatgctgatgcatacgataagatcgtcagtttcacgttcgcggttcgaacatggaattgtggctaaagaaatttgggcggtatgatgcaaatgaggtgtacgtatgtatatatagcaaagagtagaataaaatgagataaagcctcgttcgttctctccatttcttccctgtttctcctttattttctctactgcttatttcgagttcaccagagaacaagagagcaggaacgcaaagagtgtgtgacacgaaattcaagatacaaaaataaaagcttacgttgtgtatttcaactggtgtgctaagaatagagtttcataaagtactgcatttattcatatattatttttgttatttgtatatatacttcacacttagagttctactaaaagtctacccagcacgcatccttcgtttatttttacatctctcttttgcttttcctttttttttttggtgcttgctagatactactgaagatcaaaggttacaaagaacgccgcatatattttctgcaggcatattaaagaagttacaaaaggattaatcgaagcgctgtttggatacactcctgtaaagagaagaaaaggaaaaaaataaaaagtggacaataaataattattaaactgtcatagttatgtcctacaacgatccaaacttgaatggacagtattacagtaacggtgatgggactggtgacggtaattaccctacgtaccaagtgacacaggatcaaagtgcgtacgatgagtacggtcagccaatctatacacaaaaccaactggatgatggttattatgatccaaacgaacaatacgttgacggtacacaatttcctcagggacaagatccttcacaagaccaaggtccttataataacgatgctagttactataaccaaccccccaatatgatgaacccgtcttctcaagatggagagaacttctcagattttagcagctatggtcccccatccggcacttatcctaacgatcaatatactccttctcaaatgagttatcctgatcaagatggttcttcaggggcctcaaccccctatggaaatggtgtcgttaatggtaatggccagtactacgaccctaatgctattgaaatggctttaccaaatgatccatatcccgcatggaccgcagatccccagtctcccctgcccatcgaacaaatcgaagatatcttcatagatttaacaaataaattcggttttcagagagattccatgagaaatatgtttgaccattttatgacccttttggactctagatcttctaggatgtctccagaacaggcccttttatcattacatgcagactacataggtggagatacggccaactacaaaaaatggtactttgccgctcaacttgatatggatgatgaaattggtttcaggaatatgaagttgggtaagctatcaagaaaggcaagaaaggctaagaagaaaaataaaaaagccatgcaagaggctagtcctgaagacactgaggagactttaaatcaaattgagggtgataactcattagaagctgcggattttagatggaagtcaaagatgaatcaactttctccatttgaaatggttcgtcaaattgccttgtttttattatgttggggcgaggcaaatcaagtcagatttaccccggagtgtctttgtttcatttataaatgcgcctctgattacttagattctgcacaatgtcaacaacgtcctgatcccttgcctgaaggtgattttttgaatagagttattactcctctttatcgttttattaggagccaggtttacgaaatcgtggatggtcgatacgtgaagagtgaaaaagatcataacaaagttattgggtatgatgatgtcaatcaattattctggtatccagaaggtatagcaaaaattgtcatggaagatggaaccaggttgattgatttgccagcagaggagcgttatttgaaattgggagaaattccctgggatgatgtcttctttaaaacttacaaagaaacacgttcctggttacatttagttaccaacttcaatcgtatttggatcatgcacatctcagtatattggatgtattgtgcttacaatgctccaactttttatactcacaactatcaacaattggtcgacaatcagcctttggcagcttataaatgggccactgcagcattaggtggtactgtggcaagtttgattcaagttgccgctactttgtgcgagtggtcattcgttcctagaaaatgggcgggtgctcaacatttgtcccgtagattctggttcttgtgtgtcattatgggtattaatttggggcctgtgatatttgttttcgcttatgataaggacacagtatattctactgccgctcatgtcgttggagcagttatgttttttgttgctgtggcaacacttgttttcttttccgtaatgccattgggtggattatttacatcgtatatgaaaaagtccacaagaagttatgttgcctcacagaccttcaccgcatcttttgctccattgcatggtttagacaggtggatgtcttatttggtttgggtaaccgtttttgctgctaaatatgcagagtcatatttttttctaatactgtcactaagagatccaattaggattttatctactacatcaatgagatgtactggtgaatactggtggggtaataagatttgtaaggtccagccaaagattgttttaggtttaatgattgcgactgacttcattttgttctttttggatacctacttgtggtatatcgttgttaacactgttttctcggtcggaaaatcgttctatttgggtatttctatcttaactccatggagaaatattttcactagattgccaaaaagaatttattctaagatcttggctactactgatatggaaataaaatataaaccgaaagtactaatttctcagatttggaatgctatcattatctccatgtacagagaacatttattagccatagaccatgtacaaaaattgttatatcatcaggttccgtccgaaattgaaggtaagaggactttgagagcaccaactttctttgtttcccaagatgacaataattttgagactgaatttttccctagagattcagaagctgagcgccgtatttcattttttgcccaatctctatccactccaattccagaaccactaccagttgacaacatgccaacatttactgtattaactccccattacgccgagaggattctattatcattgagagaaattattcgtgaagatgatcaattttcaagagttactcttttggaatacctgaagcaattacacccggtagaatgggactgttttgttaaggatacgaaaattcttgctgaagaaacggccgcatatgaaaacaatgaagatgaacctgaaaaggaagacgctctgaaatctcaaattgatgatttacctttctattgtattggtttcaaatctgctgcaccagaatacaccttacgtacgagaatctgggcctctttaaggtcgcaaactttgtatcgcacaatctcggggtttatgaattattcgagggccataaaattactttatcgtgtggaaaatccagaaatcgttcaaatgttcggtggtaatgctgatggattagaaagagaactggaaaaaatggcaaggcgaaaattcaaattcttggtttcgatgcaaagattggccaagtttaaaccacatgaactagaaaatgctgagttcctgttgagagcttatccggacttgcaaattgcctacctggatgaagaacctcccttaaacgaaggcgaagagccaagaatttactcggccttaattgatggtcattgtgagattttagagaatggtcgtagacgtcccaaatttagagttcaactatccggtaatccaattcttggtgatggtaaatcagataatcaaaatcatgctttgattttttacagaggtgagtatattcaattgattgatgctaatcaagacaattacttggaagagtgtttgaaaatcaggtctgtcttagcagaatttgaagaattgggaattgagcaaattcatccttatactcctggtttaaaatatgaggaccaatccacaaatcatcctgttgcaattgtcggcgctagagaatatattttctcagaaaactctggtgttcttggtgatgtagcggctggtaaagaacaaacttttggtacattatttgcccgtactttggcacagattggtggtaaattgcattatggtcatccagattttattaatgcgacattcatgactactaggggtggtgtttccaaagcacaaaagggtctacatttaaatgaagatatttatgccggtatgaatgccgtacttcggggtggtcgtatcaagcattgcgaatattatcagtgtggtaaaggtagagatttaggttttggtacaattttgaatttcactactaagatcggtgctggtatgggtgaacaaatgttatctcgtgaatactattatttgggtacgcaattacctattgaccgttttttaacattttattatgcgcatccagggtttcacttgaataacttatttattcaattgtctctgcagatgttcatgttaactttagtgaacttgcatgctttggctcatgaatccattctgtgtgtttacgatagggataagccaattactgatgttttgtatccaattggttgttacaactttcatcctgcgattgattgggtgagacgttatacactctctattttcatcgtcttttggattgcttttgtccctattgtcgttcaggaattaatcgagcgtggtctgtggaaggcgacacaaagatttttccgtcacattttatctctatctccaatgtttgaagtctttgctggccaaatctattcttcagcactgttaagtgatatcgctgtgggtggtgctcgttatatttcaacaggtcgtggctttgctacatctcgtatacctttctctattctttattcaagatttgcgggttcagccatttatatgggatcaagatcaatgttgatgttattatttggtaccgtggcacattggcaagctccactattatggttttgggcatcattatcagccttaatctttgcaccattcattttcaatccacatcaatttgcttgggaagattttttcctagactacagagattatatcagatggctgtcaagaggtaataataagtaccacaggaactcatggattggttatgtaagaatgtcgaggtctcgtgttactggtttcaagcgcaaactggtgggtgatgagtctgaaaaatctgcaggcgatgcaagcagggctcatagaaccaatttaattatggctgaaattataccgtgtgcgatttacgcagcaggttgttttattgccttcacgtttattaatgcacaaactggtgtcaagactactgatgaagatagagtaaattccaccttacgtatcatcatttgcaccttggcgcctattgttatcgatattggtgttttattcttctgtatgggtttgtcatgctgctctggccctttgttgggcatgtgctgcaagaaaactggttctgttatggcagggatcgctcacggtatcgctgttgttgtccatattgtctttttcattgtcatgtgggttttagagggttttagttttgttaggatgttgattggcgttgttacatgtatacaatgtcaaaggttgatttttcactgtatgactgtactgttgctgacccgtgagttcaagaatgatcacgctaatactgccttttggacaggcaaatggtacagcaccggtttaggatatatggcatggactcaaccgacaagggaattgactgcaaaagtcattgagctttccgagtttgcagcggattttgttttggggcatgtaattttgatcttccaactaccagtcatttgtattccaaagatagataagtttcactccatcatgttattttggttaaaaccatcccgtcaaatccgtcctcctatttactctttgaaacaagcacgcctacgtaaacgtatggttaggaggtattgcagcttgtactttttggtactgatcatattcgcgggatgcatcgttggccctgccgttgcttcagcacatgttccaaaagaccttggatctgggttgacgggtactttccataacttggttcaaccaaggaacgtatctaacaatgatacagggtcccagatgtctacttataagagtcattattacactcatacgccatccttaaagacctggtctacgatcaaatgatttttttagtttacaatctatttttgtttctaagcaagtttatcacgcaaatacataagtatatttttactttctattcttcctagtttatatttatttcattgtaactttcttagaagctcggtcctctcgctatatagtaggatctgcaacatatttggatgtgggtgggcgttctccttcttttttagatgtaaggtccaacacgtataacaggtgatacacatagaaagacacgtggaaataacagtcatttacgaatatttaaaacctgagcaactccgtcaaatttgatcttaatcttttctggggccccatctaattcccagaaagcccttcgaattagaaaccggatgcaattttggcttgatcaaatagtaacgcttctctccgggaacatcaacgtacatgttgataaagtcaggttgataattctgtttggattctttagcctctaagtgaaccaacgctattttctttttggattcaacgtggaatctcatatagtgatgtgtcctaccttctttatctaattttttggtagatactataggcctgtttcttgtccatttgtcattcgttataagctcaccgtacgctttcaatctttcttttcccgtaatgccatcgtcgcactgtaacaaacttcttatatctttgtttttctctaccatagaaactgctctgttgaaaagctgtgtatcacctgaaggcgaaaatagttctgaaagaattaggtaaataacaatagcagatataccaacagctcctatcacaagtatgccagaaaaggtgaacgtagaagcggattttacttgaggccataatggcttaggtttattcctagtcttgtcatccttctttcctgatgttgcgccggtgccattactatataatcttgttctaagcagtgacgtatgagttattaccgatgagttcacgaaagtattatatcgtggaaacaaaggctttctatgtcctaaacggagtaaagacctaggcaaacttgagctcattgtttaaacttggagtcaggaaaataatatacgaatgattttaccaacctgatatctaaaattaaatttagaactataacctgctgtcactggcggaaaaatacgccctcaggtttgacctagtagagctgaacatcttttcactgctttctgtatcctttatttattggagcttccgaaacttcccaagaaaagtgaagaaaaaaccaggaaaatcaaaagacatgacgcatataatgtacaccttttttttttcgcggccaaaaatttaacctactcatctagatcagtggttggtagagcagtattccgtcatttttcatgtccaggttcgaagctgacctggtattatccggttttttttcttgttgaccaataggaaaaaaaaaaattaaaataaagtcacagaaattcaatgaatattataaatttttcttgtttgtttccctagttgttatttttataaaaaaaattcttgtagacaataaaataagaaatgcccattttgtaacttagcgaaagatgcccagtacatcccttttacacccgtgcattaaaggtgtttgggtttaataggagctttatcatatctctttgattttttttctgctgtcctcggcttgagggactcacagagatctggaaattttcagattgtcagtgcttaggatgggttgtcagtagacggtggccgccgtggatgggaaatctcatacgtttacacacatagtgtttggaaattaatagtagcaatagctatctggctactgttttaaagtattagcccgttctcagtgcttcttttttaaggaataacaacggcaagaccaaagatatatcaaatatggctaagcaatctctaggtatgtttggaggatacgaataacgatagaaaacatgagtgaatttccgtccacgaaaaaatgttaacataaaatgcaagagaacaattaatcgaataatgttaaattattgtaaaacaatgtgtatgatgaggaggaatgtacctaagccaaaaaaaaaaaaaaaaaaaaaaaaaaaaaaagaaacagcttttgcatattcaatccaggcatagggcgactatttagcactcaacgatttttaagcttgtgtattgctgacataaattccggctttagaatccaatattgaaaaacgtgagtacgcagaggagatagaagaaaagtaggaagttaccgtttatattgatttgtgaaatgcatactccgttggatgtggggcaacatagatttaagtgtggatgaaaattatgtgctcattgtgaaaaaaaagttttgcttttactaacaaatttttttattatttgttttcaatagacgtttcctctgacagaagaaaggccagaaaggcttatttcactgctccatcctctgaacgtcgtgttttgttatctgctccattatccaaggaattgagagctcaatatggtatcaaggctttgccaatcagaagagacgatgaagtcttggttgttcgtggttccaagaagggtcaagaaggtaagatttcatctgtttacagattgaagtttgctgttcaagttgacaaggtcaccaaggaaaaggtcaacggtgcttccgttccaattaacttgcacccatccaagcttgttatcactaagttacacttggacaaggacagaaaggctttgatccaaagaaagggtggtaaattggaataaactagctcgactttaacatagatcatacaaaaaatacaataaataaatcctgtgtttcttttatgtatattttttatcaatttcaatttagtttagtttagtttctttaaaaataaaattgtaatttctcacattctgccttcgggtctcaagggctggttggtagacgaatgcgcttgtttctagctgagcggcagatgcatgaattcaatgcaagaaaatgagaaaacttccaatattaaaatgtgattgttaattattagtatatttatgacaatatatatatgtacatagggtgattatgaagatgagtaagatgcgaatggatatgaggatatgaatctttttagagacaatgaagatgcaaagaagtagttaagcacattgacctcagggttgctatatgctacttttagtccgttggatttctgaagcagtattggccacaaaaatttcttcattatttctacgattagagtttcttctggatttttctcgtccctgagacttactccttttcaagtcattttcagcagcagctttgattaaatcatatcttgtgattttacttggagagctattgtgatgggaactttgtctgcatgtgactgtattagtcagagatgttatgggcttaaccataagggaagaaactatggcacgcatgaatgaattactgcttttactgctgtcatctgttgagtttgctgagtcttccgttcttgtagtcttggctggtgtgagtaacattacgtattgtttctgtagagaagataacttataacttccgtcttgtcactagttgttttaattatatgtttgttacaagtttttatgtatagatatatgttacaacttttagaagtattgtggacataacagagagaagggaatgttgctatatttatatattttatatattgccctcaaaactgtatctcatctttttttctgcaatccttgctttcgtaatctaagtgtgggtgacatgctaaatccgcggctttccttaagctttttcacaaaccatctattatgtccagaagctccgctgattatccgtggaaaagggtcttattctgccgtaggaaacttcttctcgagaaaaaagtgagttcacccgcggcgctctcgtaaaacccgagggccgattctttccctccgtggaacaatcggccccgcggcgtcagagggtattatctccgcaagtgatagaactcacatttattctacgttctgcatggttttgattatcttcttttgcacgatgtcacatactttttcgattaccgtcgctttacacagtaactgtttaaaacgagcgttcttaattaataactgtaggagagcaggctttcggctttctttatgagaaataaggactactccagcttgccaagttttatccagttacacaaacgctcaagatcgcctcgctaaaatagatgaaaaaataagaaaaatgaaatgttcaacctaatcccttttggatttatcattgaaagatcgctgatttattcttttccaatacgcctcgtaattctctttcaatgtcaaaggcgccagattgtaagaatctgtcatgtaaaataatctgacaatacgtagttttaaaaaccaattgattaaaccaagctctcttatgatgccaactataaaaaaataaagtgatccagtcagtgcccccacgctgaatcccacgattacttgatctaaattgtggtagtgcaagtaaactctggaaaagcaaacgcaaaacgataataaagccaatgcaccagaaaaaatgcatttttctaagaagtttagattcttccaggaagtgtatatcttcagagagttataggtaaaacaaaaccccatgaattgggagtgtgcactgggcatcccgtaaccggatcttatagtgtcattttggaacgacgcaccgaacgatacggggcgtggctgttttattatattcttgatcacgttattgaatatttcgttcatcaattggccaaaggctacaatgcaggcttctaactctcttgtgatgataaaccacgacaaataaaaagctagcactaggatgggcatcagcgagaaatatgcactaaggaatgatagaaagtcatgcgaatcatagagaatgtatgtgtcatcgaatggtataacatttggatttggatttattgcagcggcggtactattcatgatatgatccgattcaaaacaaattttgatgtagataaaatgcctggtataatgagtggtagagaagaaaattagacgaaaagaatgagaacgaagaaatgatttaaagtgatcacagtggcaatcactttcccctttttaacgcgtgttgagcaatcgattgatgtctctaccatatgtagcattttctcagaaggcaaacttttctttttctttctacttttccaacaagaaattttaagttttcccagaaacccgaattctcctatttcatccaccacgtaagaacggttttcttcctggcgtaattaaaagcataaagaaaaactgaacaagctctagatgtagatcagggtatacatggtgcgcttcagtaagtgtactgtaccactagtttggcgtctgtcacttgaattgcggatttgtgtagagcaatgaaagcgctgcttctgccgccatcaaaaaaaactgagtagttattaaagcctatgtatgacaatataaaaatgtatacagatcagtctgtatataaatcatgaaaatatctttaaaaatttcaagagcgtgtttccgctaaaccttgtcatattcaacacaaatcagtatcattctcggcgtaaattacatgcgaatctccctaattgtgattcaatattccagcgaaccccgagaatttaaatagaacagagtatatgcatttattaacagttattacgccttgtccccagggagagtagtaagggatatgggcatttataaatgtacataagtcacgtttttgcagccaataaaatataataatagaatagtaacaaggaaagctaggccaaaactccttacatggagctagtataccccttttctaagaggagtacttggcaatcagttgatcaacaagggcaatgtattccttttcggcatcttcctgggatttaccttttaagttttcccaggcttcccacttgtagcggtccttcatgttgaaaataccaggcttttccttgtcgttgtcacctacagtggcttgcttgtacagagcatacaattctaataattcatcagtggagggcttcgttggtagctcgttgacggctttagctttttcttcgaataattgggaaaccattttgctgaaaacactagtttaactaattttagagttttagtcttccttcttttgcttcacacagtgaaatgatgtacataacgtacttgcttccgagacagaccaattgatccaagctagctatatatatggcggtcattggggagttggcctggagctgttgagtttgcggacgtgtcagagagcgcgtagggccgccagcgccacctgtcttcaggcaccaaggccgtaatctcttccgacggtcattttttaatggaatgtttcaatacgagagtttgtggcatgtagtttaggaacggattatagagaatagtcgaaatatgtttagtccctacacaaattgctagactacctgtttcgagtttcctctattcctttgctaacggagctgcggtatataaaccatcgtagactcaaagccgttacccgacaactatcgggtatagtgaaatgcctatgttttcactttaagaccttagaaaactatcatgagatctcgccttcagatgcagatatttcagtggattcacgaaacaagaaaaattcactgatcgataacatcttcctttgcttgatattccctttttgaatttccctaactaccttttgttgtttaccacatattctctaaaaagcagagttattcttattttgtatttcattgcatttttatccatttagttaatgaccgaattagattatcaaggaactgctgaggcggcttctacctcgtatagtcgaaatcaaacggaccttaagccgtttccttctgcaggcagtgcatcttcatcaattaaaacgacggaacctgtgaaagatcatagaagaaggcgttcttccagcataatttcacatgtggaaccggagacttttgaagatgaaaatgaccagcaacttctaccaaatatgaatgctacttgggtagaccaacgcggcgcttggattattcatgtggtcattatcatactgctgaaactattttataatttatttcctggtgttaccacagaatggtcgtggactctgactaatatgacatatgttattgggtcctatgtcatgttccatctgattaagggtacccctttcgatttcaatggtggtgcttatgacaacttgacgatgtgggaacaaattgacgacgagactttatatactccttcaagaaaatttttgattagtgtcccgatcgccctattcttagttagtactcattatgctcactatgatttgaaattgttttcatggaattgttttttgacaacctttggtgctgttgtcccaaagttacctgttactcatagattaaggatttctatcccaggtatcacaggtcgcgcccaaattagttgaacatagtttatttcaatcttgtatctagatgtttttgctatatttatattttctgggccaaatcactaacgctttgaaatttcaaaagccaacaacggatttcggacttcatttatgtaaatgaaaaagaatgtgaacaaaaattgaaaaaattccatattaatgcaccttctaaacctatttgttgaaattgtatttaattcatataatcatattctattcaaaaagaataacagatagtattagcactatttcacgtactgcttctaatactattatcacaaaatagacatcggaaaactcaaaaataacgacaactgcaggactcgaacctgcgcgggcaaagcccaaaagatttctaatctttcgccttaaccactcggccaagttgccaatgtatacattgctgtttcctggtttgaagaagctaatcgtgcacgtaaacaacaatctatactacaagtaaaaaaatggggaaaaagatgctgaaggtgagatatatgtgggtaattagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacataccacccataatgtaatagatctaatgaatccatttgttagttaatagtttaaatgtttttatcggaagaggttttgtcatcacatcagcaatgttcttcttggtctcgatgtagtatacgtatagattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggctcggtaggtttgtttttgtgccatatcagttgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcctgttgaagataaacattgaatttattactcttttagggtctatttcttttctgtcataatatttgtcagtgtcccaagtattcattttcaatagttggttgacttctttgtggtatgcttcgatatatttttccttttctttaatatctttattataggtgattgcctcatcgtatcttaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactatttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgccaggattagatgatgctgagtgtatgtggtgagcagatcttataagggttcgtgatgctcctgaatcgagaaggaggtgtccagggagttcatcatcagaatgattagtgtgatttaccgtagattcagtaagttcctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgaatgttgagataattgttgggattccattgttgataaaggctataatattaggtatacagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacagaaggagataaaaatttcaaaatgtttctatgataaatttataatgaatttataataatgttttgggctgtttccctttagattatttagcttatcgtacataatcgcacataatcagactctttattatatataattaaatatttcgagatttacatactagtggttacttaaaagtgtaatcgcaaattatatcagaaatgaacaaagatacgcagtccaaattattgacaacaaccagcatatgtacttagtaatattttatgaagttactaaatcaagattagaaacgtaaaaatagaataacatgatcaagttcaagtctgaatttcctttaatatttggataagtaaattcactacgtgacatgattggttggtgccaacataacacaattttaacattatgtaatctacaggataagtagcattctgtgtaacaaattgtagtaagtctggcaaatctctactctcttaaaggtataaggattgtccagatacccgatattactagaggccgtcatgtataaaatgtggtaacgtaaaatatacacttaacagaaagttaaaaaaggttaagttatacgtggctttctccttttttcttttcaagtacctacctgctgttaattaatagttaatattgatcacgagaataacagatcttcatatacagtataagagagatctataaaactaaaaatggatagattttgatgaaattcgtgggccgatatactcttcagtttgtcattcatgatttattataatatagacttcataagtgaactttgtagtttctggtgattactatagcgatacttttcgaatagtcacaacaagagcttctgcttcacgttttttggaaacaaaagactgaggaggggctaaatataaatactgattcatattacgaaaggaaataaaaaaataactatatgtagatttatattaatattgtataattgcagtccttgtatttgaagagaatgtggattttgatgtaattgttgggattccattgtgattaaggctataatattaggtatgtagatatactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtactttctctttgtattcatcttcatctatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatttcgttatcactttcacccagatttattatctttgtatcgtattgtttcttgagtgttgttatgattttcttatttgcatttaagtctttgctgaataatatcatatcatcaacgaataagcaaattgttacttgactattcttaaatacgcatgaccatccgcgaacttcttgcatgtcgcaacaatttattaaatatgatttaatggtttcataccagtttgcaccactttgtttcaaaccatagagtgattttctcaaacgtagtaatttatcattcaaacctaaatgtggtggaggtcttatgtataattcttctttgatatcagcatataagtaagcagaggatatgtccagctgtgtgatataatagtcgttgtctaatgcgattgacagtgacgtcatcagtgcatagtgatgtacggtattggattgcatatcagaatcatatgtatcggggtgttgaatgtcgcctcttgcaacaaatctagctttgtgtgtaccatcacgtttcttgttaaatataaacattgagtttattacttttttaggatctatgtcatttctatcataatatttgtttgtatcccaagtgttcattttcaatagttggctaatttctttatgataagcttcaacatatctgtctttttctttgttgtctttattatatgtaattgcttcatcatatcttaaggtcgttcgaactggtttgatcgatttcactccttttattgctgcaattaaatttatgcgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagatttatgggttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcacatacagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatctcattggtactaccaggtcggttttggtttcgtgcagtgaaggtagacgagtgtctaggtgaagtagtatctgattcaacggtaccacccatttcggtactctctttattaatgatatggggtgtacgagatcgtatagtagatggaagaatattgtattcagatatgtcggcatcaacttcttttggtgcacgtactttttggactggttccttgtctaattgtaaagggtttattgattgggacgagaagtcgttcactagaggatcagagtttatttcaatctccgattgatagtcatgatcagattctgtattttgatcatatgactgctctgtttcattttgttcaataaaagattggttatgggctgttaaacgattgagatcatcatcaaaagtgagtgtatcgtagtcgaactggtccaatttcgtttgcttgttttgtaatataacgtaattggtagtatctactgtcttttttaatgatggaagatagataatatagccataagagtttcgtgacggatgtaaggcgtaacctggaatgccacgaggatgtattttcgagtcgggattatggttgttaactataaccggttgaccgaaaggtagtatagtagtaatgtccagtccagctaaacctgcatgttgtcttgcagatttatcgtttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtgtgcaagtactgaaaaggctcatatgattcttggtactttagtcgtgatcctttgacatgtctatgtttcgtgcttttgccgattagacagtcaggacattgatatgtgctagcgttagaccattcaatatccgattccttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttgattagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctattgtgtgtgttggcttagattctttctgttgctggcctaagactaagttcgtcgtcatcgcttaagtattgtgatgaaacggttgattcattaatgtgatcattgttcacccttgagaatttactagatgtagcaatattgtgagcttttgctgctcttggttttgaactatttgttctatgataattacgagttgtaacctttgtgttagtcgtgtttggagatgtgcgagaaacatttttgtattcgctgtgttgtttgtattgggacggtttatttagattcatgattttattttcgtcatatattaattgaatttcagcgaataattgggaaagtttcatgttcgttttggtacgatattgattacgtaggtatttgaagtcaccggatagacctttaagtattagttgacaggccaatctgtcgctaacattgatattgttttcttttagcctctgaatgatcgtactgactgtaatttcaaatgtatcagcagatgtacttccgtcgtactcaaggttggcaagagctatccaatcctttaattcttgattgttagtttgcattttggacacacttttacaaaggactgtaaggatgtcagcataattaatttctaaaatttgttttacccatgttggcaataaatgaaatggggcaaatgcttggaaggtattgtatatatacgcatgttcttcataagtcatttgtcttttgatttcaccctggtcatttggaatgatgtcaccgagattagagttcttcaaaaatctgatgtaaaatttaacccatgtagaaaagttttcttctgatgttaaagtgtgtggtggtaagacgttatttcccacctttgtcttagcttgaggtatttcagagtgttgattttttaaatcgattggatcaggtgaggaagtactcagtggtgggatatactgtggcaacggatagtgtgggtccggttgataatacgcaggtgacgtttgataatgtgaacacgtcatcatagatggttgttggtaatgtgcccagttagaggccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaattggaagctgaaacggctaacggatcttgattttatgggacttccttagaagtaaccgaagcataggcgctaccatgaagagaatgtggattttgatgtaattgttgggattccattttttataaggcgataatattaggtatgtagatatactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttttcatcatttgcgtcatcttctaacaccgtatatgataatatactagtaacgtaaatactagttagtagatgatagttgatttttattccaacagtatttatgttttgtcattcttttctacataatcttgaaactaggtagatctacaattgaaaagtaaatactaacattatttactaaatttaagttagaaatcggcacgaaaaaaatttgacagattacgagagtccagccaaaatatgagtatattactatttccccttggtgaaagaaatgaaagatgttattttttaccggcttagtaatactgagctacttacttgggggaaagaaagattggctacttattatgtatgaagcctcagattaccttgaattcctcaaccgtttgagcagtatgctcttcaaattcgaactttttgaacatctttcctccacattcctgattttttcacattcaaaacgcgctgtgaagctgttagaaatttacagatcgaggcatatttctatatataatgtatttttattaagacacccaaagtacttccaatctgtagatattgcactttatctgaccagaagccagacttgaacagttacatattgtgctttgcagtcgttaaatttcccgaactgttttcgtatttttttttcttttcctcttttccactggatcagatcaaaagccgactaaaaatttggcaatttaaagaaagcatcttttaaagatagaaaaggttatttcaacaaaaaagtatcttttcttcacttttctttcaacaattcaaagatggctagaaccataacttttgatatcccttcccaatataaactcgtagatttaataggtgagggagcgtacggaacagtatgttcagcaattcataagccttccggcataaaggtagctatcaagaaaatacaaccgtttagcaaaaaattgtttgttacaagaactatacgtgagatcaagcttttacggtatttccatgaacacgaaaacataataagtatattggataaagtaaggccagtatccatagacaaactaaacgctgtttatttagtcgaagagttgatggaaaccgatttacaaaaagtaattaataatcagaatagcgggttttccactttaagtgatgaccatgttcaatactttacataccaaatcctcagagccttaaagtctattcacagtgcacaagttatccatagagacataaagccatcaaacctgttactaaattccaattgtgatctcaaagtctgcgattttggactagcgaggtgtttagctagcagtagcgattcaagagaaacattggtaggattcatgacggagtacgtcgcaacgcgatggtacagggcacccgagataatgctaacttttcaagagtacacaactgcgatggatatatggtcatgcggatgcattttggctgaaatggtctccgggaagcctttgttcccaggcagagactatcatcatcaattatggctaattctagaagtcttgggaactccatctttcgaagactttaatcagatcaaatccaagagggctaaagagtatatagcaaacttacctatgaggccacccttgccatgggagaccgtctggtcaaagaccgatctgaatccagatatgatagatttactagacaaaatgcttcaattcaatcctgacaaaagaataagcgcagcagaagctttaagacacccttacctggcaatgtaccatgacccaagtgatgagccggaatatcctccacttaatttggatgatgaattttggaaactggataacaagataatgcgtccggaagaggaggaagaagtgcccatagaaatgctcaaagacatgctttacgatgaactaatgaagaccatggaatagtattcacaagaacatttctgccatacttctaaaatttccctatattcagcttagcagtgacacgttgtggtctgtaggtcaatatgtaagtaagaaacttcaactcacatatgcacgatgcatgccaatggaaaaatgcaaggaacgaaatggcgccacggcaacaagtttttttttttcgccagcagaagtacacgaaatgcggcttcatgagcctcttcactgctttgcctaaacgggaaatgcagagaaaaaccagccatcgcgtgtgcttggagagctgacgcgactgtaatcaaagaggcgatatcaacaccttttatccagcactattcaacagtgaatgggctcccaagtaagtcttggcattgtgctttctattcttaagtattaagtagaagttttgtttactgggtttgtttattcctggctagatgttcgcattcgttttctagttgaccatatttaccaaatattcacaactaatacccagccaaggtagtctaaaagctaatttctctaaaagggagaaagttggtgattttttatctcgcattattatatatgcaagaatagttaaggtatagttataaagttttatcttaattgccacatacgtacattgacacgtagaaggactccattatttttttcattctagcatactattattccttgtaacgtcccagagtattccatttaattgtcctccatttcttaacggtgacgaaggatcaccatacaacaactactaaagattatagtacactctcaccttgcaactatttatctgacatttgccttacttttatctccagcttcccctcgattttatttttcaatttgatttctaaagctttttgcttaggcataccaaaccatccactcatttaacaccttattttttttttcgaagacagcatccaactttatacgttcactacctttttttttacaacaatttcattcttcatcctatgaaatgacgaaaataaccagagatgtttcgataacgacagaaaattcaaaatccacatctggatcggcaacggcttcatccgcatctttacctgagaacgaccacccaatattccatcaaccgcgagcaagaataagatctggttcgctgttcatcgaaggatctgattcatttccatcatcagaagtgaagtcatacaatgtttatattgatgatagcaagtatagtgaaatcctcaaaggagatacaaattcaagtagtactgatggtaaacaagtctttgaagatgctagagatgacaatttccatcaggaatcacatagagatctagaggattcaattttagatttagtacgacgagatccagaagtagcagcattccctttacctccgccaaattcaaatgagaggaacagaaattcctcaaacgggtcttccgctgaaactaacctaaatggacacagcagcagcggtaccatctctacttcggtgctgttgaatatgggttcggcagaaaagcacgctgggacgaccagaggagatcatatggaatcatcttcaatgaaatccttcgagaaactgggaaccagaccttcttctttattctatccaccacccgaaggaactgcgccgtaccagggaccaagggctaccgtctccggaaataagtctacaaggcaaacacaaggtacatactcatttccttctatgcggtatggtgtagatcttgtttctcctgtggaaggggctgttgatgtagcaaaaagcagagttcctaacagcacgctaaatggtacttttcccgataaagcgtttatcccacatgaatttcaaattcctaaaaaggcctggaacagaataccagcgaataagtccactagcctcaaaaccccaagaaaccattccctattaattgacatattaaagccttttgaagcagctgaccttgctaatgaccagcgaagttcttccgctgttttaaaaaatacagtgcattctaatgggcagtataatccaactaatgaaacctctggaactcgaatgcaagatcaaaggcagaagaataccaacgaaattgatttagagaaaattcctaatcctcaagtccctcttggtatcgcaatggacaccatgcgtagtccaaaccaactacacgaaaaggaatacgaaagtaatatagaagctggtttagcttctggggtcggaaaaggtgacaatagtattaagcaacatcaatataaaaaaattcctcaagaaattgatcgagatcagcaattaagttttcaaatggaaacaatgcccattcaaagaatagattcctcctccatacgttcatttgattcccgaatatatggcttctccgagatttatagtattccaagggttataactacactgtgcatctgcctttttgttccgcccttattctttttcttttcaatcaatggaaataatggcgtttcaaattatagattaatgagaatgataatgaattatgaacatagaatcggcctcctcaaagggtttgaatgggacattgacgtacaatggttcaggacattgtgctttgtattaggatgtatagagatgttagctatctttgctagcataggaataggatttggtgtgggaataataagagagtaactccatgctggacttactcgtcgaagatttcctgctactctctatataattagacacccatgttatagatttcagaaaacaatgtaataatatatggtagcctcctgaaactaccaagggaaaaatctcaacaccaagagctcatattcgttggaatagcgataatatctctttacctcaatcttatatgcatgttatttgctcttataattggtctctatttagggaaaaaagtcggtttgagagcttctcgcgatgtgaaatctcaatttgaactgcacgccaaagctagcccatttcacgaacaccagaaagaagaaatccccaaggatcgcatgacagagtatgctctctcatatcgttgagtatgaatgccaatacactgatcagctttacaagaaacgtaaaatctggcacgatggtagactgaaatactttcagttaaacaacagattcatgctttatacggaaaaggataacgttttgttagctagtgaatttaaaataaattcaaaagagctgaaagcaattctaaatccagaaggttttgatattgaagaacataggatttttagtcagtttttggtgattatttcaaatattattgaggagtacgatagagatattcaagtggcagcaacgcatgttagggcatatccttcaaatttgtcggtgcaaaaacaacgccctcttatctcagacaatgcaccaagtttgaatcatatctcaactgcgagagaagttcattcgaacataaaagtcacaactcccaatcgcaagcagacagaggacaatgccaccaagggaggattcaacatcagcaaacttactctgaaggtcaataagcctttcaagaagcccaagaggatattaagtactaatgtggtaaatgaatcaaatagaccgagcataaggagccaaaagattcaggaagtgacaccacaactacacgaaacaaacacaagcactaaagtgcagacagccggaaaagttgcgttgaataatgataatattgcgcaaggtaattacgccacgattaccgaagaagctaaagtcagagacggttccgacagaaagaaagatatggcgaacctatccaaaagtggtaaaaggagagtgggcgggatacgaagaattgttcacgaacccctcggaatttgattatacgtcagaattttaatgaatatataagtctgtacactatgctatgcacatatactcaaacaaattcaatactaagtaccgaaaaggaaagtggtatatatatatttatatatataagtaggtacctctactcttaatgatcacattttttcttcaaccagtttgtacagtgcttcaatgtctgcggagaattttctgataccatctgatagtttttctgtagccatttgatcttcgtttaaaacatatctgaaatgaggctcgtcgttgataaaagagactttttcgacgccttcttccttagcactctcagaattcaatttgttttcaataggatctgttgattcatataactgttctagaaggttcagtgggagagtcatattatcaataccggctaacgccttcaattcatctaaattcctgaaagaagccgccattacctcagttgcataaccatgcctcttatagtaactgtatatcttcttaacagaaagaacaccgggatcagtttctgcagtatagtctttgcctgaaagggccttgtaaaagtccataatccttccaacaaatggggagatcaatgtgacatttgcctccgcacaggctactgcttgcgtaaaggaaaacagtaatgtcatattacaatgaataccatgctttacttccaattctctagcagcttggataccctcccacgtagaagctatcttgatcaagactctttctttaggtactcccgcatctttatatagtttgatgatgtggagagccttcttcaccgtcgccttcttatcaaaagataaccttgcgtctacttcagtggaaacccttcctgggactaccttcaaaatctgggtgccgaattccaccaaaatcttatccatggcgttctcgattttctcatgatcagttttgccatgctttctaccatattcaacggcagcgtcgataaacctcgcatatttctccaactttgaagcagccaatatcagagaagggttagttgttgaatcctgtggttcatacttcgaaatagcctcaaaatcacccgaatcagcaaccacatgggtcccggccttttttaattgttctaaagatgaggtagcaactttttgttttttctctgaaggttctgacatatttaatttcttgtatatatgtgattatttcctattttttatgacttacgctagcaagaaataatgatatacttagcataaatatgactgcgctgcaagattgctcttcttttatatgttgtccaccccattctagatggttagaaggatccactatgctcccctcattcgcccctactatggaagaagaagagaaggacaaaagacgtatttcgttacaagtcaagaagtccgaggagtacaagagccaaaatcagagccagagccagagccagatcaaggaaagtaacctataattccccgcgttaacagtccagtccctcttattgaaagcttcgtcatcctgaaaatccttcaacccagaccgactgttgaaaagcccttttgtgtcacaaatccgtaaccatattaccctactaacatccggaaataattgccgctcactttagggaaggtctctaaagggtaataatcgagttgatgaaaaagccgctacccctatttgaaaaataatgaataatggctttctggcatgaatagatttaatacaatgctgaccttgaaaatgtgaaaaaagaaaaaaattaatataaaaaagaaaaaaagtagaaaaagaaagctatcttttttggtctattcaaccagatagtgtgcatttattatattgtccccccatattattcatcaagaaaattacaaaagagtaatgccatttttcttcttttttttcttcttcttggctgtacagatctttttccataaaatgattgatctagcgattattgtttcttaatatttttcctgtcctgcaattgttctcgaggattgctatatttctcaaagatattttcaggaaatgtgcgtgcgatgtgagtttttcattgagggtatttagaaaaataaccgccaacggtgagaacataaaaatcttagctggaaaagaactgccaaagatactattacctagagggttcgtaaatacggtttgtggaaccagggcgatgcaactaaaaaacatataaattggaaattacgagactttcggcacaagaagcgctaatatcctacttaagtggttgaattcttgtatgattaaaaaaaaaaaaaaaaacacctgtcttattttcaattttatggtactgactttgagggtacgtgaatcatcgaaggaaacataattgcactgatatgtaaacttcctagtttcaaatgttttctcggaataccaaataacctctagccataagtttattttcaaactttttcctcttaggtgataagggagattagaaaaaaagaaatatttattattgaaataactgtccaaagaagcaaagtgaatatagaagaaaaaatgcgagtacttacgattttttatttagctaagtaaccaacgtggtgccatattcacgacatagcaagtgtccatagttgcatgcgttttctttaatatcattgtgttttatttttattactttaagaaaaaatacagtagctttcatgcctgcacaaatttaacaagagtttcatggggtacatttttaatgcctcaactatttggtattgttcaaaattttcttcaaacgcttgttaaatcttgaatcagcgttgttatgcaccatggccacatgtctcttataggcgtctttgcgcctaaacgttttctgacagataggaaatgggcaattcagtcctggatatttttctacttttagatttaatgatttctccatctctatatcaagctctcctatatgttgggaagcacaatgtcttctcagaccagttgcttgttggaaacccaatattttccagggacattgctctatgggacacttacacggtctttcaaggttgaattcgtctaagtgcgcggcaaactcaactaacgttgcgaacttttcagaacaatgagaacagtggtaacttcctctttttgtttgcccttcggaaattgtgctgagtactttggggtcgtgatatagctgtgccacgtgcgatttttggggatagcctagaatacactgtgaatgggattgttctgttgtattgctctcaataaatacaggatttgctcctttttgacgtccataattaataagatctctgaactccggatcaactaatgacgtgatacagtgtgtactgtccgctatttcatccggccgtaattgaggtgctgtaccttcctcagtagacgacgtagagtcataagcctgtctctgatttccggctataactgtgattgtgttttctaatgatagtagtaaacagtcctcagtgctggaaggcaggctggaaggcaggctggaatccccctctaagggtgatgccgaatattctttcatgttttgcccgaaatcgtgccaatgataaatcggttgcacctcttgtaaaacctctctgttccaagaccccttggcgatggcactgttttgtccataacacggtgacataagtgctgaaaatcccaacttctagtaaagaattaacaaattcaactgtatgacttataggataagaacaatgtcagttccaatgcgttgacacagtagaaaatatatttactaagaagcagcttcgtcgttggtatagtttcggttgatctagatataaatataactacaaataaatggcaggaaaaattgaagcaaatgacacaggacatatctatcacattgctccctttaatttcctcgaaggcactctggcctttgttctctgcataagaaaaagccagcagaaaatacggtgatatatttaatacatgcccggccacttttctgctggtaaagcccaccggaaaagttcggattttcttatccagtatacgccgaccttttgatgtaatctgtgacatctcactccggcggccattttacgtgacgaagcatcccttacaacagaaagaagaaaaaagatatgccgctttgcggtttctttctggcaatgtatgcactcataatgctactcgtttacccactatccctgtccaaactaaagagggaggaaagcactttttgcatttacacatcgtagattataaaatgatcgttaacaggcgcttgtgattttgaatttaagaaatgtggactagagaagtcttaaatcgccaatgctgtaccagactctctatagcatctaaacacgaaattcaactgttatcttagtttttcacttaccagtagcgcgcttgttattcccacgttattatttgcccccacatcataggtcaagtgaccttctcttacccgacatgaataaagaaaagaaaagaaatcatacccttcagcctgtttagccataaatagtaaagagtagatgtttcgacggactaaataatgtgaaaaaggttctaaaaccttcaaaacaattaaacttgagaaacgttgctataggattgagctaataatttgaattaataggagctgctttttactttgatatatcctgaagttatgttacgagtttctgaaaatggtctacggtttctgctgaaatgccattcaacgaacgtaagcatgtttaataggcttctgagtactcaaataaaggaggggagaagttccatagatgatgctggcattatccccgatggaactattaacgaaaggccgaatcactacatcgagggaattactaaaggcagtgatctggacctcttggaaaaaggtataagaaaaactgacgaaatgacttccaattttacaaattatatgtacaagtttcacagattgccccccaactatggaagtaaccagctcattactatcgataaggaacttcaaaaggaactggatggggtaatgtcatccttcaaagctccgtgccggtttgtatttggttacggctcaggagttttcgaacaagcgggatattccaaaagtcatagcaaacctcaaatcgatataatcttgggcgtcacatatccatcacattttcactctattaatatgaggcagaatccgcaacattattcaagtttgaaatacttcggttccgagttcgtgtctaaatttcaacagatcggcgcaggcgtatattttaatccatttgcaaatataaatggacacgacgtaaaatatggggtggtttctatggaaacacttttaaaggacatagctacttggaatacattctatttagcaggacgactacaaaagcctgtaaaaatattgaagaatgatttgagagtgcaatattggaaccaattaaacttaaaagctgcagctactttggccaaacattacaccttagagaaaaataacaataagtttgacgaattccaattttacaaggagatcactgccttaagttatgcaggtgatattagatacaaactgggtggagaaaatcccgacaaagttaacaacattgttaccaaaaactttgaaagatttcaagagtattacaagccgatttacaaagaagtggtcctaaatgattcattttatcttccaaaagggttcacattaaagaatactcagagacttttgctcagccgtattagtaaatcaagtgcattacaaactattaaaggtgttttcacagctggaatcacaaagtcaattaagtatgcttgggccaaaaaactaaaatcgatgaggagaagctagtgtatccaatgttatctacacattatcttttatcaaaaatgttttatcgtcctttcatctctttcgaagaatcgctctattcacattccaaatctctggcgtcggtcaatatttattcatctttatttttaccttcttctagataatatacattatcccatattggcattcaaactgacttacttgcattatggaagggggatcatacgttccagtatatgcaatggatgtcgtacttacgaacacattgtagcatttgaaggggtatttctatatatttctattattaagggttatattacaattatactttatagtttaaaatatttaaacaagttctcaaatacttaaatacttctccatgaggtggtcggccaactcaacatttccgctttgctgatatattataatactgttataggcagcatgttttttcaactttccatcatcgtagttttctagaactctattatagtactcaattgcaatcgataccagaccgattaaatggaaagcacgccctaagttgtagtctgcctcttgcttttccaaatccgtatataggcttttccttattttatgataacgatatagataacgtaatccatgaaaaatttgaaaatgcctttgtgctgttagtctctgcatagcacgatgaatatgtgacagacccattaaaagattgaccatcgggtcatctgggatatcctcttccaacctagttaaatactgtagggctgaaagaaagcccctactggaatagagaagaacagcatagatatagtacaaatatggcgacgactttttattagggttgtacacctctttgttcgtaattgaagcttgcccatttacctcggtattatatctacaactgtcaaaagctttcagttgtcttaagaaaaatttttgttgaatggtagagctcaaaatattcagagaagagggtcctcgacatagggaatacataaatacctgcaaaacttttctattaaattgaaattgatttagtaaacctcttaaattttcggccaattcctcttcatcatccatttgaagaacaatagctagtttcacaaatttcatcatcttaaccctctctggatcctggaagaacacgtttacttcctgggctgtttccacaacactcaggccgtcttcaacactttgatattttgcgattactaaagaaagttccataaataactcaaaccactgctcatacgacaatcctctcaattctgtggcagaagttaaggttactctttcctccattagcggcccttcaaacacactatctccttcagctaacttagataacctttcaatttggaaatcaagctcggtgttaaactttttagttctccttagtattccaacgaatttcctggatcgacttttcataaaaaagttcttaacgctcgaaaatatatcaactaattcagaaactgtattgatccatatagatgcctgtttggcttcattgagacctgaatttagttcaaattttttcatcttttcgtatttatcaacgacttttgccgttattcttctttccctttctattctctctctttctgcatcataaggtgtacgtttctttttcctgaaagttctaaatttactatcctccagcagcggtttactagaaatatccgaagtatcgttagaacttttctcgttagaaatcctgtgcagtgtttcatcaacctggtgtttcctcatttctacaacgtcaactaacatatgtttaaaagtctctggatcatttaagcgatagtaaacttctgccaaagatacacgaatatctaaatcatctggttcagattttatagctagttcataaaactctttagccgtttcataactttcgatttccttgtagcatcttgctagtggtttgaagacgtcagtggtacgccattcctcaagggataacaacggcgtaaagaaatcgatagcctctttatacttttcagcccttgttaaagcagttgcagcctcaaaatataaatccgcaacgtcactgaaagtctcatcatacaggcattgaaaatgattcagagcttcaacaaggttatctgtgttcaatcttaacaatcccaatctaactctaatatcgattggaatgttatacgatttttccttttctgcggcaagtagtgaatcaaaggtactgtttttaaaccttctattgtcaaattctgaatcatctggaacatgatcccaaaatgtctggctttcgcggcgttgaatccaccgtgcacattttttaattgtctttataccatcgacctcactaactgcgagttttaagaaaagttccgcgagaatgttcaaagaagaccagtcaaatggtatgcatttatattttgcatcaatttttttccagttgatgtcaggaaacatctgcctatcttcatcttgttcaaggggttccttttcgtctgcatcctccccttctgcggcgctttcttcgtctgaagaatctaaggcattttctaaagcagctaatatcgcttcccttctctcaacattagcattaaacactttcatatagagctcaattgaatcttcaatccgatcataatcaacataaagaatggccaactccctcaatatgtttgcatcataaggattgtacatgtaaagcctttgaaatccatctaaagctcttgctaactgtcctgtcttcttgtacaacatagaccggcgataaattgattcccattccataggattcaaacttattaccctggaaaagcagtagatggcctgcctaacatgatctaaatcggcggacagtatagcgactatcttccagaattcccaatcggaagcatttaggtgagctgccaggaaccaagagttacaacaatcattaagccttccttgcaattgatatatatctcctagggtctcgtaagcagcaaaattacgtgcatcttttttaattacctcattaaataatctttcggccacttgtaaatcattcctgacaaaagcttcattggcttgagaaagtaattgcgctacctctggatcaagcactctttcttttctttggcggccgtaagatttacctttgtcatttttcttcttcttttttaccttaaagttacttgcttccctaatcgcgttcatgaaatcttcctcatcgtcttcagatatttcaccgtagtccgagaattctgccaacaaagaactgtctcgttcggaattatattcatcttcgcttaattgtagatcatgaggtacatcctcgtcatcatattcctcatcttgaatcaaatgcttatagtcatcaatatttccgtatagatgctcttcatcctcatcgttaactttacccgtatcagcgctttctcgttcagctgattgattttgctgttcctttttcaattttcctgctgccatcacagatacacttgagggtttctttctctagcttcagattcattgttgactggtgttattatacacagtgcgctgccattattatcgttcttctatttctagccgaagcgccttaaaaaaaaaaagtgtccactttgggaaactcgcctttacgacgaaaaagtcaaacttgcgttctacgaaagagaagaattccttttttgggttaggtggcgaaaaataaaggtagttaaaagtaatcctggctggtctatgtgaatagggaagagataatgatgtagttttcaatagatagtaacacataccatagcaagggaggaaaaaatatcaaagtgatactgtaaaatataataaaaatgttttctggctttagttcttttggcggcggaaatggttttgtaaatatgcctcaaacgtttgaggagttctttagatgctaccctatagctatgatgaatgatagaatacggaaggatgacgcaaacttcggcgggaaaatattcctgccaccaagtgctctaagcaaactatccatgttgaacataagataccccatgctttttaaactaactgccaatgaaactggacgtgtgacacatggaggtgttttagaatttattgctgaagagggcagagtttacttaccacaatggatgatggaaactttgggtatacagccaggatctctactgcaaatttcatctactgatgtacctctgggccagtttgtgaagttagaacctcagtctgtagatttcttggatatttccgaccccaaagcagttttggaaaacgtactgaggaatttctcgactttgaccgtggacgatgttattgagattagttacaatggtaaaactttcaaaattaagatcttagaagtcaaaccagaatcatcatcgaagagtatatgtgtcattgaaacagatttagtaacagattttgctccacctgtaggatatgtggaaccggattacaaagcgctgaaagctcagcaagataaagaaaaaaagaattcttttggtaagggccaagttttggatccctcggtgcttggccagggatcgatgtccacaagaatcgactatgcgggtatcgctaacagtagcagaaacaaactatctaaatttgtaggtcagggacaaaacatatctggtaaagctccgaaagcggagcccaagcaagatataaaagatatgaagataacgtttgatggcgagcccgccaagctagatctgcctgaaggccaattattctttggtttcccaatggtcctaccgaaagaagacgaagaaagtgccgctggtagcaaatccagtgaacaaaatttccaaggccaagggatctcactaaggaagagcaataagagaaaaacgaaaagtgaccatgattcgtccaagtccaaggctcccaaaagcccggaagtaatcgaaattgactaaaagatatatactagtatacaacaatatagtgtctttgacagatatatagagcattttcaagttaacagatcttagaatccaagtatcttatgcatcgcattagctctgctgcatttgctgttcgtttagtaaaaataattacgtgcgcggttgcgcgatatttcccttgcttaatgccgaagtaattctcttcgtttacccatactcgaatctattgtgttgttgaaaaataaaaaaaaaaagaaccaggttatataattgtgagttgatcagtatataaatgagagaaaagaagtttctattgttccaaattatatccaagctgattttttaacccttacctcacgaaaagcaagtttaagacaaacactcataagaatccttacatatactaaaaaacaaatgcaagtctccccagctattgtaaaaggtatcgcagtctcatcattaggtttatacgccggtattttaacttcatctaccgtgatttctattaccaccccaataaatgttctaactcaacatttgaagaatgttttgtgcacattaggatgctggagcaccgttttaggtggtttagctactggtgcctttggactcagctactatctagctgcaccaggagaaagaccaaactaccttttgtgcggacttggtgtcgccccattatctgcagcctacctatacttagtatcactgttcaatcacaagctagccccaaaatgcacacgtgaccaaaatgatttagaaaagcaaaaggatgaaaaattaccccaacatcacccggaagtcaaagatggggaagctgcatgcccattctcaaagatgaacaacgccaaaacattaaaacctgaatccgaaagaagcgtaaaatgtcactcatacatgtcattgcacatgagcattgtaaccggtataacaatttttacctttggtaagtgtatcctagatggattcaaagcatgaacgacgaagcacgtgacacgttcccttcaaacatcacaattatttaagcgagactaatatatatgtttagcgaaaaaaaaggccaaaaaaactagtaaatatacaaagcagagtatttttggctcttgtccacattggataagagaatatttatttttcacacagaaaaaaaagttatatacgtatctctaagaaagtcaaagacaaattacgtagaatgtgattcattcccatttcgcccgtacactctctgtctctgtctctgtcccaaacttcccttcctatacgtattcataatctgcttaaacgtcaacagtagtttcggaacatcttcatacgtagggaatacgacttttttcttttcacctgcagcttgagccaaactaaaactgggatccggataaactattaataaaggatcgcaaagtccatacgccagtttaatgggaatgaaatgatattgcgaagtgacgtcaagaatcgactttaagctatatccgaagtcaagaaagccgaaccttacatgcggtcggaaagcaaacgaggagattagattggttttcatatccgctaaattttcttttgattttactttggcttaatctaatgcatgtatatcggaagaagcaaccgatctggcccagttgagtcgtgctaccttagtcatgcccaggaaaaccggattccttcttttcattatgacatccgtttaggtcaataggcttttttttctctcgcccgtgcctctccgtgttcgatgaatgtgcagcttgcctccgagcgggcgagccacctcgagcgggtgacgaaatagtggaaaagaaacggggaagcaaaactgtgctgttctggcccgcagcggacgaacgtcattaaaggcgctccatttctgtcgtgagggtctttcggtgcggtggtgaggctgcgtaaacaagcttgctcttcatacccctcccgtggagctagttcggaaggactattggcgcatcttctgttgagaggttccgtaattctccgtaacgtcccgttcaccactttgcatgtgctctcacgtacggccgtctcttttcggccttcggcccgttccgatttttgtaccccttacgtgctttgaattctagaaggcatctcctctccgatggcttggtacagggagcactagggaaattgcacatggaagtatctggaatacaaagtttttgaaaagaaaagccgagcgtaatattgggacaatacccagttctcagccttttcagcgcgggtatgagacagcttgcaacaggtaaaaggaagttagaagggttaggtgaagggaacgatgatgctgcctgagaacaaaaatgcagcttcatgttacatacaataaaggaaggataattaaggggaccatgcaataagggacaacttaattttggaaaaatcggagcttagttgcatctacctactaatactttccccaaagaataataatacgagtacaatacatatatatatatatatataatatacacatgtaagtgatgactattcttaatacaaaaaaatttcccttttataataactattcttagcattaaataacccgttactgacaaaaagcatataacataggactcaagatcgactctcataccctccgaatcaaattctcactcgtatacgcaatcatttaaataagcacatcattatcagcatataccgaataataaaaagcaaaaatgtatacaaaactaagatctatacaatcaggaacatttagcacagtttataaagcatggagtactacacataaccgctacgtcgctttaaagattactcctaaatacaaaacttcagaagccaacatgaagaacgagtatgatgtaatgaagattttgagttcttgtaatcctcaccccaacatctgttcgatgctcgacttttacacggatgactcgtactacatcatggtgctagaatactgcgaatgtggtgatctttatgactttctagatattgctaagagtcaaggtagcccgtcgtctccatctttgattcaaattgatatgcaaaagataatcaaacaactgtgctcagcaatcagctttgctcacagcttgggtattgctcatcgtgatatcaaaccagaaaatattttgctaacgataaatggtgacatcaagttggcagactggggtcacgctatccaatcccctaaatctaacgacttccagattggtaccgataattacagggcgccagaaactttctctggccgcgttagtaactcttgttttaagaagaatttcgatcggtcatcggctccattgtataacacataccaagctgactattggtcattgggtgccaccatattttatctgatgttcggcgattgcctttttagagtctccaaatcaaagaaggttcagcatctaaaaaatttcgatgagtttgaaaaagatccatttgcattcatttacaggaaatacgtagtaccaaggctctcctgtggttacaatgatgaagaagacctacacgttagcctgcagcatacgaggcagtacatatggcaagatctacccgacatttatgatgtcttccatttgtgcaagattatggttgataccttattaaaggtatcgaacgctaaagagaggtcgatggagaatttcatcaatgaagttgattctgcatggaacaaagatagctcgatggacagctgcttctcgtaccaaaataagattgatctgttttgggaacagtggtctgtgaacacggaaacagtaccagcaaagttccaattgaaaaattttgagaaaccttgcctaattcaagatggaaaataagaagtaaaaaagaccttttgaaagtttcgcctcattttccttgatctgactttttatcccctgcttatccaattttagttaggaactttggcataatttcagtattacatactacctaatcgacataaaataatattacatattcatttttttaaaaaataatcataatcaatttatcctttttattccttttttctcctgtgcaaggttgatggtgatgtttatgatggtgtgtttattatttacaaataaagatgctatctaattcttgtatatcgtattaacatgcaaatgcaccgcgagtggcaattttcttctcgtaatggatcagttcaacatcttcaatggtatgaaccagaattttcgaattttcttcgttaaattcgaatatgaatgttcccttaatcagccgggataatctcttttttttacttcttttaccgtcgccatcatttttcttcttctcatcttctttggaattttgagtttcgttgaccttattttccattgacctttcagctgcattttcaaggtactcagagataacactttggttcaaattattggctgtaggatgtaaaatgtagtctatgactggtaccgacctcattgaaaatgaaccgcctgcaccattgcctcgtttctcctctttcaatctgtcattaatttctaatttggtaatcttgcaatggtcttccggtatgcagctttgccatttgatcaccaatttgtcattacatgttatggtattataactctgaagagcagatttaacttcttcatcatgcgatgtcgatgttagagtctttactgaacttatatgcaagcgacattcatcgcccaagataaactttcgtactatcattcgcattgcattcaaagaagccatgtattttgattttccatgtaacactggaatatatggatgcgatgttggaaatagtctaaaaacaacgttatccgccaacactgactccttgaacattttttgtaacaaattgggaacacctttaaccactaaataatctgttatttgccccaaattggccactttttgagaattggagtaccatcgaggaaagattcctttgatagatattatgccggctctgcaaacacactttagtaacataagtctttccccctattatctatgaatataaactgtctatctttccttggttgtgatgtatcgttttccgtagaggcttgcagctttatggctcatacctgtcatccctctttatgggccttttaagggcgctctctacattgtattctattcatttttttcgtaaccgtaactacgcgccttcttaacgcaaggcgctcgactcatcatgagatgcgtatgaatgtctttcagtgtatagaaatacatctcaccaaatctatttatttaactaatatttcttttaatattttcctcaagaaactcaggcagttaatgttgtgtcctattttttttagttctttcccatttttatagcactcgtacaaaagaaatcgaaatatttcaatatgtttagactcggttctatgtgttaaaactgcaagatgaaaaagtaacatctatcttagattaaggtcctttctttatattctttactttattagtgagcagaaatattattaaaaattgccgctgtcatactgtacgatattattacccgaccgcagaatgttcctcaatactttctttttcttcctttttttcacttcgctttcttcatgtccatcaatgaaatttcagcttcatagcgatttattttcagtgtacgttattcaatgaagattccttttcctcgatctatccagacgactagacatagcgagaattctttacggtagaagcaacctatagattaccgaatcataactttctttagtgttgattgagacgtgttgtgtttaaactatccattgcatctcgataaaaaaacatagtactacaacaaacagtcaggttcaataacacctaaacattatgtcatctcagtttttcctgaaaacctctcaggatatagagctcttccaaagctacccaacttttgagcaatccaacacaaactccaaggatttccctgtcatttcctcggttttatcgccatgtggcagatttttggctttatctacgaaggagaacgtcaaagtttttacaggtccatgtttggataacgttctattaacaatgaagttgtccgacgtctatgacctacacttctctccagcaggtaactacttaagcacttgggagagagcgtctatacaagacccaaatcacaagaacgttaaagtttggtatttgaataaaccatttaagaaagattgcgtttcggaggatatagtccctgcttacgaatatcaagccaaatcccaaagcggttggtttttacaattctccaaattagacaattatgggctaagactttttaaacacgacttgaagattgttaaattaagctccgctaatgccgacaatttcgacttccaatctccgtttgctgtcttgtctgatgatgaaacgtcccaacatttcaccacctacctaatctctccagctgaacatccaacaatttgtactttcacaccagaaaagggtggtaaaccggctcaattaatcatatgggccctctctgaaggtaaaatcaccaagaaaattgcctccaaaactttctttaaagctgattcctgccaattgaaatggaatccattaggtaatgctattttatgtttagctattactgattttgattcctcaaacaaatcatattatggtgaaaacacactatacttactgtctttccaaggtgtcaacgggactttgggtggtaactctgtacgtgtttctttaaccactggacctgtccacgatttcacttggtcgccaacttcaaggcaattcggtgtcatcgctggttacatgccagcaaccatttccttttttgacttaagaggtaatgttgtccattcattacctcaacaagccaaaaataccatgcttttctctccctctggtcattacattcttatcgccgggtttggtaatttacagggctccgtggaaatcctagatcgtctcgacaaattcaagtgtgtgagtaaatttgacgctaccaacacttctgtctgcaaatggtcaccgggtggagaatttatcatgacagctaccacttcaccaagattgagagtggataacggcgttaaaatatggcatgtatcaggctctttagtatttgttaaagagttcaaggagcttttgaaggtagactggaggtcaccatgtaattacaaaactttggaaaacaaagacgaagcatttttcgagaaccatatcattaataactgggaaccgctacctgattcgaccacatcttcacttgatcctaaaatatccaataaatcagaattgcaaatacattctagcgttcaagagtacataagtcaacacccaagcagagaagcaagctccaatggaaacggatctaaggccaaagctggaggcgcttataaaccacctcacgcaagaagaacaggcggtggacgtattgtccccggagttcctcctggtgcagcaaagaagaccatcccagggctagttccgggcatgagtgccaacaaggacgccaacaccaagaacaggagaagaagagccaataaaaagtcaagtgaaacgtcacctgattctactccggccccatctgctcctgcctccacaaatgcccccacaaacaataaagaaacttctccagaggagaagaaaataagatctttactaaagaaattaagggctattgaaaccttgaaggaaagacaggccgtcggcgacaaactagaagatacgcaagttctaaaaattcaaactgaagaaaaagtgttgaaagatttggaaaagttgggttggaaggatgaataaactagaagaaactgatgtatccatacaactgtgtaaatattaacaacgtcaaataatactactttgaattgttttttactgtttcccaggagaattacgccaacctcccccctttctttttttcccttgttttattgtacttttccacatatttttttaacatcaaatagtaattgatacatacataattagtgagcattttccttatttttacgtctcttcttggcggattgccaccagccgcatcttacaatgtatgccacgataccgccaggcaataaatgaatatggagtgtcacttcggctccgtaagccggcgctgcatccgccaccacagttttttttagcgtcgctgtcgccgctttgccacagaaaaagaaaaaaaaaaaagaaacggcgccgtgtagggttttgtataacagatcggcctagcagccaggagatggcacggcgccaactgaaaagttagactgtggaattgccgttcaccacactcgagtggcatctaataaactgccacagttgactcaagcggtgctaccttcgcagttattgcacaccatggtaacacataacacagtcttgcattacaaatgtggttcctcctacttggcggtgaatttcttgagtcagcccgttattttcatatggtgatgtaagattacatacagtatatatatataaggatgattctcacacaaacttttccgctgttcatcatattttgtttttggattagtttcacattctgtagaaatctttaaagacaagagaagagaaaacaaaggcggagcaatgtcggaaggaagaacgtttctgtcacagttgaatgtcttcaacaaggagaactatcaattttcttcttctactacaaaaaaggaagtaagtaactcgacagtggatgctgacaacggtgcctccgattttgaggcaggccagcaatttgctacagaattggaccaaggtgaaaagcagttaggtattttgtcgtgtattgggcttatctgtaatagaatgcttggtaccggtgttttcgccgtttcctcgaccatttacacactatgtgggtctgtggggcttgcattaattatgtgggcagttggcgccattattgccatttctgggttatatgtatacatggaattcggtacggctataccgaaaaatggtggtgaaaaaaactacctggaggctattttcaggaaaccaaaattcttcattacctgtatgtatgctgcgtatattttcttcctaggttgggctgctggtaattccatcaatacagctattatgtttttaactgctgctgatactgaagtgaccaaatggaatcaaagaggtattggtgtggccgtcgttttttttgcattcctaattaattctctgaatgtcaagattggtctatatttgcaaaacattttaggtattttcaagattggtattgtcctcttcatttctattaccggttgggttgcccttggcggtggtctcaaagatggttatcaatctcacaactttcgtaatgcttttgaaggtactgaaaccgccactgcttatggtattgttaacgccttatatagtgttatttggtcgtttgtcggttactccaatgttaactatgcacttggtgaagttaagaaccctgtgagaactttgaagattgctggtcctacatcgatggtcttcttggctataatctacatttttgtgaacattgcttacttcgctgtggttccaaaagataagttaatttcttcaaaattgattttagctgctgacttcttcgatattgtgtttggcggccaagccaagagagcagcagccgcactggtcgggttgagtgccttaggaaatgttctttctgtcattttttctcagggtagaattattcaacaactaggacgtgaaggtgtgttgcccttttctaatttctttgcctcttctaagccattcaactccccaatggttggtttgtttcaacattttattgtttgtacagtaaccattttagccccacctccaggtgatgcatatttgctagtccaaaatttaatttcctacccaatgaatattattaattttgccattagcgcgggtttgctttggatatactggcaacgtagacaaggtaaaattgaatggaacccaccaattaaggccggtgtttttgttacgggatttttcacattatccaatttatacctgattattgctccttacgttccaccttcaaatggcgagtcggtgtattcaagcatgccatactggatccactgtgtaattgcttggggtattttcttctttggtggtgtttactacgttgtttgggcccaattattgccaagatggggccactacaaattggtttccaaggatgtgcttggtgaagatgggttctggagagtcaaaattgccaaagtttatgatgacactattggcgatgtcgatacacaagaagacggcgttattgaaacgaatataatcgaacattacaaaagtgaacaagaaaaatcgctgtaaccaaaaaggtacttaccatctcatctcgattcttataatcacgtatgaacattcttataattgcattttctttatacaaaatatataggtaccaaacctcattataatttctgccatttaatagtttaagatgctattccgtttcgtattttttcaatttttatacctactattgcgcgaaatcaaaatagcatactaagaaaaagcaatatcatgaattgctgatgagatagattcaaattggaattaactaaatctatcagcaacgctataaacacagataagcgctctataaaatcgtttgtctaacgttttatatagttctttattgctcccttaccctctttccgtcaatagtgattgttgtctcgggaaagcttttttttttattaatcaaaggcccaattgagttacaactgaaattaagctgagttggcggaacagtgtggtattagcgaagggaaaatctgtgaagtgccctagctacaaaacagagataaaaaaaattatatttcaagcatggtggagcaagataatgggtttttacagaagctactcaaaacacaatacgatgctgtcttccatttaaaggatgaaaatggtatagaaatatatccaatattcaatgtactgccacctaaaaaagaatatccagactattacattataataaggaatccgatatctttaaacactttaaagaaacgattgccccattatacatcgccacaagattttgttaacgattttgcgcaaattccttggaatgcaatgacatacaatgcaaaagattcagtaatttacaaatatgccattcttcttgagtcttttattaaaggaaagatcgtgcacaatataagaaaacattatcccgaggtgacatatccatctctaggtcgaattccggaaatattcgcagagagtatgcaaccctccgatttatcctcgaaccccattaatacacaggaaaatgatgaaaaggctggcttaaatccagagatgaaaatggctttcgcaaaactagatagttcgatcactgaaaggaaaccaaccaaccaagattacaggatgcaacaaaaaaactcaccagcgtttccaacccattctgcttctataacaccgcagccgctggcttcacctactccagttgttaactatgcaaatattacctcggcgcatcccaaaacccatgttagacgcggtagaccaccagtaattgatctaccctatgtactgaggattaagaatatcttgaagatgatgagaagagaggtcgaccaaaataataagacgcttaccctctgttttgaaaaactaccagatagaaacgaggagccaacctattactctgtcataacagatcccatttgtctaatggatattaggaaaaaggttaagtccagaaaatatagaaatttccatacttttgaggaagactttcaattaatgctaacaaattttaagctttattattctcaagatcagagcaatataatacgagctcaactattggagaaaaacttcaatagattagtgcgaattgaattatccaaacctgatgaagactatttacctgaaggtgaattaagatatcctctagatgatgtagaaatcaatgatgagaaataccagataggtgattgggttcttttacataatccaaacgacatcaataaacccattgttggccagatttttagattatggtctactacagatggaaacaaatggttgaatgcttgctggtattttaggccagaacaaaccgttcatcgggtggataggttattctacaagaatgaggtcatgaaaactggtcaatatagagatcatcctattcaggatattaagggaaagtgctacgttattcattttaccagattccagcgtggggatcctagcacgaaagtcaatggtcctcaatttgtttgcgaattccgttataatgaaagtgataaggttttcaacaaaatcaggacttggaaagcttgcctgccggaagaactccgtgaccaagatgagcctacgatacctgttaatggaagaaaattttttaaatacccttctccaatagcagatttgttaccagcaaacgcaactctaaatgacaaagttccagaacccacggagggagccccaactgccccacctttggtaggcgctgtatatttaggccccaaattagagagggatgatctgggagagtattcaacttctgatgactgccctcgatacataatcagaccaaatgatccaccagaagaaggtaaaatagattacgaaacaggaacaataattacagataccttaaccacaagcagtatgcccagagtgaacagttcctccacaatacgtttacccactttaaagcagactaaatcaattcccagctccaatttcaggtcctcatcaaatactccactattgcatcagaacttcaatcagacttccaattttttgaaattagaaaacatgaataatagttctcataatttactatcacatccttccgttcctaagtttcaatcgccctctttattagaacagagtagtcgctctaaataccatagtgcaaaaaaacagacacagctatcatcaacagctcccaaaaagcctgcatctaaaagttttacattatcctcaatgattaataccttaactgctcatacctcgaagtacaacttcaaccatattgttattgaagccccgggtgcatttgtggttcctgtaccaatggaaaaaaatataagaaccatccaatcgacagaacgtttcagtagatcaaatctaaaaaacgctcaaaatctcggtaatactgctattaatgacataaatactgcaaatgagcaaataatatggttcaaagggcccggtgtaaaaatcacagagagagttattgattccggaaatgatttagtacgggtacctttgaatagatggttctgtaaaaacaaaaggagaaaactggattacgaagacattgaagaagatgttatggaaccaccaaatgacttcagcgaagatatgattgctaatatttttaatcctccgccgagcttgaatttagatatggatttaaatctaagcccatcctcgaataactcttctaatttcatggatttaagcacaattgcaagcggtgataacgatgggaaagaatgcgatacggcggaggagagtgaagacgaaaacgaagatacagaagacgagcacgaaattgaagatatcccgaccacgtctgcttttggcttaaattcttccgctgaataccttgcattcagattacgagaatttaataaattatgaccatgataaattcaccacatgtatctatatatgttcatgcatataccatatatattttgttattcatacgatagacctcaatcgttttgttgcctttcaaaacgcacaattgtaaacctagcttactatttatctatcgcggtccagaatggctttcctttttaaattcatcccagaagccacgtcggagtaaagtattcggccttgatgactatttcgaatcgaaatgaaagaataaaaggaactaggaggttgttccaacaattttccatgccgtaatttcatcggttattaggttaccagcatttatctcagtttatttgagtcaaggtaatttattttcattcattactgtatggagtaaaaatgaattccatttatgtattcgcacgaagagaaatttatcatccgtcagagacaccaaattacggccgaatttagatttgtttgcacgtaaatatgagccaatgaaagcgttattattcaatgtttccaaattgttttccaccgttttatttttccccaagaattcgcttttatgaatgtttttaatatatgcaatcattttatcaaatccaccgatgataaagttccagtgttcactcaacattttcatagaatcgtcatggcttctggaatcgactgttaaaataaaacaatatcttctttcattgcctctagcattttcatcatacagtttaaagcctataactaagttcaatcctctaagatcatcaaaaaatataaaaggcatattatcataaatcattgtttcttcagaaaaggctcttttaataatagaatttagcaattggtatcttatagaagaatattgggtagttataaacggaacatcttcgatgaagcaccgcatcgatctagttgactcttcaggaaactgtaaaagacatgattcgcaatatgattcagttggataatcaggcactagtaattcttcacctagcgttcccttttctgcggattgtgtaactgatatgatccttgggccatgcttgtcgcagaaatgagccaatgaaatcactgtcgaggacattctatgcatctatttcatcaaccatttaaacgctaacttattttatggaggtgctagttagttggactttattgcttcatttatcgtttgatggtcatcgaatagaagattcctaagcccttttctttttactcaagattttctttttcaagcgtgttttttctggcaagtacgaaaacggcatcttcgaacttggcgaatgaacaatcggtttggttcaacatttccaagaacaactacaacatactatcagtgttactttcaaaagtcttttaatacatttgaaatgatattcagtggaagtggaatgaaataggccacagtgaataggccacgatacacacagcatgtgtcatgctcaataccttgcacctgaatctatataatcttgtagttcaccattatatacataactcagaagaagaaaacaatacgcatattggatagtgctccatcgcttttaacaactgataatttcagtcatctggctcagggtcttgtcgattttttttatttagaaactatccgaataaaaaaaccgcaggaatacaaagcgatgggaattgctatttcactgaacatgtatgtataccgtataccgcataaaataactataaacctacaccattaaacgatgtgtgcaaagaagctcaaatacgctgctggcgatgactttgtacgctatgctacacctaaagaggccatggaggaaactagacgtgaattcgagaaagagaaacaacgacagcaacaaataaaggttactcaagcacaaactcccaacactagagtccactcagctccaattcccttacaaactcaatataacaaaaacagagcagaaaacggtcaccactcctatggttctccccaaagttattctccaagacatacgaaaacacctgtggatcctagatataatgttatcgcacagaaaccagcaggcaggcctatacctccagcgccaacccattataacaacttgaacacttccgctcaacggatagcttcctctcctcctcccctaattcacaatcaagcagtgcctgcacaactcttgaagaaagttgcacctgcttcgttcgatagcagagaagatgtacgagacatgcaagtggccacacagctatttcataaccatgatgtaaagggcaaaaaccgactgacagctgaggaactacagaacttactacaaaacgacgacaactcccatttttgtatatcatcagtagatgcgctgataaatttatttggtgcttccaggtttggcactgtcaaccaggcagaattcatcgccctatacaaaagagtgaaaagttggagaaaagtttatgtggacaatgatatcaacggatcgctcaccatttctgtaagcgaatttcataactcacttcaagaactaggatatctaataccttttgaagttagcgagaaaacatttgaccaatatgctgagtttataaacagaaatggaacaggaaaagaactaaagtttgataaattcgttgaggcgttagtttggctaatgagattaacaaaattattcaggaaattcgatactaatcaagaaggcattgcaaccatacagtacaaagattttatctatgctacattatatttaggtcgtttcctacctcattgatgaaaaccattcgttctttctggtcgtaatacaaatagaagaggtaaaccaatcaatggcccgttagtttgccatttgctgcatccttcccatgcaaagtgtcttcgtatttagtgatgttttgttagcgacacaaaagagacctcgatgacagacatttttttttctttacttaatgtattataagtgtgtctgacctcgactatcattataatattaatttgaagttctattttacatttatatgagttattccattacataataaggatatcaagagcagattagtgtcttttagattatacatctttttccccccttttttgttgttggtagtggaaagaaaaggatcaattaacagaaataaataaataaataataaaaacctaaaattccttttgcgtcattgaatttttattatgaagtcaaaagggagtcggttgtcaacagactgtcctgtcgaatttcccaagatagtctctggattcgctgaggaagtgaaaatacgtagacaaagttcccaaggacagtacgccgtcgattcacatcctccgaaaagccctgaactgaaacacagaagacagaggtcatcctcttttgttaacggtaaatgcaggaacagggaccttccattgttagataacaagaaagcacaagaaataaacaccaattcacacggccaagacatcggtatcaaaaacttaccacgtcaacgtgagttgttgaatgccaaaaatggaattgattttacgctgatggtggcgggtcaaagtggattgggtaaaaccacgtttatcaattccttattttctacttctttaattgatgatgacatcaaagaaaacaaacctattattcgttataaaagcattgtagaaggagatggaacacaccttaatttcaacgtcatcgatacacctggttttggtaacaatatggataatgcatttacgtggaggacaatggttaactatattgatgaagaaataagatcgtacattttccaagaagaacaacctgataggacaaaaatggttgataatagagtccattgttgtttgtactttctgagaccttcaaataagggaattgatactttagacgtcgtaacaatgaaaaaattagcgaagagagtgaatttaatcccggttattgctaaatcagatttgctaacgaaagaggaattgaaaaacttcaaaacacaagttagagaaataataagagtacaagatatccctgtatgtttctttttcggcgatgaagttttgaatgcaacacaagatatttttcaaaaatatccattcagtataattgcatctaatgagtacatttttaatgaaaagggcgaaaaagttaaaggaagacaatacaaatggggcgctgttgacattgaaaatgaaaagtactgtgacttcaaaatcttgcaaaagacgatttttgattggaatttaattgatcttgtagaaagtaccgaggattattatgaaaaatgcagatctgaaatgctaagaactaggctattaaaggccagagattgcttaacaacgaaaagtgttgacataacggaagaacaaaggaaatttttggaggaagaaatgaacttcgatgaaatcgaggaaaacaaactcaaaaattacaagtgctatgaaataattaataaaacggtcatggataaggtggctacagaatgggatcctgaatttataactagacaattagaagctaagaaaaaattcaacgagctgtccaacagagaaatttcaaaatttcgagactggaaaaagagcctattcatggaacaagagaattttaaccaagagattgaacaattgaatcacaagttggaaaacttacaactggaatgtcaggacttggaatacaagctgttaatcggaaaaagttccaacagccattccacagatagtgctactttagtaaacgttcacatcaaaaggtagtattaattaaaaaaaaaaaaaagccaataatttcgcgcaagctttgctctacataataaaaatacaattaggatagaaatgaatatttttttagcggcagttttaccataagtagcaaaaccctaacaatacaatgtgagactaaagtaaatccgggtaatacaaaatacaatttttttttattcttcacagcgttttttcgacggaggagggaaaaaaaaaaattgtatttaaggcatcaaatgcgcgacatcatatacctttgtccgctgttatcataccttgaacctctacatttcagcctagcgcgcgcaaaaagaaaaaaaaatcataagcaagagtggtacggtaaccacaaggcaatgcaaagaagggtgcgatatcaagtgatgttaccttcctttactttttgcctttttcttgaattgtcaatccgccctttttttcttttcagttttttctcctttcatccgtctcgtttatcataatgatgatttcacttatacctatatgttttttctggcatctctaatgttaggatgtgaagtttaagtactctccattcaatgaatacaatttttgacaatatctgattttactatgattaaacagaccgagggagaaaaaaaaaaggaactaaaaaagggcctacgtagaagatgatgtaaaagtagattcgcatctgagaatgttttcttcaaatttttcttttcggccttggcgcagaagactttctcttcgtccgcgtcgtataggaaacaaaaaagtgtaaaaagtaaaaatcggtatattacgcaatccattcgttacccggtgtagtcacgtgcgggtgcggagggcagccgtttaaacccgtttgggccttggtccgatagaaccatctcgcaggaaagagcagagccagttatcgggtgtcgtttacgcccagatgtcgtttagccagctccgcaacggccactgccactaccactgcctcccttcgtatacggaacacagagatcgtatacggtaaacgactagcactaggacaatagcaactaacaatgaccgataacagtcagcaacctcaaggcacctggcacaaaaccgtcgaggaagaggccctttgccaccgtatcgcatcgctttcccaccaattttttttttcttgcttgcctcgcctctgctgtggtcgtattattattattcattctctgcgcagtttaaactatatacacacgattaatccgttatgcatgtacattttcttgtatgcgtacgcctgtgtatgcatacttctatataatatataatacaggaggatctattcttttttttcttcttctcttcttctctcccttttttctctctcttcgtttctttccttccagtaaatctttatattagttgtaactttttctctttagatagtagcatagaggactaaggaaaagtagtacagccataaaaaaaagaggaaaagatgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaattccatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaactaagagaagaaacatacttcaaaaaaaaaaaaaagaaaaacaacaaaaaaacgtataaaatgaaataaatttcgaaccgctttttttccttttttttttttttactttgtttgacctcccctaactctttctttttaccttcacaattgtttattttaatatatgatttttaaattaattcaggttaattctaaaaactatattgcaatcttttaaatatatgtatacacgttcattaccacgtatacatatccatatatatatatatatatatacatactatttatgataaatttttaacaagcaaacccattattaaatgctataaataaaagacagcttctttctaattattattcaaacttaaaaactacatatacaaaaactacaaaaatctttcaaccgacccatcttctggcagatctgaataatctaatccatggaccgtatccaccccactcttcgtatttgccctctggataccaggaattggcctccaatctgcaaactctttcaggatgtggcatcatggcaagcactctaccatttggtgacttgataccggcaataccattggtcgacccattggggttgaaggggaacctttcggtgacgttaccgtagttgtccacataccttatacaacataaaccatccttttcgaacttttccagttgttcagcgcttttagaaaatgttgctttaccttcaccatgtgcgacagcaattggcaatttggatcctgccatgccattcaagaaaacagattcctcgctagaattgtccttttcttgagatatttgcaccatacatacacgggcttcatattgttcactaacatttctttcgaaacttggccagttttcacacccgggtatgatatcttttaatctactcaagaattgacaaccattacaagcaccaaaagcaaatgtatcttgtctttcattgaagaacttagaaaattgcgagcgcacaccttcgtgatacaatacggatttagcccaacccgcacctgcacctaagacatcaccataagagaaaccaccacatgcggcaagaccgatgaagtcatccaaatggaacctaccttctagcaaatctgtcatagtgacatccactgagttgaatccagcttgttggaagcaccatgccatttccatttgaccgttcacaccttgctctcttaagatagcaacctttggcctttgactggataattctaatccgatcttcatatcatcggctgggttgtatgttagggcatactgcaaaccgggatctctatcgtccgtgatactggcaaactcttcttcggctgtttttggattgtctctcaatttctgcatttcgtaagatgtcttactccaagtttgctccaattcagatctcgaattggcgtaaattacatcatttgttgtggagttaataatcttgatttcctggctttggaaggatggcttaccaacaatagaaatatattctttagcaactccgttctcgttcaagattttttcgaacttgctcaagttcttagcagaaatctggaatactgcacctaattcttcattgaataggtttgttaattgactttctaggtctccaccgtcaatgttgatttctaagccgcatctggaagcaaatgccatttccagtaaagtgattagtagaccaccatcagacctatcatggtaggcaagcactatatcctccttttgttgatgcaattggattaaactttccaagaaacccttcaaaatggcgttatcatacacagtaggcgacttgttaccaacttggttgtaaacttgcaacaaagcagaggcacctagtgacttagtctcttgtttagctgatagatcaaccaagacaaggacagaatcatctgtgtttctatttagcaatggagtccacgttttactagtgttgaaaactggtgcaaatgctgtgatattcaatgacaatggtgcagtaacttccttatcatcccatttcatcttcatggacatggaatccttaccaacagggatagcaacacctaatgcaggacataaatccagacctaatgcttgaacggcttcatataacttagaaccctcaccttgatgagaggctggagacatccagttagcagatagcttgatatgatttaaagatttcacatcagcagcgaatatgttcaataaagattctgccacagataatttagcggaagcagatgcggagattagggcgttaactggtttttcacccatagccatggcttcacctgtggaaattattgtctcacccaaagaggtaccggtaacaccgacatccgcaacaggtacttgccaaggaccaacaaattgatccctatcaattagacctgtgacggatctgtcaccaatagtaatcaaaaatgactttgagccaacagatggtaagtttagaactctttgaatagcatcttgtagggaaggaatttcgctcaaatttgcctctggtagatttagtgcttcagttatggtttctcttgacatctttggaggcttaccaaataaaattggcatttctaaatcaattggagttgttttcaaaagaggatcttctacaatcaatttttgttcagcggttgcgtgaccgacgacagcaaatggtgctctttctctcttacagatttcctcgaaaatggataagtcttgaggagaaacaccaagaacataacgttcttgtgattcattacaccaaatttccattggtgacataccaggttctaaggagaggacctttctaatatcgaatttagcacccaagtcattgtcatgaaccaattctggcaaagcgttggataacccaccagcaccaacatcgtgaatagattggataggattattgttacctaaggcaacacaagcgtcaatcacttgttggcaacgacgttccatttcggggttccctctttgtacagaagcaaaatccaaatcggcggaaccttcaccggaagctacagaagaagcagcaccaccacctaaaccaatcagcatagattgaccaccaagtacaattaaacaagagcctggagttattggggtgttcttcaaagcaaattgaggtctaacagtaccgaaaccacccgcaatcataattggcttgtggaaccctctgatttcctccttcccttggtgattcaaaacctttgtagttaaagttctgaagtaaccgtttatacaaggtctaccaaactcattgttaaatgcagctgaacccaaaggagcctcaatcataatatctaatgcagatgcaatatggtaaggcttaccaatattcaactcccaaggttgttcattacctggtatcaaaaggtcgctgacagagaatccactcaaaccacacttagtcttggaacctctgcctgtagcaccctcgtctctgatttcaccaccagaacctgtagcagcacctgggaaaggagacacggctgttggatggttgtgagtttcgactttgataagtaatggaattctttcctttgtagaggtccattcctttgtagttgaatttggtgcaaagaaaaaggcatcattttcactatccaaaacggctgcattatcagaataggcgctaatagtatattctgggtttaatttatgggtatttctaatcatttgaaacaaggtgaattgttgttttattccatcaatggtccaatcagcattgaagatcttgtgacgacaatgttcagaattaacttgagcgaacataaataactcaacatcagtaggatctcttttcatagtttcgacgaatgcatgaatcaaatattccatttctccactatctagagctaaacccaattccgtattagctttggataaaatatcctttggagactgtttagtgtccttaggagttaaaggaacgtgaactaatggctttggctcttcatgtgtgaaaatactcatcgtatttggtggttcggtcagatataattgttgtgtcatcctatcgtagacacacttcaatgaaatatcatttagattttccaaaagagggaaacctggaacagtctttatgagtaaggctaaacctctttcaatacgttgaactttgtcttgtagcccgcatacatgagcaatattagtagccttggaagaccaaggagagatagtgcctgatctaggaacaactctaatcaaatatgtgtcttcgccaagagctgaactgggtaaattattagcgacagcatcgtttaattgtcttgctaatggatcgttagcaatatctaaagcagaatcgtaagtcaacaaaacttctagcaatttagtgtcctgttcagacaaattttgagcgatgccgttgacatagtgaatgtaacacgaacgcaattcattgatgacagaagtactgtttgtataggagtttatatctttaattagattatcgactctgaactgagataaggccttgggacccggcaaaatataatcagtcattgaacttgacttcttttgttatggacctgggaggattaaactcttagggatatcgctaagataaaagtagaagagaaatatacttcgaggcagggacagccaattatttaaatacgtatgtcaaggttttcaaagaaagaaagagttaaatagcaagatatattgcatttattacggcatcatctgtttaatgagtcctcattcaatttttttttttttttttcaatttcaagttcgacgagaaatttggaaaaacgggtcagcaggaaagagtcaggaacggttgaaggatattgaaagtcatttttgtttatttacaagctgatgtagaattacatatcctatctatgcgtcagcttcactcatcgttggtaaggataaatccaatttaatatgatattttgcaccagggagaatagctgtgatgatatccaatagagcgaaagaaggaatggagcctgtgaggacattgctagcataacgacacaaccgagtctcgatacgttcagtatactagtcattgcctcttggactcttgtcgaattccttgaaattgtctttataccttgcgatgacaaacttgagctaaacatcagtcggccattgagttccacgtttaataccgccagagtccccaccaaaatgggcgctagtagaggcattgctactagcggtgagcttagatcaaaggaactgaaacccagtgcggaaaaccaggaaggataaaaactttctataagctgtgtctctgttagggtcctgatgcccatggagactgtgacccaaagaggaatttgcaccattggcagtaaggcatttttccataggggtacattgtacttcttgaataattttttctgcctctttcttgtctctttcactgccaatagtgtaatttgttctggtgtcaaaacgccagcattctgtagttgtaacggcatgaaagaaccgttggagctaattctggcggcatttctagactttttattagtaacggctgccagtcgaagtttaataatgggcgttattggctgtactaatttcctcagttcttgttgtttcaaaattctcctccgctgccatatactgaatggcagcgtcacgagggttctaagggtcatagtagtcaaaggaacaagcactatccatggtatatgtgaggcttcatgcactgttaaaaacgtgtccgctacactttgaaaaagtgaaaagcttctctttgtacttggattagtcctaccatatcgcagaccgactgagctgcacgagaatgacgcaaaaccattttgacgattggctaacctctttaacataatgccatactttatcttgaaattttcctatccttggaccttttttttctaatgaaagtctttttagccttagttgaattactggacggtagaaaaattgggtttgccagcaaaaacaaaagtgcagaacgttaaataaatgaaagcataaactcatatgctagaatatttactaaaaaaaaaaaaaagtaaaaaaaattcattactattatacatgtgatatcagaacggaaggttttactcaacttgactgccatccctcggtttgtagtgaggcaacagctccacaacctcagctggtagtctaccatcgaccttgatggcgtacataccagctatactatgatctacgctcagccactttgctacccacgacttagtaggcttacacattcctacgaggccctcgaaagaaggcgacgtacattccattgtagaaacacctgcctcttcaaaaataccctgacagttgggacaaccatctctattaaactcatttgtggtctgcactatgccacacagcatacaggctctttcactagacatctcttacactgtacctcgttcgcttttgccaaactgaatgtggccaggtgtaattattacacagtacatccttcgagccctttcttaaatttcactttttcactcgatttcactcatagaacgtataaggtgacctttatcaacatcgagattaattatagatagaagatgattaaattatatacatgaatatatttatttgaggtatggtgtctaaagcgtaatatacctatctacttcacgtaaattggactacgaggaccgctttaaatagtagtaaccatctctttcctccatatttttctttacaaattctggaagctcttcacccttattactatcatacaagatgataccattacctagagcatgtttcttttcgtttctcttgtaaaaaaaaagtacaacaaacgtccataaaccgtaaatagcaccaaaaattaagctcacggtgtaaccagtcttaaaacgtggtgactccacggtaggccacgccaaggtaggaatccaggcgtaagtggattgagagaaggaataaatggcgatccatgtaatagccttcacctgaggatcaaaccttaagaagtcattaataaacgaccatagacaaggcgatgcggccacactgaaatacgtggtgaagaaagcgtaccatttagctttcgaaggaatatcccacttgataagtaaggcacaagaaacggtattcattatagcagcaaaaaccatgaatatccacttacatctaaataaatcggcaccaaaggcacaaaaaatcacatacgcaaatcctaaacatgcgggtataacactcaggttgttcacttgggcaatggagtactttgtattagactttaaccacaaagtatatgaaccactatacgcagtcatgttattccacgaacatgtatcaaaaacaacaagtacccagaatgctggagtacaaaatactttcttccaaagttttctgctccataatggggctagcttacttttatcaacaccatctttgatttggttcctcttatttctggcccttgcaattcgtatttcttcgtcagtcagaaataaagagtaacacttagatggtacaccgggaataacaaaaaaaccaataatagccgtgggaagagaaattgcaatggcatcgatcagaaacatccatctccagcctgctagaccatggacgccgttcaaacttttgaatatgcgactttgcagaagtcctgaagtcacggaacccaattgttgcccacaaaagaataaacagactcttgaattaatttcatctggggcataccaacaacctagtatatattgggacactgggtagtaagcagcgccaaaggcacttaaaataaatctgtaagcccttagttcggctagtgagtttgccctataacatgcaaatgtgaaccaagtccagcccaagtccattacaggcaaaataatatgagagggaaatcttggtaacaaatacataaatggtaattggaagacaatggcaccaacattagcaatagtagaagtgtaaacgtaatcattacctttcatgtttaaatcttccttcatattggaaacatatgcgttagtgtagttattcaaatccactgacttggaccaacataacataaaaaagtataaagcaataataatgtctagcttgtaaagaagccgtctttcagccttggtttgagtagtatgattaggatacaaaaactcgtaccacttacgtgatttcttgtattccttattaacacgatactcgaattcatcaaaatatttccaccatttacgcccagcttcatctctcacttcatatggcaagtcatgccttaaattgtgaggatgaggttctacagctgtagtttctgccgtaacgtctgtcttcgaggacttatctacgctatgatgtagctcctcttcagctatgatactggagttagtatcgtctgagtataagtactgatcatcttcgggtagttttctcaaatgtgggaagtagctcctccacgatttattcgaaattgtcattatctattgatttgtgtcggtccttttttgaaaattgaaacaaatgaaaaggcgattgctcgtgggtgtagagcctttatatatagttatgttatagccgtaagagtcatgcagatttttgggaatggctatcatcaaacttagccttgcatctcatatttcgactttttttttcatttcacacatttttttttcctttcacagttgggtgaaagagtctcggaggcggtacggcgctttctgtgtaaatcatcctaaagtgattcataatctcagagccatttcgggtgaactaatgatgattttctagtagactacggcagtatcttagctgacgcaattgtagcaatggaggcaatcatgttagtaaaggacattttagttgtaggagcataggatcgacaggccatgtgaaaggcgtactagcaaagattgaagtaatgagaataattgacgatgattttaatttgagcttttcaatgcagccgaattcagcagtagttgcagaaccggactaacacttgaaaaaatcccacgagccagctgccgtctaaggatattgtaataaagttgggcttaaactaaagtttttatatcttggttgtaaggttgtaatcattcgtctcaagaagaacgttgagtaatcattagtcctccgcataagtaggttgccaataacttgttcagcaatgatggttgcagcatatcctcgctaacgttttacttaccaaatattttttgctggtgattaagaaagcttctaccataagaacactatgtcaatttaaagcaataatgttttcctgagtgttcttgagcctctgtaaacgaatcatcaattcaagtatttttattttattgcaaggatatcgccaactaattattaaccggcactaatgatagaaatgtttttatttcgaactacaaaaagggcatacatgacgtggatatatgtaaagggttactagtttacttattgatgtaatatcaagaacaatgtgcttttaaaagagacatggttgacgagtaaacaaacatacattggtaattctataagggtctttaggcaatttcaaatccacttgagtaggtgttcaatgcgtcgcagttggttggaacgagttcgagtttttgaaacaattcacaagcgggatgatagtagtagccttccactgaacctgttagctggtctaaacacacatagtaaaatccctcaaatgacgcgccttccagatgatgattatcgtccaacatcagattttcttgttcctcatcatcaagtaggaacctttccttccatttaagataaatatatcgttgattcataaattctgcactttcatgattatactgaccaaaatttctttccgttaacgaccagttatcagaaccaaaatgaccaaacctcttccaatgagagcaatcactttctctctgagccatataagggtcgagcgtctcctcagcgggccaatgcagtgaacataacgggaattggttataattgatgacatacccttcaaaaagggtaacaactttatctaggactggtgttaaatttttaatagtgaaagtacctgtgacatgcgggtccaaagaacgcgaatccttgtaaagtggcaagtttacggtatcaatcttcacttccaccgtataatacgtgtactttgacgattgcgaaccgccaaatctcaatcctggcctcaaaaaatctaaatgtctaccaagggatctgtaggtatatttagcattcttacccactaaattggtcccttcctcgtaaacatcacagtcctcttcttttgctttgaagtgaggcaaacgtgtatcagttgaggagggtagagagacataggccgaagtatatatttcttcaatgttgtcatttcttttggccctttctagaataaactttcttcccatgatattcagtgatgtcatacctacagtatattttaaatgaaaagtctcataacacaatacgaaaggataaagataactcgtcgatggccatcatgattgccctttttatatgtttttatcaaatattaaactaaacaacatatacaattacatcatttttccctactttctttttctgtaatggttcatcgaagcatttttaagggtgccctgaagactattgttaaaaaaaggtaccgcatacattcgaaccattaccagaaaaaagaggggtgaaaagacattctaaattttgttatcgaatgtgaacagaacacttaagaaaacgccaaggttaagaaggccttgagagtattgattaaggcgcatggagcacaggtaaacgcgaaagacgttttgtacttccttttactgagcacctcttacatgtagtagtaaccatcgcagcggaataagcacacaaaaaatggtatttacttttaggcaaacttgtgggaagtattaaaattattatgtagatttatgtatatcgtttgtggttgtattaaactttaatgttattagtgttgttaacaacatttctttggccattattttatttggctaaaaatttcaatgttttaactttgtttattgtcagttgaagaagctgagaattcttgtgattccatgtttacctggggtgggaccactattgtttggactaaattgatattgtttcctgttgcccttaacaatggttgttccttctcttgttgcttaggggccgagttcacgtaggtgtaattactcgttgagataggttcaatggcttttatatctaatgggggcaggagaatcttattacagtttgaatctctctttaggaaattaggagagagtggcaaacatgatgctactgaaaacgatttcatatcagaagcaccagataaagaacctcttgaagtcttgcgaaacggctgttgaagagcaaaacaagaccaattagagatatcagtcaacaatgctttcgtctggtcattcaggtgaggggagtagattaagtatgggtaaagaatattatctcttaatgaagatacaatagcatgcagtagtatatggtaagcaatgaaggaatctgaccaaaaatcgaacaaaatggagtgtaagtctgtcaccaagttcttttggtgtgttataatgtagtcattcacaaacacttcaaccttctcaaattcctctttctctgttgatgaaaggtagctctgacgttgtacataaatggtatcgaaccagaaatataacattaggtgaacattggggtttactagtaattgagatacttgtgatggtgaaacatccgagcttgcaattaactccgatgaaaacaattttagttggaagctgacaatgtcggtaattaactgaatattccttgggtttaaagatgccagcgtgaaagacttcaaattaagaagcattgatatgattgataagttcgtggtgatcaaggtttcatcaacaaatgaggaagaatgatgaagtaagcacgaggtcgatacctgtggaaagttatcaatgaaccatatgttccttgtggtcccatttctcaaagtcaagttgttgatgaattcgaaccaaatcgtttcccacaataaccagttacttttcgatttgcagtccgtaatcctggcgttcataacgttcgcaaataaagaggggtttgcactagtttcaggtttgatcggctgctgcattacgaaacattcattcaagtaaaccagcaaatcatgcactctaaaatcagatggcagctcttgcggataagtcttctttattataaaatacacgtacgcggaatctgccaaaatattgatatgctttaaagttaagtcagtagtggacattgacggtcccttgtatatgaagtccttaagtggattagacgaaataaactcttgattgacgaaccaaccaaatattagtaaagaatcgttgttgaagttgtttgaatcgcgcaagatattgacccatagatcgaatatgaaccatgcattttccttactattcaaataatggtaactggaggatgccacggtgaatggcttcagaatatcttgaagcattgaaaacacatcgaactttttaatggaattagaaacaggaatgttattctccaacattactagaagagaataaaatagaatcaaggcaaaaacatcatgttgctctgtctgtgacaaaatgtcctcagtgtcaaagtcattgtcatgtttagatgagctagcatacaaattcgtacaacagataaaccatagtttttgagaatcttgatttaacgaaatggacatacccagacaagctattatgagaccaaaaggcttgttaatccaaaaactttccaccagctcgtcattttgtagtgatgagaacaggtctggaaagaaattttggaagatcttattttctaccaagtggcttacacccattctgaagaaagttagaatatctcttgagctaataaaatctaatgaatattcttgcaaaatttttacactgatggaggactccaaccggcttttaacctgcttaaagcggcttttccctttctttaaactagaggactccttcccaatcacacaacgttgctgcttatccattttttcaacattactactatgatagtgaatattgataaggccgctgttgaccttaatcatcgaattaacgagtgtttccattttgatatctctgggtgaagtcgaatcaacgtcaccaacgccaagtgatacagggatatcagccttatcgcctgtcattgacgcgtaactggataagaggaaggttctgtggacagtcctgatgtgtcgctgtaagagatcgcgtctaacaaaagagtgtttacagacttggcactggaaaggcttcacgcccgcatgagacctttcatgccttatcttgtgctcggatctcgagaaaggcttcaaacaaaaggaacatatatattttttttgacccgcagccatagcagtgataatgcaaatacaattactgtatatcaacaattgtcttctcccgagagaaggttttaaataaaagcgacaagtaaagctcttaagccatgccaactggcatgaagaagaaccgaaaaagaagaaatagaaagcagaaaaatgtaaaactaaactttataagtactttgaagatgcgttctatataaatatgtggggttaagtgaacatgactcgaaatctataatgcagcgattacgataagtatccacattaaacgtcaattattttgcgttgtaagcatatgcgcgggggagggggcgcacccttgaagtgcagtctgtctatcatattactgaaccatttccttcgcttgacttacatcattggcaacacatgcctggatcgctttagcggctacctttagtccatattttcttctattaccagatcccatcatccccctttgtccgattgacgaccattttgccgcggacgatcggaggggattgccaacgcggggtagccgactcggggcgccgagagcggggatcagtcatcgtcgcagtaagcgggtacggaccctgtcacgtaagacgatgccgatgcctgcgcctgcgcctgctcgtatgacggcactgtcagtaccaccgaatcggcgccgagcggctgtagcgccggcatgagatgatcgttggtgctctcgtgataattcggtggcggttgtggcagcgcgaggtgcgccgttgtagtggagttcagttcaacgcctggagtcagaccctgcgcggggtaagtggttaaaaaaaggggtactaattcgccagggcggaagtggatcttgccatcgtgtttatcaaacaacactagacggcctttcataggcagatgcggcgaaataaataataacataggtaattgcgccttgatctccaggttcttgtattcgccatccacttgacgttgtaaaagaatacgtacctgcaatttgtgcatgacacggattaggttgtcttgcagacagcagtcttgagttatttgtttgaggttatctggaattgtaaagggacaatcgacgtcaagtttgtccgtcagcgggccgaagtccgctagatgagtaattttcatgacggctatttcatcatcataaatttgtgcgctgctgtccttcattgcgtaatattggattagcgccatttctatcctatccaaacgaatgttcttttcgaaggggaaaatcttaatcttcacgggggttgtgctaccaataggaacagccctactcgggatggacgtttcgtattgcaacttgtcacgccaagtattacccacgctaatttcttcttgcatggcaagattgtccatcgataatgtacgaaggattctgagatacttgaactttttgatgataattttattcttcgttctcataccattgccgctcgtacttgtgctaccgattggaccgtgaggagaagtatgaacgctcagatcagtatcccataactgacgtccatctataatggcttcaaaggaatacagtatgctaccactttgtagtccctcgattgtttcgcacacttctggggggagcattgtattgaagggtagttcgtagttgcctcttttcattaggaataagtacgaacttccagacccgtctctgttactataactatggctattgttattgagggtgttactactactgcttctactacgggcgttttctcttaaaccctcgaaaggggttcctgtaacaccattttctggtagctctagtatttttctgtgggaagaatgggtctttcttcgaattattttgttgaaaacagggctcgaaagtgatctcttgcttagaaatattgcgttgccgctggtgtccatatcttggttgcttgtactgcgaccgctactactgttatgttgattttccgcattttccccaccgactaaaacatccccttttgaagaaaccaataagttgtcccaatagcattcgaaaatcttacgcttttccttaactagacttgccaaactactgctattcttcttatatcggccaacttgcaaaaactccaatttgaatcttcctaccaatctcagcgaaattttcttcactacgatctcatttttcactgaaatcactaagtttcctgataaaggtatagacgacagttccaacggtgacccttggatcaaaattatgtccttgtacggggagtttattctaatatcaaaataacttattctctctctttccttctgctctgaatgcccaccgctgctagatagcgaactaagtgaaaacatggtcttgcttcaccctattctcgccgagagctgtacaagatattttttacttttgccatcttatactcatcctaatcatctgtttcattttccttctatttcttttttttttttttttttttttttttttttcagttttcgaagaaactgcctttttagaattgtaaaagacgaagtgaagtattcaggagtatattattacatacatacaaagcaagacaaagaaacatttttagatctaacattttacttcaattgtttttgtattccttataataagaaagacctgctgtttaatgtgggagtaatccgtcccctactcgatcttcaataaattgtcatcttgtatctaaaggagcgctccagtactccaattaagcaccacctagtgcgtctagtgtcgatttttttttcacgcatacgtttgtatgtttcttaaatttcccatgattttttgttgccaatgtcatatctacaaactctatacgaaagtaaacgcacttcatcttttttgccctaaaacggcaatatttagacatatcataaggggcccaagggagaatcgttaattttaaacttttctttgctcttgaatgaaaaagtaaataaataaaactaaatcaaaaaaaagaacgccacgtttgaattttaaagcaaaaattttgttgatttagtaatgatataaataaaaccaagtcgttggtaagaatttggttaggttatgaatagtaatgaactggatctaagaaataaatatttttatgagatattcggtaagaaaagaaaatcagatacttcaacccctactcagttgttctccggctccaaagttcagacaaacatcaatgaaatttctatcactaacgatgaggatgaagatagtactgaagatgaaaataaggcttcattgaaggattatacactagggcacgacaccggtgcacggtataggatagcaccggactgttcttcccaccaattaaaggcatctcctgtcctacatatttcaacaaaccttaattcaagtccacaatccttcacaggcgatcagatttcacctactaataaaaaaatttcaataaatgattcgaccagacaagataaaggtaacagttgcactaccacttcatcaccttctcaaaaaagatcgaatgttttgcttcctcacgtaagaaaacattcatctccttcactattatcattttccaaaaacagtggcagtcatatgggggatccaaaccagctatctacgcctccaactcccaaaagtgcaggtcacacgatggagttacacagttcattcaatggaaaacatagttcttctagcacctcttctttatttgcattagagtcactgaaaacccaaaatagacgctcatcaaactcttccaatcattctagtcaatatcgacgccatactaatcaacaccaacgtcatcattcaaggtccaaatcaagtcctgtctctctgacggaaatatccatgatcaaaggcacgcctttggtttatcctgcacttttatcactaatagcaattaaattcaaacagaccatcaaattgagcacgcataaaaagatggggttactttacagagattcctttacaggaaaacaagcaattgatactttatgcttgatcataggaagcttagatcgtaatttgggcatgttgatcggaaaatcgctggaagctcaaaaattgttccatgacgtactttatgaccatggcgtaagagattctgtactggagatttacgagttatcttcagaatcaatttttatggcacatcagtcgcagagttctacttcaattgccaacacattttcttcatcatcttcttcagttaattcgctccgtactaaaactgaaatatatggtgtttttgtcccattgacacattgttattcctctacatgctctctggaaaaactttgctactctatttcttgccccaatcgtttgcaacaacaggctaatttacatttaaaattaggtggtggtcttaagagaaatatttcgttagcactcgataaggaggatgatgaacgaatttcctggacaaattctgtaccaaagagcgtatgggaatcattatccaaacaacaaatcaaaaggcaggaggcaatatatgagttgtttactacagaaaagaagtttgtaaaatctttggaaatcatccgagatactttcatgaagaaattattagaaacgaatattattccatctgatgtaaggataaattttgtaaagcacgttttcgcacatatcaatgaaatatattctgtcaatagagaatttttgaaggctttagcacaaaggcaatcattaagcccaatttgtcctggaattgcagatatatttttgcagtatcttcctttctttgatccttttctgtcatacatagcatcaagaccatacgcaaagtatctaattgaaacccaaagatcagttaatcccaattttgctcgttttgacgatgaagtgtctaattcttccctgaggcatgggatcgattcattcctatctcagggtgtttcaagacctggtagatattcactgttggtaagagaaataatacacttctcggacccagtaacagacaaagatgatctacaaatgctaatgaaagtccaagatcttttaaaggatctaatgaaaaggattgatagagcaagcggtgcagcacaagatcgttatgacgttaaagtgttaaagcagaaaattctattcaaaaatgaatacgttaatctgggtttgaataacgaaaaaaggaaaatcaagcatgaaggtttactctcaaggaaggacgtgaacaaaacagatgcgtccttttcaggagacattcaattttacctactcgacaatatgctattattcttgaaatcaaaagctgtaaacaagtggcaccaacacactgtatttcagagaccaattccactccctttactgtttatttgtccggctgaggatatgccacccataaaaagatatgtgacagaaaacccaaattgctcagcgggtgtgctcttaccccaatatcaaacgagcaatcccaagaatgctattgtattcgcctattacggtacgaaacaacaatatcaagttactttgtacgcgccgcagccggccggattacagacattaatagaaaaggtgaaacaagagcaaaaaaggctccttgatgaaactaaacatattacttttaagcaaatggtaggtcaattctttcactcatacataaatactaatcgcgtcaacgatgtcctaatctgtcatgctggtaaaattttattggttgcaacaaatatgggactctttgttcttaattatgctacatcgatcaatcaaaaaccagtgcaccttctgcacaaaatatcaatttcacagatctctgtattggaagaatataaagttatgattcttctaattgacaaaaaactgtacggctgtcctttagacgtaatcgacgatgcagaaaatgcagattttcttttcagaaaaaattctaaagtgttatttaaatatgttgcaatgttcaaagacggtttctgtaatggtaaaagaatcattatgattgcacatcattttttgcacgccgcacaattattgattgttaatcctttgatatttgattttaatagcggtaattttaaaaaaaacctaaaggcaggcttggtagattttagcgttgattctgaacctctgtccttttcttttttggagaataagatctgcattggttgtaaaaaaaatatcaaaatattaaacgtaccggaagtgtgtgataaaaatggatttaaaatgagggagcttttaaatctacatgataacaaagttttagcgaacatgtataaagagacgttcaaagtagtttccatgtttccgataaaaaattcaacttttgcatgttttccagaactctgcttttttctcaataagcaagggaagagggaggagacaaagggatgttttcattgggagggggaaccagaacagttcgcgtgttcctacccttatattgtggcaattaatagtaactttattgaaattagacatatagaaaatggagaacttgtccgctgtgtacttggaaacaagatacgtatgttaaaatcatatgccaagaagatcttatattgttatgaggatcctcaaggatttgaaattatcgaactgttaaatttttgagttgaccgcccatattaataccttaaaacttatttcttgaacctatacatctaaatttaagtaatattattttatttgtataaccatatgtagtttacctgaaatatatgggtgccattaagaaaatataatacaatggacaagaattttgtcctagaaaataaagtcttgaaagtatattgtcctttcctttggaatattatgtcactagcaagcatcgaaaattgatccagagtgaaaattaattttttcgagattaaactgtgaattcaaaagtttgattttaattgtttcctcactcaacttggtactgaagtcttgattagctgttagagaagataattctgaccgtattgaagatgtcgaatttactgaaagcaactgaagtaaaatatcgattacttcaatcttgtttttactgcttatgtaattattccaaattgaatccgagataggaatatgaatatcaaatgtctcttccatgggatttaggcaccattcccccgagttagagtcgttttcctcagataactcatgttttgtaaagtgagatccatcgaagctaatatcattatcatttaagtagtcatggtatgcattaggcagctcatgcgcaattctgttgacatagcgtaatagatcatcccgaatgatttggacaagtaatgaatcttctgttagtggtgcggttaacttggtgttacataaaagctctacgtcccgtgattctttcataaaaatggcctcgtagtcagaaagaagattattaccggaattccgaccgctctccccaccactattagaggaacgaaaattagttatattgataaagtttttaagataccttagaacaattttggtcatgttatgaactattttatttaccgatgttgtgccaaagatttcatttagaaggcttttactttggaagattgatggatacaggaaagcaccaatcaagtttacatcatcaagtaaataaaggtctttaacttttagaagccttgctaggattttttcaaagggctttttagatttggtgaatttgaagcttcgtataatctctgtcaaatataactcaaacttaatgataaaaaccaaggtatgggtaaatttcaatggagcggaagaagcaaagtactcaattgattgctcgaaagttcttaacgtctcttctaccgtgtttattagacgaaaatcggattcactaagtgattcattttctaaatgagagttgatagacttgaagaaaggaactaagtttgcaaatttttctaagatactcttcaaagctgaaaatctatcgcagttacaggaaaggattgaagtaagttcattgcagttaggttgtgtataattttggcagtataataggaaatccgattttagggagtcgtttaagttaacttcttctatcaaacagcatattttgccgagaatagtagatgataaatcaatatgggaaaaatctattaatgagtctaacaaagagcctcctgaatgattttctttggccacagaaaaggaagacagcattgattcagtaggaacattaaacaacggctgtaaaaaacaatgaagtaattcagatactatgcaagtatggtactttatctccctcacactcccgctatggaaagtaaaattatgactgtttctattctctagtaccattgtataatggctttgaggcaaagttatagaaatcaccgatttttgtaagccagggtatttcgaatacaaattgttgagctgttcctgccagacactaatatctatatccgttgttttacgtacaaaaatagataatggtaaacccttcgaaactttgttggtattatcgaacagttgcaaagaaaataatgatctttttccagccagttctgtaaaatttacagaaataagatgggataagtccaagttagacaattgtgcccgaatttccctagaatatttcaagtaaagaggttgatttgattccttactatcggataaatggatagtaaagggtaattgtgtatcattccttgatatagaccttctgatcaactcatcaattgattttgacaaccctataattgactcctctattatattggtagttaaaggagggatcctatgaaattttgataaaagagatttaaaggacacattctcaaagaagttcagcggtaaattttctgaggctatgactatggctactaattgggaaatagaaaggtaattactgctctgtaattttcctatgtcaaagcatttgaaactttggtcggaattgaaggttaacgaatcatagccgtgtctacgtgtaatttctgtgctggaagtattgtttttgagattggagtctcctactgtgaaattcatggaatagaagtttttattggcacttatattatgctttgttttcaagtgagatctaaaggtttttgtcaaacttgcatcgcttcttgttagtatctctccacaatgtttacatttaactttcgttaatttcttttcaattgctagaaaatgggaccagaactttgctatattcttcttgagcatttgaaccggaatccatatatttaacccatcatttatgatttcgtcttccggatgaattctacttgataggattttattgccgtctttttctataagttctatatcctcagtatcgtcttcttcctcgtcttcctcctcatgactagtagagtgagaagatgaatgatcagaattattgatgatttcgttatcttctaaagtcaccaaatccccatgtaaatcatccaatgcagtgttcatattaatgattgagtagattggtacatatgctatttcggaagacttttgttattctatggtttatcatccctttatttattttgtgtattgtttgctgatcaaaagttgaaaatttttcgcctaaaaagtaagatacaaaagaaaatattgtcgatgattattgcatgaatatatcagcaaagaggaaaggaaaacctactgagggacttacatttctgctgaaatatatagtaatctatcatgagcaatgtggctggggaattgaagaatagtgaggggaaaaagaaaggcaggggaaataggtatcataacaagaacagaggaaaaagtaagaatgagacggtagatcctaaaaagaatgagaataaggttaataatgctactaatgctacccacaacaatagcaaaggcagaaggaataacaagaaaaggaacagagagtattataactataaaagaaaggctagattgggtaaatcaaccgagaatgaaggatttaagcttgttattagattgctacctccaaatttgactgcagatgaattttttgccatcttacgagataataataacgatgatggtgataagcaagatatccagggtaaactcaagtacagtgactggtgtttttttgaaggtcattattctagtaaagtattcaaaaactcgacatattctcggtgcaatttcttgttcgacaacttatcagacttggaaaaatgcgcaaatttcattaaaacttgtaaattcattgataataaggataatattacaattccagatatgaaactgtcgccctacgtaaagaaattcactcaaacatcaaaaaaggatgccgcgctagtaggaacaattgaagaagacgaaatttttaaaacatttatgaattcaatgaaacagctgaatgaaaatgacgagtactcattccaagattttagcgtattgaaatctttagaaaaagaattctcaaaaagcatagagttagaaaataaaatagcagaaagaacagaaagggtgttaacagagctggttggaactggtgataaggtcaagaataagaacaaaaagaagaaaaataaaaacgccaaaaagaaattcaaagaagaggaagcatccgctaagataccaaagaaaaaacggaacagaggcaagaagaagcgtgaaaatcgtgaaaaaagcaccatttctaagaccaagaacagtaatgtggttattattgaggaagcgggtaaagaggttttgaaacaaaggaagaagaaaatgcttttgcaagagaagttaaaaatatcaaactcctctcagcctcagtcatcatccgctcaaacccagccgtcgttccaacctaaagaaaaccttttcgtaccacgggtaaaaattttgcatcgtgatgataccaagaagtagtaaaagctcatggcttcttatatattatatatggaatacatttataataaaataataagaattatatattttatgattatattattacataaagtattccccattataaattctgagtttcgtatttaatgatttttcaatgaatatttaaaataataaaatatatgaaatgttcatatacaatgaaattgtcatgaagaaagatgactccaagtatcgtttataaatcgtcgagaaaaagattatgaagttggttaactttttaaaaaagctgcgcaatgagcaggttaccatagaactaaaaaacggtaccaccgtttggggtacactgcagtcggtatcaccacaaatgaatgctatcttaactgacgtgaagttgaccctaccacaaccccgactaaataaattgaacagtaatggtattgcgatggctagtctgtacttgactggaggacagcaacctactgcaagtgacaacatagcaagtttgcaatacataaacattagaggcaataccataagacagataatcttacctgattccttgaacctggattcacttttggttgaccaaaagcaacttaattccctaagaagatcgggtcaaattgcaaatgaccccagcaaaaagagaaggcgcgattttggtgcaccagcgaataaaaggccaagaagaggtctatgattcgctgctggtgtcgttgtcatcttcactgtcaccattactttcgctttcgctagaactactctcttcatcagagttgtatattttattccattgacatttccctaatggaataccccagatatggtcctgtgtggccaaccaatcgactaattcatcaatgtgtattatacaaagttcttcgttataggagtgagcaaagcagtctacttgtagtgggaaactttttagtttgaaataatgctgtgaatatttgtataattgtactttaaataactttatcaaatcattttcatcatcatcgtttttgttattgccattcaaataataatactgtaaccgcgcataaaccagaagcaaagcaataatatatttcgagtcaaaaccgttctcattttttacattcaataagaagttcaactgctggaaattcggtctgatttcgattaacttcattaagatgcatttaaactcaatgccaccgagaaccatcatgtgtaaatgaccattttgaccttttatggtaccaaatgcgccaatcataactttcaaaagctctaccattgtattgcctctcaaagattcgttgcttagatttactttatagtacattgaattatgaattttatctcttgtcaaccgaggaataacaagtgacactgactggttattcagttgttttggagagatgttagactccacttgaaattcattgacagccattgtagtccttgttctttacccacgttttgtttttgttcttgcgtttttactgccactgaaaatatagcgttgtaatggctttagattttacttttttttatcataattcttgttcagaacgttcgttattgatatcacaaaattatttacatgattagacattaaaaacataaaacagtacacatagggtttactattctaaactatagttatcttctctcttattcttcagaaccagcctatactttggttttttttcattttttctactctcttggcatacttcgaacccttcttggaagcaatcaactcatctaccttctttaaagcttcttcacgtttttttagcttttcgtttaatttcaattcatgcttatgacccttgggcaagagaacacctttcatgagggtctttttattgtatttctcctcgaagaaaagtttcttagtgttttcgatcggtggtaaaaactcttctactccataacgcagtgccaacttatatacgtcactcattcttctaagtgaatatttcggatcatgaaatcgttgtgtgaccggatgtttatttggcaggaaaggattggcattaatggctttagtagatgtagacactggagaatacttgattgaaggggggtatctttggaaaaaggacttcaatttcaaaggcaaactatcaaaatactgtttgtatgacatggagtttagtttaatgcactagttggttttcctattctgtataaatggttcactttatttcgtatttcacttgctcttccactttcacttgtatcccagtcattttttttttttgtttgagaaaaaaggaatataaaaaggcgctactataaagtacttaatgatactataatttagaagattgacttgataagaccgttgtgtaccaccagtcgatggctagggaggattctagactcgaaaccatttcccacaattgttgaagtagctttttgttatgtgtattgattagctggagacagatgttcaaccagccgatcaaatgatgaggattgttgataaaggctatttgtacaatcagacattcaatcaatacattcttcttttctgggttttttacattaacaattctgatatacgtctcgtgcaaagagtccctaagcaaatgcttgttataattatgtagtgagggaagttgtgtggatagatggccgaatataagtaaaatttgatttgcggacaatttacctgcaataaattggtccatcgacatctttaaatagacgagtatgcgggatacttgccattgtgcaacctgtgaggaataagaggagtctatagacagtacagtgattgtcaatgtgtgtatagattctttgatttcaatatccaaggtattgcccgtcttcccgctaaaaaatacatcgaaatgcagtaaaggttcgataaactcagtaataaacggcaaacgaatgcgacacccatagtaattagtaattttgtttagaaaattgatgtaaaacactaatttatttggatcttgtttggtgttgtttcttttcattagttccaaaactgtagtgattttagacaagtcatccatgacaatgaaatacgttactaaattatcgtaaacataatcgtaactgggaaaaccgactgtcccgattttttgagtcaatacgtggacgtggaaaaggcttaaacagatcatagaataaaaagtgtctttatggttaggcagtattgtcatattcatggcggataattcttttaacgcgaggattatcaggataaatacattttggaacttgaaatctagttgttgttctttcaacgaagccacagtatcggacaagtatcgacatatcctttctagtttgcgtactgaatttaccaaagttgcctcatttgacctcgtgattgaactggtcaagcaactggccaaatgattcaagttggttgataagactgaatcagtcgaaaaaatttccatcggctgcacaatgccgtgtacatactcttccaaaaggtccaatagtttctctgtgaccaaattccatgatacgtcaactccatgcaaaagggcgcttcggtttgactgattaaaaagtaaagctaatgctatcagaaggcaatgctgaatcgataaattagccctgacaatggcagtattccatagctgcgcccatattggtgaaaacagttgtaatttccagtttctgtaataaagcgcagttttgttgctggattcatcaataaaataggcgttgttcaattgtttgaagctcgggtatgtgactagtacaccatccaaaaccatcaactgtgaaaggttccacgtggctcggtgagattcgaaaacagcattccaaaccaagtaaaacttcgaaattgggagcgtgggctcagaaacttccagtttccaaaggaaaacatctttgacgatgtgcaaaaggcgtagtggtggtaattggacaatgaactgcgatcggaaaagtgctccgaccaagcgatacaaagtgtcgggggatttgactcttgggacgtagtataccacattggccgcgatttcgtctagcaggcgttgatcatactggatcctcgtttcggaagagagtgcagtgatcagatattcgacgtcatgatcaaacataatgtcctaatgccctctgtaagtgcggttttgcgcgcatacatgcgtattcatatttcccttttgcatttgtcttcttcggttttcctggtagaatttcccttaatgggagagtagtaacaatgcaaaaaatgaagaaaattgagaaaaaacaaaaaagaaaaaaaaaaaaaaaaaaaaaaagagagctatgtaggttgattgtgttgttctatgtagtgccctttatttttctttggatttaaatttacagacacattatatcttgaggtttttagtcccttcttgagcctgcttcaagtcttgccttctctgaacgtcccagttatacaatcgcgcgcaattgacctccattgtcgtgatattttccctcaaaaactctacgtcctcggtggacaccgttaaagactgttcggaatccgcgagtttcttctttaacaactctatggcctcgtcgatgggatattccagcatcacgtctgcgccaagccacaacccaactttcaaatccgcccgatcttccggtatatcaacctgagcctttgtgtagagcgtgtcgttcaattggtagtgcaacaggataggttcatcgctctcatcgccctcgtcgctgtgattgcgcagactttggcatatttttaatgtgttttccaagtccgggattctagtcttcagctgctttatcgtagccaatttagattcctgcataaatttgtacttagaaagccgttcttggaacttattgaagcacaattcgaagtcgcttgggtccttaattatttcgttgacattttcgatgaatggagcctgcggtatgcctctggcattcttttccgtggagttgaacagtgtgtccataataaccgtagtatctgttatatatgtgcgtacagttttctgcagtaaatgttgtctacaatttatagcctctacaatagtgttaaactagattttttcactttcttttctgaccagttctgcaaaatgatcgaagaaacgaaacaaatcatgtgttacccgtcctgcacaatcatgagtgcctgcggtttccatattggaacggcaccttccttttttggaagtcacgttcctgcagcgcgtttcttttttttttttttttttttttttatttttcggtttttttcgcacgtttctttttggtgagcgagaaagctcgttgcctcctaatataaaggatgagatgagatgagcagtgccgcaaatgagggatgtgtttatttgttcattgtcgttttgcgattatcttcgttttcatgtgttaactcattcattcattcatttactcgttcacgcacacgcagcagttattccctcgacgagcgttcacttgtatcatatagcatagtttacgtagcaatgaataaaagcagcaaggcatttcaggtaccgaataaggtcatcaccaaggaggatattactcccttgtccagatcgcacacaaagaaagcggacactcgcgggacagcagatggtaaaaacaccacagccagtgcagtcgaggccaccccaatcatcatcaccactgctcgttcgatagatactgccggttcactatctgagaacgccaccgaggacgatggcacccaaaacggagatttacacgatgatgacgatgatgacgacctcgaaagtacgctcggctatagttctgagcctgatcctctcttctccccatgccaccagccttccttcaccaacagcacatttagttacagtgcggacaatgaactacccatggaggaaaatcacaacaagaataatttccacgatagcagcgagagcagtatctttctaccacagatacagcaatcattctttttcggcgacaatagcaagagtgacgcaaataatacggacttctggaaggaagtaaatggcactgcagaagaggccatttgcctgcaggagacaagacaaagaaaatgctccctcgtggctctgcatccaggcgacgccaccacgagttcgaacgacacattgggaatagaggacttcatcaaagatgatatcaacagtgctgaagccatggaaccctccccatcttcatcaccatcttcctcccttcttgataatttggactacaatatcaagttattgtgctacagagacaatgagggcaagttcaccttgaaaaaaaggaagtttttgaagaattccctgcgctcatcctctgcaatttctaaaaagtggaaacccttgtctaaaagagataagctgttgaagagggccataagaagaaagagtggtgtttgccagacgttatcagctggttttggtatcggtgaattcatgttgtaataacagtactattaacagtacaataaatagattctttttatacagtgttagggtaacttgtttttgtaggatttgaaaaatatgtcattataagatctatatcttttactatttggacaagttggctaatttgataggcaattgaataagaaggaactctgtatctcaacacatcacatgtctactcaatccggtatagtcgcagaacaagccttgctgcattctctgaatgaaaatctttcagcagatggcatcgtcatcattatagccaaaatttcccctgattctacctcggtacatcaaacgcaagtcgcacgtagcttcgaggagctggtacagttggcatcacaagaaagagaaccgttgtacatcttctataagccggaagggcttgataagtacttctttgtgtcattcatccccgatggttctccggtaagatcaagaatgctttatgcctcgacgaagaacactctggcaagacaggtaggttcaaactctttatccaccgaacagccattgatcacagatgcacaggacttggtggatttgaaaaattttgatagtgcccgtcctgctggccagaataagcccttgacacatgatgaagaaatgcaaatcgaaatcaataagcaacaggcacttttaaggaaaaacacatccgtcaagttggtttctcaggacagtgcttcgcctttatcgttaactttcagggtcaattctgagaaacctatcaatgaaatactggatagcgagggtaaaaatttaatcatatttcaaatcgatccctcgaacgaaaccatccagatcgtgcaatctgatacatgtccctccgtagatgaactgtacattgacttgcccgggccaagttacacgattttcaggcagggtgattcaagtttctttatctactcttgtccctctggcagcaaagtcaaagatagaatgatatatgcttctaacaagaatggatttatcaactacttgaaaaatgatcaaaaaatcgcatttagtaaagtggtagaaattggcgattttgtggaactagacaagtccttacttatggcaacaaataaagaagatagcctcgatcatggatccaatccagatctcccaaacaaaagcaatttgaaattcaacaaaccaaagggcccattgaggaaaagaagaacatagagatagaaatggcatctatatatgtgtgaccaacaatacatacgtttttattcttctaaatatgaaactgaatgtttttctaggtttgctggaatatatattacactggcaaaaattgttatgctatgctatttaatgttcattgtttttgcagcttgataacctctcttaaggcgccaaatggatttttttggaaatcttgattggttaggacctgattgaatcttgcagtttcgttagcagccaatgcctttgcacccttttggttcctgatatttggctgattcttttttatcctaacagaaccaggttctatctttttcaagttcatttcctttgtgtccacaaaccttattttagaatccatgtcgatgtcatcatcgttattcatgtctttgctactattttcaataatgccccgtaaatccttttcttgctccaaagaagtgagcagatcttgcattcttggttttagttcttctcttagctttcttttcctacgtctaatggaagatttagaaataccatcaaaattggcagctatgccatcgttaagtgtggatttccccttcaagttagataagaaagtattctgtctgttaagtagcttttcctttttagtttctttaggttggtgcagaaaggcccttggatcagattctatgtcataactctcgtccagaatgccattgttcgctacgtctggtccaaaattttgactatttcttgcacttactttgcttctaagcgtgtttctcttcttagcaaccattatcgcttatctatgcttctatattcaatggatttcctgtctcttatctctgctcatcgagtctgtaatgcttgagtatgtaaaacatgaaaaatttgcagtgcgtcaccccgttcagtttctcgcgccgaataacattttttatacaggaatatttcaccttgataatggccgacatttacgttatttacctattgtcccttcgcctagacctacaagaaacattgcctcaagtgccaccttcataaagtttattttctattatgtcccagtcgaaccctatcttacgtggcctcgctattacaacagccatagcagctctatcagccaccggttatgctatctactttgactatcaaagaagaaatagcccgcaattcaggaaagtgttgagacaaagggccaaagagcaggccaagatggaagaacaagctaaaactcatgctaaggaagtgaagctgcaaaaggttaccgaattcttatccatggaattagccaaggaccccatccctagtgatccctccgaaagagaagctacatttaccaccaacgtagaaaatggtgaaagattatccatgcaacaaggtaaggaactggaagcagcctctaagttttataaagcattgactgtataccctcagccagccgatttattgggaatttaccaaagatccattcctgaagccatttacgaatatattatattaatgattgccatcttgcctcctgctaatgtggcttctttcgttaaaggagttgttggaagcaaggccgaatctgatgcggttgctgaagctaacgatatcgatgactgagagtaacattttgcttgctttttttctccgtttttgtttcttttactctgtatatagccctatataattacatcatttctctagcctaaatcttgttatatataccaagctttttggaaagctaaggataaaaacaattcttttcattagatgtattttttcatcgtattaggtgtaatatatatatatatgtatatatatatatatatataatatatatgtagtatacacacgtggacgaccattaacgaatgttgtatatgcttatgcggaacctttgtactctcttaaaataacagggacagatgaaggtggcaaagcgccgaattcagtgatcacttttttaatatattctggtggtgttaaatcgtataagatgttgacaatatttaacgaaggtaactcttgccaaccatccaaaatatttttgctgttgctgtcttcttcattactggcgtccttgctttctccttcagatcctttcttaccgccaattttattaccctttggcttattctccattgctagctttttcttttcaaattttctttctttgataaattggtttaataacgcacctttattaccgcgtctctcgactggattttcgtaatctatattaaccaggtcatttggatctgccagttcattaaatgtgacactatccaattgtactctttgtgaaaacttcaaactttcgcagcagactaatacaggtatatttcttctcttagcgctcatagccaacattgctgtcccagctcttgaatataggaacccattagataggatagaatgggctcctaaaaacacatagtccacatccatattgaatatcgtatccaaacttgtaataagtgcatacataacattgacaccagcatttcttaaagtttctgccattttccgcccttcaaatagtggtctcgaatcgacgacaatcactttgatgtttttctttaaactgattgcattatgcagtaacagttcagttagaacctttgatgaaccatatgtcacaatagtagtagattcttcaatttgtgtagaggcattgtctataattagttgatcagccagttcgattttttctttagcaaactgcccaattttctcacaaaggtcttttttggcggctttgtcgggggtagatgggtcaattaatgaaatttcttgctttaaccatctgatagcattacccatagtaacacttaaaggtctagcttttttcaaaagatcaatctggtgtgacaaataacttgttaagttacgtgacaaggtagttcccttaggtgtttgatagtctttgataacaatttggaaaacctctagcatggctatgcaacgtgggatggatcccacgattttatagtgtgctagatgagaagttaataataatatcgacggatggataaggtctttattcaataaaagttccttaacagacgatatcaagctggagttgtcaaatgattgttctaacacggtagggatcactgacgatataccgggaatgacattaaactcaccagcctctaacgagatagatgccaatgtcttggcaacatcagaagcgtttgatgaagcaatctcttgttgtatagctgttggagtatttgttgacgcagaactggtaccggcagagagtgctgcagaagaggcaggaagagtcgttgttgttgaagctggagctgatgcagatacagtagacgacgcgtttggacccacgggcatcaaggaagaagccgttaatacgttagatcctgataatgcactagccaccacggggaccatcaacccagcagcggtgattcgcgaagtttttggagatgatactgcactggttaaagctaaaattgtcgctcttctttcttcagtagtttccagatgaccaaaaagtgtgctctttttcacgtttcgttcattttgtttttttttattggcatttttttgcttttgctctcttttctgttgttgctcacgttgtagttgtttcttctcttttttcatttgtgcttgttgttgctgttgttcaatggatataccattagcctgcttcattgcagctctctttgcagctttttcttgtttctttagttcttttagctccttgtttgttaatttcttttctccattagctgcagctgtagttgttggagtagcttgtttagctttacttggcggtgtagccgacctagatttggcttccgattcgctcatagcaatttgattatcgacgcttctttgacaacgtatttcttacgtggtgaaaataagatcttatgcacttacgctgattatctatagctggtgatgccttgttgtagaatactcattttcactaaactcgaaaaaaaaaaattgaaaaattggaaaaaagcgagaggtactgaaaattgtgaagagattcccgggtaaatataaacataattaatacaataatagcaatatatgtgacgaactgtgttctactttttagtatttacaggtatgtttatttatatatttcctatggggtgttttggtactatttttcctctttttcggtggattcctgaggaggtggtgtttccaacagtcccaacgctttcaaatgcgtgtcgtatggatcgctggattcacttaatgcattttgatattggcgtataaattcttgcaattctagatattgagcattgtgttgatcgatgtccaataatgttcttgcaataaggtatatcccctcgtatttgcttagcaagtcctttagttccgcgccacttgatgaattggggatatctggtaaactaatatctacaggttgcaagcccgtcagctctggggtaaatccaatctgtctacctaatgttgcaacaagaatatttgctagtccagtattattttttctatttaatacctttttccaagcaacctgcagtttcctctgagcaatttctgcatctttatagtctttcaacctatttcgatgcaaagcacacatgatattagtattaaaaaaatgctcgatatcaaatacggatggattttgcgctttgagaaacttgtgctcaataccatataagagtcctaccatgtgcgcatatttaccgattttgaaaaatgacgcagtcaacatcttttgaacatgaattggtgagatgtacgtccaaatagcgcgctttcttatggaggtccctgtccattctttgaaccaatctagtagttctgtcgagttgggttcaaccgaataaataaaatcatttaacgtttgcttcgacagtggctttacgggaggtctcggttgtaatggttcccttgtttttggatccctaatatctttagttaacaatatctgagcattcttgggacggtaaatgaatggttttagtttcgcatctgtcttgtggtatatcaagaattcatccagctttgctttcgcaatttcgccggtagatgcaaaacgtctccaaactgtacttctgaacattttcttgttggtcgttgctcggtgcaatgcccttatcaacagtattggtccctcattaatcaccactgttatggttcccattttcttaataagaaaggtttagctttttttcagcacattttctattaccctgcatggtgagtatcaaataagtgccaataaattgggtatgaatacaactaaatacattgacaaagtgttcacaacgcatcgaagcgctagacttgcaaatgtgatgaggatatatgatatttttgggatattttatttgttcttatatattaagtagttgatgttgtcactgactataccgagaccaaattatttatcgagcacatcagcgtcgtacttttgcttgaaccaagagacggtgtcttccttagttgtcttgtgggagttaccaacagtacccttacatctctttcttctagtgactctagcacctggtctgttcatgacgacatagaaatccataccgaaaataccgatggatgggtcatacttgatacccaagtcaatgtgttcgtcaataccgaaaccgaagttaccggtagcagagaagtttctgtctctcaattggtattccttgaccttcaaacctctttccaaaatttcttcagcctttggacctctgacggtaacgtgaacagcaattttttcgtttcttctgataccgaaagttctgacagtgtatctggccttggattgaactggagtttgaccagataattgttctaaaaccttggaggctctggttaatctgtcaccagattcaccaacggagatgttcaagaccaatttctcgatcttcaaatcacgcatagggttttgggctttagtagacatcttggacgcgtatttttgtatatgttgggctttcaagggtaactgatgctaaacgttataatacacgaaatgaatgcctctcttaacagtatacttctttaatgatgagttatgtccaagtttcaatttggtatcctagcttcgctattcgcagagcgggttccaaaagatcttcggataaaaataaaaagaaggcggtgaaaacaaaaagaatattaaaaaaagtaatgtatgggttctcgttgtacggatgtttaaaatgtcctgaaaaataccaattagacggttctgtgcttgttatatatagatgtctatacgactcaacatatgtatgttgctgcattttagaaaaaaattaggcattaaacattaggctacacaggaaataatgtttcctatcaaaagagttctaacttgaattgttccttcacaattaaaaaaaataaaagagtacatatttaggagggggaagagatattgataatagactaaagtaaggagtgaggagagggcaaaatacaataatagatgaaaaaaaaaataggaaaataaaacaattttttcagagtgagggaacagaaatgattatctgtccacgcattaattaaaagagattaattagtatggtaacttgttcttttctgctggtttttttttttttgtttctaatagattgttgatttattttgattaagctgttgtttgttggggaagagactcactttgctggtgtccgacttgttcatgttcttcaacagcaccttcttcttcttgttcaggttcttcaatttgtccatcttcttgttcgtcttcggaccacctgccttgaccgtcttcctcttcctcttcttcgccttcttcaggttcgaagtcttcgtaatcctgcttgaaacttaaagtaggcttgacttgggcagagtctagtgtccattcattcagtgcgctttcagcatcaataatgatttgtttagaggcttcatacccatcgtaagcaggcctggtttcacctggagtgacaggagagtcgtccaatagttccaagagagccttaccgtaaccagcgattaaagcaattttctctgaatgttcgatgatggagtcaaattggtagttgaaagcagctctcaactttgaccttgtgatattagataattgagcttcagcgaccaaagattcagcctcagcacgcaccaattcttgttccaagacctcaatcttaggtgattgaggatctttgtatttcaagtaggcgattttgtcggtgatcttgtccttacggtctctagatggttgaacagaaccttcgatatctctgatggactttagagtcaatctgtattggtcataacgatcgataaattggtcgtctaattcactaacttcatagatcaagacacctaatttatcagtgatgtcggaaacatcgtcatcgttttccaacccccaaatagacaattgcttagcagcgtcacgtctttcgttggctgtcaattccatggacctcaaaacattcttttcaatcttaaccaattgagacaactttctggataattctgggccaaaagctccagcagcacttctcctaaagctgtaagctagaccacccttcccaaagaatctacctttggttgtagatggtggtggcggtgggttctgtaattgagaggcggtaggtgccctggaatttcttaaagagtaagttctgtgcatactatatacttgatgctgatatattcttcactttgcaatactgctaacaatggaaaagtataggtaaataaatgtgcagatgcagatgtgagacaaattttctttcttgggttgggataatcaacgcattgtacccaaacgacgggaaacaaggaaggatgcagaatgagcacttgttatttataaaaagacacgggagggggaatcccgtctttcgtccgtcggagccaaagagatgagccaaagcagaaaaacaggggacgccgcccttcttccgtcccgtgcgtgaggggggcgcggccattcggtttttgcaatatgacctgtgggccaaaaatcgaaaaaaaaaaaaataagaggcggctgcggaattttataagacaagcgcagggccaaagaaaaaataataattgacgtggctgaacaacagtctctccccacccctttccaaaaaggggaatgaaatacgagttctttttcccaattggtaaatattcaacaagagacgcgcagtacgtaacatgcgaattgcgtaattcacggcgataacgtagtatttagatttagtataatttgaaccgatgtatttatttgtctgattgatttatgtattcaaactgtgtaagtttatttatttgcaacaataattcgtttgagtacactactaatggcttattgtttggcatttgtagcggcagtcaattgcgcttgtttgatcaaactttccggagcatcaaagacgggcagtttcagttcaattagtctgatcaccgagtttttctggaactctgaatcagtggttaaggcatcccactcacccgtagtggcgatcttgtgattttcgtactttttcgcaccaaatgcgggcaacagggcgaggtgatcccaggtctggatttcgttgtactctgcgtgaggcccatgaatcagcttttcgatagtgtagccgtcgttgttaaggacaaaaagatacggctttaacccccatctgatcatggtggagatttcttggacggttaactgcaaagacccgtcacctatgaataagatgactctcttgttggggtcaatctcctcagcggcaaaggcagcacctaaagttgctcctgttgtaaaaccgatggacccccacaacacctgcgagataccgtaggcgtccttaggaaagatagtttgattgataccgaaggcagacgtgccggtctcggaaatgataacatcaccttcttgcaagaatttggacaattcgttccacaaccactcttgtttcaagggcgtgctagcaggtacacctttgtttgcgggagttttggttggtacgggaacgctcttgtagcccttaacaacatcgggaataaccttcagtaagttttgtagtgcaaatttcatttgtacaccgaggaacgtagcgttcttcacctttacgtaatcggaatgaaactccactacatttttagtcttgtaggagtaggaaaacgaacctgtgttaaaatcagagagcaaagcaccgaccgaaaggatcaaatcagccgactcaacggcctgtttcacgtcttgtttggacagcgttcccacataaacaccgccatatctgggatgctgttcatctattgaccctttacctagaggtgtcacaaaagctgggaattgcgtcaaatcaattaacttctgggtttcttttttaacgttgtgcctagaagcacaggcatccgatagtataacagggtttttcgaattctggatcaattctagtacggtatcaataacttccttttcagcttcgggatcgttaggttttaatgatagatcaatcggtttttccaaaagagaaccaggaacctttagatctaccaaattcgctggcaaccccaagtagctaggcctttgtgttataaatgttgtcctgatcaacctatcgatttctgaaggggctgtagcaatgtctgtaatcattgatgtagtttctgagatattggcggacattctgtgaaaaacggtaaaatcaccgttacccaaggtatgatgcaacaacaattgcttagcctgagcggagatagaggggacaccaacaacatgcagtacaccgacgtgttctgcatacgatcctgcaataccattcaaggcggataattcacctacgccaaaagtagttaccagcacagataaacccttgatgcgtgcgtaaccatcggcggcataggcggcgttcagctcatttgcattaccagcccatctcaatccatctacctcgtaaatcttgtccaatagggacaagttgaagtcgcctggtagcccaaaaatggtgttaacattaacttgcttcaatctttcaaataagtattttccaagagtaatttcagacattttgttggcaatatgtttttgctatattacgtgggttttttatttatactgtatataaaagaggactgcaatagcacaagattaagatagaatggcttcaaacagccgccttttatacatattggtaaaagctcgcgaatcgcaccatatcccttatcctgtaatcaaatcgatctaggtgcagatacagatcaattcataaaaagaaattgaagcaccagtttatcactactacactatctttttcttttttttttttttttgcgaagtttcgccctttgttcaatatcacttgataagttgtgggctttttctgtcactcattcggcttaaaaagtattcgttcttttgtgttttatgaaaagggaacgtgatataaaaaaacatcctttggtgtgggacatgggcttttgtttagagaatggttatcactaccgcccccacccttgaaagccacagaaaatgaaaaagtatgtgaataaggtgtgaactctataacattttggccaaatgccacagccgatctgcatattccaatggacataatgcaacaacaattgatgtcacattctcttacacacttcgattggtccgtacgtagtactttttacataactgactcaggcgtttccttcattgaaatgctcatctattgccaagtacatagaatccacagtgcataggtttatgagatgcttggaagatgtacgatcgcctgcactatattagtatattttttcaggctttacaaaaccagaaagaaattaccgactgtaatacttaatttccatgattttaatcgtatggtccgtgaggaaagaggaattttaggtaaaaaaaaacctttgtctatcaaaacataaaagaaaagaaaaaaattaaattgaataagtcagctttttagcatgaccacagtaataatagtaatacgatatcagcatgagctgctaaacattaagaatttttgaattgtgttcgctggtaagagaaaatagggtagcattagttgcgagatggaaaattaaaatatgcgtcataaggtattttcgacgttgaagattaggggttgcaagtccgagaactaaactgccttcacgacgtcaaacttattgtatggtgacaataaaacgaattcaagaagccagagatgatgaggaaccgatgacgaggcacatggggatagaacctccgttatctccattccgcgttgagcagctctcctgcgtgctttcacagagaccctaagccaagaccgcggacggccctctttttcaaggggatcaccggtaaggggccaagcggtgaaattgcgtattgtttcctcctatcaatgatgagtacgtcgccgatccagaagggttattattgtcattgccagtactattcgtatgctgaaaaagtatagttcacttcaccctctggctgcaggctagcctagccgataatgcccccgactccctcaacaggtagaatttgtaaggattcgacgtagcctggacacattgtgcatttatcgtatcccctactgctacacgtataagaagtcgttgctttacctctattccagaactcaatcttgtcgttacttgcccttattaaaaaaatccttctcttgtctcatgccaataagatcaatcagctcagcttcacaaatgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtccattgcaagtgccaattaaggcagcactatttattcataattattcgtaattatatctccataattatttattcataagttttctttaagtttattctctacatcactagttattacaaattggtcgtatgtacaagcactaatatttcatacttatcgtacttcatacatagcaaatcctgttaggaaaaatatggcagcaaaacagattggctgcctacttttgacacatttttttctaattcggtacttagatcggcatgaactcaacgattatcgcattatacggacaatctgaaaaaaaaaagtagcctaacttatgcagttgtgtgtttataacgttgaattcctaaacctcttgaaggtgtaatataacaagtaacataactaggttttcacaactcgttagtttctattaaaagaggaataaacaaattttattaggactaagaggattatacagagtaccagcagagaaaactttaaattctttctgttataataatatcttaccaaagttttttgttttctatctccacatttttcgtaccatctctttaggtaatcactctgaataacttttattcatatacaccccaatattttttaagattccacctatctccgttacataaaaggatccatgcacaattttcatggaggaacaatttactaatcagaagaaagtatcacatctacagtcattaatgaacactaaaaggagtgaacagcccaccgaatttgccaaaaaacataggtttaaagatacgcttgcattgttcctggtttttttgagttttaaccacttcacttccctatgtttattggtttcctttattgttgctaccaaatgcaaagattttctggcaaattgttttattatacttttcctatcgaaaaaaccttcccgccatatcggtgaagtggcgcacatagatataagtacttccaaagtgaccaatggtagttcaaaccgaaaatctaattcacgattttttggcaattcaaaaaatagcttcgtcattccgatccccgtattaatttgtgaaattttatttgcaatgttactaaagatttacggtggcgattattttgttaagccaataaaaaatctggcaatttctattattgcctcatttttgatcaatgatccaagcgattgcttaagctatgcaacttcatgctcagtattgtatgctgtgtcaactaacacttttcaaagagtgtcacacttctttgacattatacagttatttgatatgtctttacgaggaaccggccaatcaattaaattattcacggtttttcgcaagtattcacagtttttcaaaaagcttttctctctatttttgccaatgcctttcaagatgcttggcaaacattcagacagtatgatttattatctatcctttcacatcctttttttctcatttgcttcaagtttattacaccctcatagacaaacagcggaaaacaagccattgaaaaagggtttcaattcaactaaaccagatgtagcccgtgttcaaggtctgcaaaagatgagaatttcttcttcttcttccgtttctgccgattcgaacactttagaggaccaaagtcctatgataccgaacgatccaggtggacttagcagcagcaatcaaactatccatccatcccaacaaaataactcgccagttcccctatcatcacacagtaatattttgaaccctgccgcctcttatcctactgatgctacttctagttttccctatttcacttctatggtcaaggaatataagtcatatcagccatcggtaatctctgctgaaggaagcaattctcaagccgttactactactaccagtacaacaacctctcctacaacgttcaacttttctggtgataacactagtttgtcaaatgaaatctctctatctgattcctcgaatggaaattcgaaaaaggattctgatttcttttccccttccaatgacaagtatactaaccaactgtttgaactgaatgttgattttgggaacatgttttcttctagcaaattatcttcagacatatctgttacatcaaacttggaaaattttatccgtcttctattcagaagaaagaatcaacacttgattgcacctctttggtctatggtagttacattaaaaacaacgaattttgaaaaaaaatacttacaagaaacctctgaaaattcactaacaccaacaaattcgaatacttcatacgtcagtaatcaggaaaaacatgacaaagatttggacacgattaatacacattcagtttcatcaagaattagtttcacccatgccggaaagtttaagaagagcgtgtttaacaatttcgaaccttcaaatactatggccctgattgcaaagacaacatctgatgactacaatcttttaaatttagtttccaccaatgaaaatattttcaatagaaatgataatgactacaaagtttgcattattgatattagcacaaactctattacattccatattgaaaatttacatgatggcgaactcattgttttagtaaacggtgttatctggtcagaagtttcttgcgctttaattttagagcatgtaggcgaagaatacgttgtcgttaacggattagtcccttcttgttcttatgatattcaattcatcaacagactaaatcaccgagatgattatttggtttctgatttaattgtaaggacttgtgggaataacaatgcgattgccggaaaatttgaaaaccttgatttcagcttcccttcatactaccataggaaattcttatctccgttgctaactctgaagcattccgtgctaactacaaacgcaaatttgtccgatgaaaggacaaaattgaaaaagacaaaaaaggaattcagcaagaagttaagtcttttgagacaagaaattgattattttaaaggcaggatttcacagaacgcaacacatgacgaaaagagcactttaaaagtcgaaaatttgaaggttgccctacagcaaagtgagactgcggtaaataagttagagatgcaattgaaaactctcactgaaaaagagcttgaattagaagaggaatacttgaaaaagaaagatctacacttgaaaaatcaattagagttcagtaagttagaagaaagcttatcgaaagacctgaaaaactcagaagggaggttccaaaaggtcaatcaagaattagttcaactaggctctaaactggacaaattgaacgcgagaaacgagaagttacaaaaggaggtcgatcagaacgcagaagagatagaaaagttcagtactcaatttttgagtaaaagagaaaaggatagatttagaagaaaggagtacaggatacgcgaagccaataaatttgaattgactataaaggggttagagcaagatatcaacagattagaaaatgagaatgaaaatatacatagtctaattggtaatagttactgatggaagattagaaaacaaagatagataagaattcgttttgtagcatcctaaaatttacttctattgaatatatacatgtatttattacttggacgttctactttaaatgtagtcagtcgtttttttctcgatattgtttttttattgtttcctaataacttcatttgttacttttttgccttttgttatttatggaaataatgcaggttaacataagtaaacataaaatatgagaaaaactaagaatgtttgctgatgtattgaacagttcacatcgttgtgtctactattaacactaagttgttgatcaaaacattccctaattaatagctgccccaggacttggaaggccacactactctccatgacatcaaagatacggcccaaataatctgtatcctcgatatgaacttaggaccacatatttggagcttgtccaaaatactaaaatggcagataacaattagatggttccaattcaaatacattacaagctacgaaaactaatattctataatttatactaagttcatggaaagaattgcaatggattgaggtttctaacgaggttatcactaccgcaaatatagagagtaagttggtaatatacaacaatagaatttaatcaataaccaatctcaacattattgtatcgtattttaacttataattgtgctcatatcaagttttctaggttacaattacgaccaattctcaggttgttttgcaaaattggcgaagagatggaggcctaccacatattatcacgatttgatagggataatctgagtaacgattagttattgacgaatccctttaatatagtttccacacgagaataggcgcctactaaagaattgatgaatctgctggtaatttctaggtttccattattcggtaaaatatacggaatgtattaggggttcttcatgacgatcaaagatccatgaatggagatcggtatttttaagtaatagtgctactatttttttcctttttgcattctgtcgttcaatatcctgttacattattaatcttagtttcggattccactgaaatcaataactatatcccatggcttgggccttaattcttgtgtcatatacaataatatgctagtgccgtgaacactagccaatgaagaaatgatcgttttccaacacataccggacgtggctctgatagtgctcgacgatggaaatttcagcatgcatactgatgtatgtcaagataacaactacagtcctatcgtcgtgattatagggaatcgaccgcgccactgctatgacaacggaaagtttatccatggcctgctgattttgatgctgctgtggacacgagaataccaacacctgttcacatcttcatgtggatgaacgtaacgaagtggatatttaggctcggtagcgaatcttttgccgtacctccaaatttatcttgtatcgatttttccgtctagttgaaactgttattatccgcccctccaattttctgtaaagcataggtgcttcttcaaagtatccaatgtatttcttaagcttatcaagaaataacatacttcgaatacgtcccaagttttctgataactttatcatattcttttggctaattggcgatcgtttatataccccagtgattttggttataaatttataatatagttcaaactatccttcctttagaacaactgtaagctttaattttgagcaagcgctaccatttgatatatagcaaactaaccaaaatgctaagacatcttctagtctaaaagtaactctttttctgtgtatctaattcacattgtgaatttgaaaagtacccttatttgtatatatgttggttttgatggtaggtgacctcacttttctttagaaaatttgcaattatagttttagacaatccctttatgtttcatgtgcgtattcattatttttaacaaattcctagttctcaaatctgagtctcttggtaaaaatttgcctccttagcttagtggtagagcgttgcacttgtaatgcaaaggtcgttagttcaattctgacaggtggcataattttatatatctctttttttgcttgttgtacggaagttctgtccatccggtgggcgaccggtatagaattatcgcgccatccatgaaggttggcccagggccgagtaaagatttaggcaggaccggtggtggccactgcctgggaacgtcggcctacggctcgctgcatgccgttgaaaaatttcaattgtaatttggaaaatttaaccaaatgataatttcaatatgtaccactagcactttacgtcaagaatctcaagcaaaccaaagggttttaatcttatacttttccattctattttttaatagaatttaaatcggcagctcttatacttggaaacaggacgttttcattttgcttttttgaaggccagatatttgctttcactttaagaaccaactccaagaaatcttcaaagtttcctttgttagatttatcctctgattgaattattgaaaccacaggtataatcactttggggtagaacattatagttttcatagaaattttacaaaggatctccttcatataccatggctacaagtgttaaaagaaaagcatctgagacttctgaccagaatattgttaaagtgcaaaagaaacattccacacaggacagcacaactgacaacggatccaaagaaaatgatcacagtagtcaagccatcaacgagcgtaccgtgcccgagcaagaaaacgacgaaagcgatacttcacctgaaagtaacgaggtcgctactaacactgctgcgactcgccacaatggaaaggttactgcaacagagtcctatgatattcacatagctagagaaacggctgaattattcaagtctaatattttcaagttacaaattgacgaattactggagcaagtgaagttaaaacaaaaacatgttctgaaagtcgaaaaatttctacacaagttatatgatattctccaggaaattcctgattgggaggaaaagtcattagctgaagtggactccttcttcaaaaacaagattgtttctgttccatttgttgaccccaaacctattcctcaaaatactaattataaattcaattacaagaaaccagacatctccttaattggctcctttgctcttaaagctggaatttatcaacctaacggctcttccattgatactttactaacaatgccaaaggagttgttcgaaaaaaaagatttcttaaatttcaggtgcttacacaagaggagcgtttatttagcatacctaacccaccacctattgatattattgaaaaaagataaattagactcatttttgcaactcgagtattcttattttgataatgatccgcttttaccaattttaagaattagttgttccaaaccaacgggtgattctctttctgattataacttttacaagaccagattctctatcaacttgcttattggtttcccatacaaagtctttgaaccaaaaaaactgttacccaatagaaactgtattagaatagcacaagaaagcaaagagcaatctttaccagccactcctctttacaatttttcagtgttatcttcttcaacacatgaaaactacctgaagtatttatacaagacgaagaaacaaacagaatcttttgttgaagctactgttttaggtagattatggctgcagcaacgtgggttttcatccaatatgtcgcattctggttcattgggtggattcggtacttttgaatttactatcttgatggcagcgttattaaacggtggtggtataaatagtaacaagatattacttcacgggttttcatcataccaattgtttaaaggtgtaataaaatacttagccactatggatttgtgccacgacggccatttacaatttcattctaatccagagaattcctccagttcaccagcttctaaatatattgatgagggtttccaaactccaaccttatttgataagtcaaccaaggtcaatattcttacaaaaatgactgtttcttcttatcaaattttgaaagaatatgccggtgaaacattgagaatgctaaacaacgttgttcaagaccaattctcaaatatttttttgactaatattagccgttttgacaatttgaagtacgatctgtgttacgatgtacagttacctttgggtaagtacaataatttagaaacttctttagctgctacatttgggtcaatggaaagagtaaaatttattactctggagaatttcctcgcccacaagattacaaatgttgcaaggtatgcattgggcgatagaatcaaatatatccaaattgaaatggttggtcaaaagtccgattttccaatcaccaaaagaaaagtgtactctaacacaggaggtaaccatttcaactttgattttgtaagagtaaaattgattgttaacccctctgaatgtgacaaattagtcaccaagggccctgctcattctgaaactatgtctacagaagcagccgtttttaagaatttttggggaattaaatcttccttaagaagattcaaggatggctccatcacccattgttgtgtttggtctacatcctcatcagagcccatcatttcctcaattgttaactttgcattgcagaaacatgtttcaaaaaaggcacaaatatcaaatgagactatcaagaagtttcataatttcctaccgttgccaaacttaccctcaagtgctaaaacatcagttttgaacttgagcagctttttcaacttaaagaaatcctttgacgatttatacaaaataattttccaaatgaagttaccgctttctgtaaaatcaatcttaccggttggctctgcatttagatacacttccttatgccaaccagtaccattcgcatactctgatccagatttctttcaagacgtcattttggaatttgaaacctcacctaaatggccagatgaaattacttccttagaaaaggctaaaacagcttttcttctcaaaattcaagaagaattaagcgctaactcttcaacttataggtcgtttttcagcagagatgaatccatcccatacaatttagaaattgtaaccttgaacatcttgacacctgaaggttatggattcaaattcagagttctaactgaacgtgacgaaatcctttatttaagagctatagcgaatgctaggaatgagttgaaaccagaattggaggccacattcctaaaatttactgcaaaatatctggcttccgtaagacatactcgtactttggagaatatatctcattcgtatcaattctactcccctgtggtaagactattcaaaagatggttggacactcatttattactaggtcatataacggacgaattagcagagttgattgccattaaaccttttgttgatcctgcaccatatttcattccaggttctcttgaaaacggtttcctcaaagtgcttaagtttataagtcaatggaactggaaagatgatccattgattttagatctagtaaaaccagaagatgatataagagatacatttgaaacaagtattggagctggctcagagctagactccaaaacgatgaaaaagctttctgaaagattaaccctagcacaatataagggcattcaaatgaacttcacgaacttgaggaacagtgatcccaacggtacacatttgcaattttttgttgcctctaagaacgatccaagcggtattctttattcatcaggtatcccactacccattgctacaaggcttacagcattagctaaagtagccgtgaatcttttacagacacacggtttaaaccagcaaactatcaatcttttattcacgcctggattaaaagattacgattttgtcgttgatttgaggacaccaataggtttgaaatcatcctgtggtatactttcagccacagagttcaagaatataactaacgatcaagccccatcgaactttccagagaatttgaatgatttaagtgaaaaaatggatccaacataccagttagtgaagtatttgaacttgaagtacaagaatagtttgattttatcaagccgcaagtatataggtgtgaatggtggagagaaaggagataaaaatgtcatcacagggctaataaagccactcttcaagggagcccacaaatttagagtaaacttggattgcaacgttaaaccagtggatgatgagaatgtgattttaaataaagaagccatatttcatgagattgctgcattcgggaatgacatggttataaattttgagacagattagaataaacaacaaaatcataacttttagaagtatctgtataatattaaataattaaagcagccggcagtttacataaagaatatttttctttaattcttttttttagatgtggtcctttcggcgatttggcacaagttaacttagtatttttaaaagttttgaatagtactgctgtggcgacgctcagaataaagctaggtaaacgatttgaacgcctcaactagcactatttgatagcattttggctgcagaaaatatacaaagaccttatgagctctgaagaggactatttcgatgagctcgaatatgaccttgccgatgaagttaatgaggaaaaagaagacatacaaactaaaaagctcactacggtaaattgtcaaacagaaaaattcaatccattcgaaattcttccggaaagtatagaattattcaggacgttggcactcatcagtcctgataggttatctctatcagagacagcacagattttaccaaaaattgtcgatttaaaaagaatccttcaacaacaagaaatagatttcattaaactgttaccgttttttaacgaaatcatccccctcatcaagagcaatataaaattaatgcacaattttctaatctcactgtacagtagacgttttccagaactatcttcattgataccatcaccattacaatactcaaaagtgataagcatactggaaaatgaaaattattcaaaaaacgaaagtgatgaactatttttccacttggaaaataaagcaaaattgaccagagagcagatcctcgttttaacaatgtccatgaagacgtctttcaaaaacaaagagccattggacatcaaaacgaggacgcaaattttagaagcaaatagcatattggaaaatttatggaaactacaagaagatataggtcaatacatagcctcaaagatatcaataattgcccctaacgtgtgtttcttggtaggcccggagatagcagcccaattaatagcacatgctggaggggttttggagttcagtcgcattcccagttgcaacattgcgtccattgggaagaataagcacctctcacatgagttacatacattagagagtggagtacgacaagaaggatatctatttgcttctgacatgattcagaaatttcccgtttctgtccataaacaaatgcttaggatgctttgtgcaaaagtatcactagccgcaagagttgatgctggccagaaaaacggtgatagaaatacagttttagctcataaatggaaagccgaactatcgaagaaagctagaaagctatcagaagccccgagcatttctgaaacgaaggctctacctattccggaggaccaacccaaaaagaaaagagctgggagaaaatttaggaagtacaaggaaaaattcagactatcgcatgtcagacaattacaaaataggatggaatttggcaagcaagaacaaactgttcttgattcctatggtgaagaagttggtttgggtatgtctaatacttctttacaacaagcagtaggagctacatcaggttccagaagatctgctggtaatcaagccaagctaacaaaggtaatgaagcacaggatttctgaggctaatcagcaagctgacgaattcctaatctccttgggtcataatacagagcaaccgaatctgtcgccagagatggttcaaatgcacaagaaacagcatactaacccagaagaagagaccaattggttttccggtcatggttagggctcttctacatacttgataatatttaaaaagatattatatagtagtgaccggcgagagcgttttcgctcataaatttcgtaaaaagccaaacaccacacgctgcaacccagatgccctttttaggaaatgtaattattcaaaaagtaaacaatgacatgtttcattcctcaatctaaatcattcgaagctaccttgatgttgaagccctccgcttgttgtttatttaaaaataaatacaaggaggcaattcgtccaagtaaattattgtaagatagaaaccttgctaaagatagaaactaatataccagaaaaattcaagcaacatctacagtattccttgctaaagaaaaattctttaatatgctatcaaaatcagaaaaaaatgtcgacctcttggcaggcaatatgagcaatttgagtttcgatgggcatgggactcctgggggcactggactatttcctaaccaaaatataacaaagaggaggacaaggcctgcgggtatcaatgattcaccttcgccggtaaaaccatccttttttccttacgaagatacttccaacatggacatagacgaagtatctcaacctgatatggatgtctcgaactctcccaagaagcttccaccaaagttttacgaaagagcaacttcaaataaaacacagagagttgttagtgtttgcaaaatgtactttctagaacattactgtgatatgtttgactatgtaattagtagaagacaacgcacgaagcaagttctagaatacctgcaacagcaaagccaacttccgaattctgaccagattaaactcaacgaagagtggtcctcttacttacaaagggaacatcaggttttgagaaaaagaaggttgaaaccaaaaaatagggattttgaaatgatcacacaagtaggtcaaggtggttatgggcaagtttatttagccagaaagaaagacacaaaagaggtgtgtgctttgaaaattttgaacaaaaaactattgtttaagctcaacgagacaaaacacgttttaactgaaagagatatcctaaccacgacaaggtctgaatggttagtaaaacttctgtatgcattccaagacctacaaagtttatacctggctatggaatttgtaccaggcggtgattttcgtacattattaataaatactagatgcttgaaaagtggccatgcgagattttacatcagtgaaatgttttgcgctgttaatgcgttacatgatttaggctatacacatagagatttaaagccggaaaacttcttaatcgatgccaagggacatataaaattaacagattttggtttggctgctggtacgatttctaatgaaagaattgaaagtatgaagataaggttagaaaaaatcaaggacctggaatttccagcgtttacagagaaatctatagaagatagaagaaaaatgtacaaccagttgagggagaaggaaattaattatgcgaactccatggttgggtctccggattatatggctttggaggttttagaaggaaagaaatatgactttactgtggattactggtcgttgggttgtatgctgttcgaaagtttagttggttatacaccatttagtggatcatcgactaatgagacctatgacaacttaaggcgctggaaacaaactttaagaagaccgagacaatctgatgggagggcagcattctccgatagaacttgggatttaataacaagattgattgccgatccaatcaatcgattaagatccttcgaacatgttaaacgcatgtcttattttgcagatataaactttagtactttgaggtcaatgatcccgccttttacaccccaactagacagcgaaactgatgccggttattttgatgacttcaccagtgaggctgacatggccaaatatgctgatgttttcaaaagacaagacaaattaacggctatggtagatgactcggcagtatcatcaaaacttgttgggttcactttccgacatagaaatggtaaacagggttccagtggcatcttattcaacggactggaacactcagaccccttttcaaccttttactagcgtaaaaatgaattcttgtcttgcattcgccgcgatataattagctttaacgagcttcatgcaaacttttcaactagcacctatgaacgcttttttcataaatatacatatatatatatatagttgtgcattacttaggacttcaagcccattgtttaaaatctcagttcacggtaacggtccatcccatgaccgttttgaactaaacttaagcattcatgttgggagcggcgaaacttggtaatgttttacaggaaaacagcaatgaccactattaatcgaaaatctgcaaaaaatgaaaaggaatgggtgttaacatcaattgttttttcaatgataattacaaattggactgatactacattgctagatgtacaaaaaacgcaaggtagctctcttagaaggatccataatatataaaaaagggcttatggtttactgatatctttttcacttcaaaaacttacatataaaaataggatgacaaatgcaaagattttagtagctcatataagtgaaagcgatgccgatgaggctatcagaaagatcaagaaagtgaatgaaaaatcagggccctttgatctaataattatattcagtaactcgtatgatgaaaattttgagctgaatactgatgggttacctcaactaatactactatcgtgtgataaggctaacaattcgaaatccaaaaagataaatgaaaatgtaacattgctgcataatatgggtacttataaattagcaaatggaatcactctttcatattttatttatccggatgatactcttcaaggggagaaaaaaagcatactggacgaatttggcaaaagtgaggatcaggtagacattctccttacaaaagaatggggcctttcgatctctgagagatgtggaaggttgtctggaagtgaagttgttgatgaattggcgaaaaagttacaagcaaggtaccattttgccttttcagatgaaataaacttttacgaattagagcctttccagtgggaaagagagcgcttatcgaggttcctcaatattccaaaatatggatctggaaagaaatgggcctatgcattcaatatgccaataggggacaacgaactaaaggatgaacctgaaccgcccaacttgatagctaacccgtataatagcgtggttacaaacagcaataaaaggccactagaaacagaaacagagaattcgttcgatggagacaaacaggtacttgctaatagagaaaagaatgaaaataaaaaaattcgaacgattttgccgtcaagttgtcatttctgcttttcaaatccaaacctcgaggatcatatgataatatcaatcggcaaactagtgtatttaaccacagcgaagggacctttaagtgttcctaagggtgatatggatatctcaggccattgcctcattattcccattgaacatattccgaaattagatccaagcaagaacgcagagttgacacagagtattttggcttatgaagctagtcttgtgaagatgaactacataaaatttgatatgtgcacgattgtcttcgaaatacagtctgaacgttctattcatttccacaaacaagttattcccgttccaaaatacctcgttctaaagttctgcagtgccttagatagacaggttcatttcaataacgaaaaattcacaagaaatgctaagctagagttccaatgttacgattcacactcttccaaacaatatgtggatgtaattaacaaccaatccaataattatttacaatttaccgtctacgagactcctgaagcggacccaaagatatatttggccacatttaatgccagtgagacaatagatctgcagtttggacgacgtgtactagcctttttacttaacttgccacgcagggtgaaatggaattcttcaacctgtttacaaactaagcaacaagagactatagaggctgaaaagtttcaaaaggcctacaggacctatgacatttctctcacagaaaactaaactaaaactatttcatttagaatttcaaatatatccaaatatatgtatatatatgtagaatactaagtcatgctacctctgaacgtttaagagacctagcaactcagaggtgatgaattaaaagaaaaaccgggtaaagttcttcgagagaccgcgctgaaaaaatttttttagaagagtcacccatacagcctactggtgttctctgtgtgtgctaccactggctgtcatcgttgttgtatgtccttcagatttatggaattacttagatggtatgaataagtggttaaacacattatctaagacattcacttttcggcttttgaactgtcattataggcgatcattaccactttgtcaaaacttttctctgaagaagtcgttaactcataatcaagtcaggttctttaaaatgagcgatcttgataatttgcctccagttgacccaaagactggtgaggtcatcattaatccgttaaaggaagatggctctccaaagactcctaaggaaattgaaaaagagaagaaaaaggctgaaaaactgttaaagttcgctgccaaacaagctaaaaaaaatgctgctgccaccacaggtgcatctcaaaagaaacctaagaaaaagaaggaagttgagccaatccctgaatttattgacaaaactgttccaggtgagaaaaaaatcttagtatccttggatgatccggctttaaaagcttataaccctgctaacgttgaaagttcttggtatgactggtggatcaagactggtgtttttgaacctgagtttaccgctgatggtaaggttaaaccagaaggtgtattttgcattccagcacctccaccaaacgtcactggtgccttacatattggtcatgctttgactattgctatccaagattctttgatcagatataacagaatgaaaggtaaaactgtcttattcttgccaggtttcgaccatgctggtattgctactcagtccgttgtggagaagcaaatctgggctaaggacagaaagactagacatgactatggaagagaagcttttgttggtaaggtctgggaatggaaagaggaataccatagcagaattaagaaccaaattcaaaaattgggggcttcttatgattggagccgcgaagctttcactttgagtccagaattgaccaagtctgttgaagaagcttttgttagactacatgatgaaggtgttatttatcgtgcgtccagattagttaattggtctgttaaattgaataccgctatctctaatttggaagtcgaaaataaggacgttaaaagtagaacgcttttatcagtcccaggctatgatgaaaaggttgaatttggtgttttaacatcatttgcttatccagttatcggtagcgatgaaaaactgatcattgctacaactagacctgaaactatatttggtgatactgccgttgcagttcatcctgatgatgaccgttacaaacacttgcatggtaagttcatccaacatcctttcttaccaagaaaaattccaattatcaccgacaaggaagctgttgacatggaattcggtactggtgccgttaagatcactccagcccatgaccaaaacgattacaataccggtaagcgtcacaatttggaattcatcaatattttgactgacgatggtttattaaacgaggagtgtggtccagagtggcaaggcatgaagaggtttgatgccagaaagaaggtcattgagcagctgaaggaaaagaacctatacgttggccaagaagataatgaaatgaccattccaacttgttccagatctggtgacattattgaacctttattgaaacctcaatggtgggtttctcaaagtgaaatggccaaagatgctattaaggttgttagggatggtcaaattaccatcacccccaaatcttctgaggctgaatatttccattggttgggtaacatccaagattggtgtatttccagacaattatggtggggtcatcgttgtccagtttactttattaatatcgaaggcgaagaacacgatagaattgatggtgactattgggttgctggtaggagcatggaggaagctgaaaagaaggctgctgccaaataccctaattccaaatttactctggaacaagatgaagatgttttagacacctggttctcgtccggtttgtggcctttctccactttgggttggccagagaagactaaagacatggaaactttttaccccttttctatgttggaaactggttgggatattcttttcttctgggttactagaatgattctattgggcttaaaattgaccggttcagttccattcaaggaagttttctgccactctttagtccgtgacgctcaaggtcgtaagatgtctaaatctttaggtaatgttattgacccactagacgttattactggtattaagttggatgatttgcatgcaaaattattacaaggtaacttagatccaagagaagttgaaaaagctaagatcggtcaaaaggaatcctaccctaacggtattcctcaatgtggtaccgatgctatgaggtttgcattatgtgcttataccactggtggtcgtgatattaacttagatatcttacgtgtcgaaggttacagaaagttctgtaacaaaatctaccaagctaccaagtttgcattgatgagactcggtgacgattatcaaccacctgccactgaaggtctatcaggtaacgaatccttggttgaaaaatggatcttgcacaagctgactgaaacctcgaaaattgtcaatgaagctctagataaacgtgacttcttgacgtccactagcagtatttacgaattctggtatttgatttgtgatgtttacatcgagaactctaaatacttgattcaagaaggctctgctattgaaaagaagtccgcaaaggatacattgtatatcttgctggacaacgctttgaaattaatccatccattcatgccattcatttctgaagaaatgtggcaaagacttccaaagcgttccactgagaaggctgcctcaattgtaaaagcttcttatccagtttacgtatctgagtacgatgatgtcaaatcggccaatgcttacgacttggtcttgaacattaccaaagaagctcgttccttgttatctgagtacaatattttgaagaatggtaaggttttcgttgaatctaaccacgaggaatacttcaaaactgctgaagatcagaaagattctattgtctcgttgatcaaggccatcgacgaagtcactgttgttcgtgatgcttccgaaattccagaaggttgcgtattgcaatctgttaacccagaagtcaatgtacatcttctcgtcaagggacacgttgatattgatgctgaaattgcgaaagttcaaaagaaacttgaaaaggctaaaaaatccaagaacggtattgaacaaaccattaacagtaaggattacgaaacaaaggctaatacacaggccaaggaagccaataaaagcaagctggataacactgttgccgaaatcgaaggtttggaagctactattgaaaacttgaagcgtttgaaattgtagattgaaggtagataaaaattaatgtaatatatatatatatatatgctatgtatatgtaacaacgaaaatgttaagaattttagaacattgaataataactatttccaaatataagaggtagtctccggcatacgacatagcatgttgtggtatattataatctataatggctatacaactagacgaggtgatatattgtcctgtattattcttcttatatttgtgacaagttcttgacacttttgctcacccagctccagtaaactgaacaattgatcttcattaaaatcaccattgctgtctaacaataaaacgtttttcacgactttaccgccattgacgaactccagagctaaagtgtggacagagagcgaaatcttcaattgctcggcagtgggatcgacaatgatatcactagtgtctttgattattgcaatagggatgcttgcgcacatactatttaaggcaattcctgcatcaactaaagccaaaaatgccgcatttatacaacaacttagctctctcagggagaattcggcttcatcttcaccagattccagaatttgacaagttatctggcagagctgtcttgggtaacaatgacgagtgatgagtggggtcagaactgcccgtaatttatcttcgagtaccttctctcttgttgtggccacccctttcgcgggacgtacaataatttctaatgctaattgtgtaggcagttcttgtcttgcttttggttcaatagggcctgttacagaacaaataaccttggtgtcttgtgatacgaattcagatgaaccatctacatgatctaatatccctatttctgcttggacgctcatttttttttttttttcagcagaatctaatctattcttggtattgggctccttgttattaccatatatgcagagatattttatgcatcttaactggttcatctaacaaattttccactcttttttccacaatccgatgcgcttaaaaggaaaaaaaaagtagtaaaaagaaaaagagaggtacataatagtctttatgaagaaaaggcgctattttgtcacctttaacttggcatagtctggagctttatataaaccattcaaagtacataaatgttgatatgttcaaagaggaggactcgttaagaaaagggcaaaatgtggccgcgtggaaaactttgttggctggcgccgtatccgggctgcttgcccgtagcataactgctcccatggataccattaagatcagattgcaattgacccctgcaaatgggctgaagcccttcggaagtcaggtcatggaggtggccagaagcatgataaagaacgaaggcatccggtccttttggaagggtaacatacccggttctttgctgtacgttacctatggctcagcgcagtttagttcatactccctttttaatagatatttaactccatttggactagaggcgcgcttacatagtcttgttgtcggagcctttgctggcataaccagttccatcgtttcctacccgttcgatgttttacggacccgactagttgccaacaaccagatgcactcaatgagcatcacgagagaagtgcgtgatatctggaaactagaaggtctccccggatttttcaagggctccatcgcgtcaatgacaaccataactctaaccgcatctataatgttcggaacatacgaaacaatcaggatatactgtgacgaaaacgaaaaaacgaccgccgcgcataaaaaatgggaactggctactttaaatcacagcgctggtaccattggcggcgtcattgctaagatcattactttccccctcgaaacgatccgtaggcgaatgcagttcatgaattcgaagcatctggaaaagttctcccgtcattcgtctgtatacggttcttataaagggtacggattcgcaagaatcggtttacagattttgaaacaagaaggtgtgagttcgctttacagaggtattctggtggccctttccaagacaatacccaccacttttgtgagtttctgggggtatgaaactgccatccattatttgcggatgtactaaagtttccaatcttttttgtcacatgtacacactcatatacatatacgaaatcatcatatcttatattcttcactgacaaagatcggtagccgcccggttttccattccgattacggcctgactcagtcgcgccgtcttcctctaataacaaaaaatcgaaaaaaaaagaggaatctcgttgctagcgatctgacgccaaccctttttccggtttttcttagttgcctgctgccccgcaccggtttttcttcttttttttatctttttttccgctcagtcagcggggaagggagagaaggaaacaatgaatcggatcttccgatggaaccagcgtcagggaccactacatctgcttgttgtttcaacacaacttacatctgcgcaagcacacggactaggagtaacaagaagtagtaaaattgaagaaagcaaggactgctgcaatctctgcacccttgtggtagccacccttcttagatgtggcatacttacacttttttttttcttttttttttttttttttcgccttttctcatttcttggctccttaatagccaagaaatgagaaacgtgggagatgttcaacctcgcctgatcctaccaaaaaaaaaaatcgcaaaaataagcgggaaaaaatgtcagattctaagtttcaaacctccggagatgattcatcatcaccatcaccgccgatttgttggattgcgtgtttacgatccatcatttttcttgtaagcgtttagctttctgtcatctctttatcttttttcctatttttttttttcactagtttttgcactgaataacacctccccttactcataaatgtgctagctgaatccatatttcctagtcttgcattccctttcccttcaaacagcgctgcccttcttcatcttcattgtcgaaaataaccattcttctcctatcttgaaatctaaaaataacgctactacagaaagcttttttcacaggaactagggcgaagcgtacaagaataaggaaagacagcgtagttacaaactaaactatctatactataacgaccgaaaatttctgttttttaacacctcttctaccaaacacaacgagagtgcattagaaataggacaaaactgggctcaaactaatgtctgattactttagttccagaccttcgcaaacgctcacgccgatgggcaataagccatctggcggtggtggcggcgatgacgcctcctccatccactcgaagagctcgcagtacttgatggacatcttacctgattcgatgaccttgaacgaaagtgtttcctccatagtggcaaacaatcaggcaaaggagtttattttgcctgaaacagatgagagatctccctacttcataaacgtccctataccaaaggctcagccaacctctactacggaaacgaagaagccccttgcaggtgatgaagctatcgatgggcagtttgttaaggagtatcccaccgacatccttgtagacaggttttataaatggaaaaaaattctgaaagggttagtgatttacttgagggaagtcgcgtatgcgcaagaacagttcgcacggatcaattaccaactgaaaggatctgtgaaatttccatttttgactgatattgatgaaaccacaaataccattacggatccattcacaacggctcctagaggccctaagaaagcgcagcctgcgcagaagaaagttggcctgactgacagcgaacaatttcagatgcaaatgcaacaggaacagcaggaaaatgcagtgcaggctcccacagatgaaagtaaaatgagtttggcgcctcatgaatacaagcctgtccagaccacagagtcggacaatacatctgccgcatccggttttgttaagttcggttcaggctcgattcaagacatccaggtcattttgaagaagtaccatctttcgttggctaaccagcaatttaagatctctaaagagattacgtccaccgtcattcctaaattggaggaattgagaaaagatttaagatataaaattacggaaattaaggaccttcatggtgatttcaaaacaaacatcggagcacatattcagctaacaagtcaactattgaaaaaatacatcgcagctgtaaaattcatgaacgcgcatggtattggcaacgatagagcatctcctactaataagaagccacataaattggatccaaaacatgatccatatcttttgaaactgcaactagacttacaactcaaacgtcaagttgccgaagaaacttacttgcaagaagcgttcatcaatttacagagttcaggtttgcaattagaaaaaattatatacaccaaaatccagcatgctttgttgcgttattctgctttaattgactccgaagctcgtctaatgatcaaaaatatgtgccaagaactacaacatggtataatatcaaagcctcctgcatttgaatgggataattttgtcacacagcatccgtcctgtctactcaattggaaatccaacgatcctataccaccaccaagaaaagtttccgacgttatttatccccacatgaaatccccactggccaagtgtattaaggcaggttattttttgaagaaatcggaattgttgcccacttaccaccaaggatattttgttctaacatcaaactatattcatgaattccagagtagcgatttttataacctatcttcttctacccctaactccacgaagtcttcagcttattcttcttccgtttccattgcagacacttatgccaatgctaataatgccaaagctaacaatcatcatcgccaggctagtgatgtacataacagcagtacgacaactggtggtacagctggtgcaaatggtattcgcggtattcgcaaaaagagctatttggcaccgattatgagtattccgctaaatgattgtaccttaaaggatgcatcttccaccaaatttgttcttgtaggtaaacccactcttaatgaaaacgctgatgttagaaaatctagctctagcacttatttatctggctcttcacaagcgtctttaccaaaatatggccacgagactgcaaaaatattttcaaaagccccattccacaagtttttgaagggaagtaagcccaaaaataagaatacgaaatcaagtgaactggaccaattttacgctgcagctcaaaaggaatcgaacaattatgtgacttggacctttaaaatagtatctccagagccttctgaagaggaattgaaacattttaaacgttgggtccaagatttgaaaaatttaacgagcttcaatgacactaaagatagaattaagtttatcgaagaccgtgtgatgaaatcacaccgattcaaggcgggacatatgtcaagaaacagcgtgaacataggttcccatacaccttgtttaacagatagcacattcacattacaagacggtactacgacgtccgtcaacctaaagggcagggcggagaaacctcagtatattcatattcagaacaattcactagcagattttgatggaaatggttttagatccaaggttaatacacctgctattgacgattatggcaatttgattacggtggaaagaagacctgcacaatctccgcaccaatactctgactacatggccacttcaggtaacacaactccttcttattcatcgggctcaagacctcaaagcatgtataatgggtataacccggctgtatcaataacgagtaatgggatgatgctccaacaatcaacagcaaataataatactaatccaacaactaatttgcgccaccaaagaaatatttcacaaacaagttccctacctggattttcatacacatccctatccctaccagtgaattctccaggtagctctaattcagaatccagctcaggcggttattttgccattccgcttcatgggaacaacaacaataataattacacccagagaaactctgaaggctctagcccatgttataatgacgaccaaatacgacaacaacagcaacctttacaaatgcaacctttatcaagaacttcaagttcaagtgttaatgtcacagcgatgagaagtacatctgcaggtaattcaattacagcgaacgctcccgttgtacctaaggtgatggtcaataaccaaaatgttaaaactgttgctgccgatcagtctgctacagcaccttcttcacctaccatgaattcgtccgtcacaacgatcaaccgcgaatcaccataccaaaccttaaagaaaacgaacagcacaggcaatgttccttgtttgactgctgaaaagactcatgcgcaccctgctttctataaacggggcaataatagcgcccaaaatttgactacctctagttcaacagcttctagggtgcatcctatccgaaagcacaagaaaaacgtatcatttagttctttgaatagtttaatgttttcaaaaaagggtgcaaatcacggtggtaatctaatgactaaccaatttatgagtggtggaattcaagaagatgatggtgattcaactaataatgatactataaagctaaaccagtcgatttattcttaattgttacgccttaacttttgttctcttttgagaaacagcctgtatggttcgccgtttattttctaagcaccgttttttattcatatttttataatgcaactcctatagaatatagatgtttcgtgtttttaattcctgctatgactttgtgtcaatggtatgtgaactaacaactgtgtggtagtttgggatggtacgtaaaggtgttcgtgattatataagcaatcttaaaatatttgtatcgcaccatgaggtgcccaataatgaaatgaaaattactattatgaactatactaaaaagatgaaacttttttatcaatcccaggttcttttacttattatttttggatataagaacaaaatcggatttcccatgctttttctcaatgcctatatgaaatcttttcgaaacagccagtacatgtaacaattatgatacgaacttgatcggtaacccataaataacaggagctgcgccgttcaagtaacgtagatggcatacacctctagatttagagacggcatatgaaacagataggctattaccattcaaatcgtcagtattacagcgaaatcccatcttttcaaaaagttcctcgctaaatttatcaatatctttgtcagttacatcccacagattacctagtaccatagggcatcctcccagcaaataagtatagattgttccagtaggttctaacttgccgtaatatttcatcgctgctgaagagcagcccagtaaaaagctgggggcaattttggtgcatttcttaatctccttactccttacatattgttcacctccgccatgccctatataaacgaataagttagaattttgcagcattttcaaaagtgtttcctcttccggcttctcgttcatcactaattgagaggaaggttttgcatcgattattttttggaacatacccttgaatttagattcagtcctggacaaatctccgttcggatttaatatcatactaatgttgtcctcaatagttacttgaaggggtagttggtaatggaaacgcgataaaagtttattcagacaaacataggacggaacacgtgtgatagacaaatctttcaaaaatgaaagacactcccaagggaataaatggcatgaactgctaacgactaaaaatgtatgaaatatactattagttgtcatagttgccctatatttctttatttgctcttctaactgcacgtgaagcatgctgaaatcaatttcgtcgtaagcattttcttcaccatggaagagaagaatatcaagaacaaagtatatcaggtcttccatcttcgaaagaaaatcgatttcttgcggattaagtttcaagaacaattcgattacccaatcttcaacttttataaacattgccggattgccatagagttttctggaaggaagattttgatgcagaatttcgtaaaatttatctttaaatttttcaaataacgagttgtcgactacttcagggctaaaaaacccttgaacgccattgaaccaactattttcaatgttattcaacaattgttgcattcttttatccaaatcatatcttgtggtccaccaagattttctttcttctcttgttttaatcttgttggtaacttccactgacgtcgtttggttgctttcattgataatagaaagtagtttttttgtagcctccggaaatgagagatgaacttcgtcgaggtctcttgaattagatcgtattagcggtagccttaaatgcgtccttctcttacgtcgcggttctaatttggatagaagtaaatttccagttatgggacagaagtcaatagttataacattaatattaaggttgctctccattaagtccttctgggcggcagatactctaatactctctgtaattgtggatatattgttcggagctattagtgatgaaacgcgaaattctcggtaatttttattatcaatattattcaataccttatcgaataacaaaggcatatgccttggcaagtcagttagcgaaaaattagttatcaaactactctcagcattatggatactagttatgtttgaaaggatagtcagagttaatgaagaaagggaggaaattttggacagttcgtgattatctaatgtgtctagtttcaaactctccaaaagttctttcatctgttttaatttactaatagcagcaattctatcaaatttctgtcttatattcttacctctaggcgtcatgctcgacgatcttggtgaatcgcaaagcttcaatcctgtactatgcttggaaggagtttttaaaatgttgttgggcatcgtgctaggaataacaggcagagaagagggaatcccaagggtagattcaaacatacctttgaagaaaggatcttcctccaattggctcattactttttgccacatattgtgtactctattgattacatttttgggcatatattcggacagacaaatgctgtcgtcaatatccttacccaagtgaagcttccacaaattaggtaggaatgttttttctagctggtcaccgaaatataggaccaacgactgctctaactttacaaattccttattatcatacagaaacattgtcaaacttgtaatgtctgcctcagcatcaagataatcaaatgccttattggcttttcccaaagttatattttgaagacaggtttgctctgtaatcatatagtatctgtgaagaaaatgcagacatctgtagacgataataggttcctctaagtcagaaataattctagacagttctttactgtagaactcacagtctctggcagaaccaatgcgtatatgtattttaatgagttggaaaaaactaaacgatagactttttagtaatgctagcctggatccttgtgacaatttgttcttctttttgagcaacgataatgctaaattttgtgcttttctacaatcaattactgcggatataacattaccagctttaatatttaatttcgcgctttcattaaaaatttttatgttcaaaagtatgactttgatgtaaagtgacatgggtaggttgtggtcgttattgatatcaaataattcaggcttcatagcaggcagtgtttttccaaaatatatttgaaacgctgtcaagtcagagtcccacaagtggacatttattaaagaacttgcatgtaataacgcctgctctattttcgccgttgataaattcattgttttttgtagttgattcttcatcatgagggcatcatcaatcatatataagctcagataagcctctagcaaataattgtcggcataaggcacaatactggagtaatacttttcttttgatttaatacagagtgaaagttcaatggataacttatcaaaattattaaagttcaagtagcacaatagcattttaacgaagtccatttcaaatgacgatattctctcggccttttcatctgatttttgtagccatttgtttatgtacagcttagttattttcgatagattcgttgtcaggtgtttactcatgtccaggttcaataggtacactattcgtattaatagctcatatttgttgagcaagtgtaatttatcaaacgtattatttagctctaaaggatccaaatcaaagatacccctcagtgagcaaaatatcattctgcttagttgtgaccaattttcggaaggaatgttttcgatagatgaatttccatacagtactgaaagcataatttctgaactgtttgaaaactcgatgaattttgtgatttttaggcgtgtaaagcaatgaatgaatgcattttggcaaaagtcaaaaacaaatgatagcgtatcatttcgtagcatgcaatatacattgaacaaacaggaaaagatttcaatttttttctgggcactctgagcactagatataaatttttcaaatttcagtatagtacgatgagatgtttttgaatcattactgattaaaacatttgagatttccaaattagcagtctttaacaaaaacgaatgactcttaaataaaacagaagcattgaaaaggacactgataatatttgacagtcgtttaggctctttataatcgatacaaatttctgataaaactcccagaagttcggataataatgccgccgcagattcgtcattaatggatttaatatttgagttgatataaataacagtacaatcaaactgcctcaatatatccttatttttaggtaatccctctaggcgaatagtagaccaaagacagactaaacattttaatgttgcggatatatgtttccctttattttgtagaaaattcgttgcattttcgagtattacgttcaaatcatcgacagatatacaggaccagagaagacggttttcactcatgttgcagtattcattgaattcttttttactttttatcgctctttgtacctcagtagtttcttcgtaacttaaaatgtctagaagcattattttatccaatccatcgtacagcatggaataggataagtaaaatgaatttaaatatattttattaggtcccatctccaaataatttttatgaagaaggtttttgctaaaacactcgacggtaatgttgctaatgaactttttaaaaggtaatttgaactgtttgatatattgtagaaattttagcccgaatagaactttgcaactcgtcgtgacagaaaaaaagctcagcacgatttttgtgagagcgtgagctttgaggttagggtctttcaaaagatatcttttatcatgggaaaatagttctaatatatgcggtaagtattcgtctactagctttcttttcagtataatctgcagcgctaatattttcagatttgaaagatagtagtcgttccacgtactgaagtctgctagaagaatgtttttcagactatgagcttgaaataaattcgtttcattgaaaagaaaaataatttcagaggaggccaatcctaatgcgttattatttattagtttaacaattatcatcaaatgttgtttaacagtggagtttatatggccccacatgtgatggctcttcaataggctatatattgaatttaatgaatggtcaacagtggtaatatcctcaatggctaagtctatgttattgcttgcaatttttgtaaagtcacgtattatgttattatgcattgctagtatgccaatagaattggatgaggcgtctccagacaacaccgaggtcagtggtctagtttggccactatgatgtactttcgaaagcgtgtcgtttaaaaggtaggacttgctagtcatcggagtattcggactaatctcattcagcggttcctcctgttttaccatcattccttaatttataagcacttcgtgcctaggttaaattattactaggttagcctcaaaaatgttgggtttaggtcaactttttactatgctcgcagttagaaggaaaagaaaaatatgctatagccagatgctcctgtgaaacgtgtcctaactaaaataattcggatgtttctgatgatagagtgtctatattcctccaaaaggaatttaactaattgtggtaagcttctcgcttcaaatgcgcaatgttacgtggatgggctttgtatccatgttcttgtttttgtttgtttacctcttttctgtaaagacccgtgaagtttgaaaagaaagaaaataaaaacaaacaccaagaaatgcagacaataagtacttgtggacaggttgccgctaatagaacgtgaatcgagctactttatacgcatttaattcctcatgaaatggttttagaaacgctgaaacaagggcttgacagcagtcaaatacatgaagctttaatacaactagattcctatcctcgcgaaccggtggatctagatgcctcgatggttctcataaaattcgtaattccagtttatccatcactaccagaaagatcgaaggtgatattgagacggctagcttctaaatcgtttacatttttatgccaaattgtcaccttctcaaggacaataagtggccgcgatggactgcaagagatacgcatataccaagaaattttagaagacatcatcagttttgaaccgggatgtttgactttttatttaaaggcaagcactactagcaaagcagaccgtgatagcattaaggcccttttctttgggagcaagttatttaatgtgttggccaaccgaattgatatggcgaaatatttgggataccttcggcttcagtggaaatttctacttgagagtaatgaaacagatccacctgggtttttaggggaatggttagtttcatcatttttgcttaacccagtgctagcggcagatatgttattaggcgaattatttttattgaaagagtcgtatttcttttcttttcagaaaatcatatctgctagtagtctgatagatcaaaagaggctgattgctaagtttttattaccatatattcaagttatcgtgactttagaaaatttgaacgatgttaggaaaattctgcggcggtttgatctcgataaaatcataagtctgtccgtattatttgaaatacagtcgctgccattgaaggaagtgatagtacgtctgatgagcaaccactcttccacgaagtttgttagcgctttggtaagtaaatttgctgattttacagatgaggaagtagacacaaagacatgtgaattgcttgtactctttgcagtgcacaatctcaatcattcccagagagaggaaatagcacacgatgagcggtttttgaatggcgtgaccaaacatttaggtagcaatgaacgtgaggcaagggagcgtgcgatgtttattgccaagcttttatcaggcggtcatctgaagtacgaaagtgattttaaaatcaatataccgaatgtcaaattcgaaagcaatagcgatgataaaatcattgatttccaatctttaaaaaatccatccatatgcaatacccaaactgatgtgggtaaggataagattactgaggtctcgggtcatgttcaaagccttacattggactgcagtgatagcgatgatgaagatgagaacgatgagcgggagattgttaaacgaattgtatttttaaaagatttaatgaaagaatacgaaaaaactggggaatctcgaaaagctccattgataccacttctgaagcaaacagtgaaattgatacggcaaaaggcggattttcagttagaggttggctattatgcacaaggtattctgtcaagcattgtgtgcttgaataatgaatttgatgaaccgcttttcgagcagtggagaataaacgctctaacaagcatactggtcgtccttccagagaaggtgaatggcgctataaatattctattcaattcagaactgtcgttacagcaaaggatgtcactattgtcggctctgggtctttctgcaagagagttgagagggcttgatgatcctactattgtcaagcccaagtttgattttccaacaaatcgtttaccgtgggatgatcaaagccatcataatagtaggcttgttgaagttcaagagtcaacaagtatgataaagaagacgaaaacagtatggaaatctagaaaactaggcaaggatcgagaaaaaggaacgcaaaaccgctttagaaaatatgctggtctattcttctatccgctagcacacggttggcttaatggaattgacgtaggcacatacaatcagctttttaagtcgcattatttaacaacactgcgtatcatatactcttgcgctaacccggtccacgattttgaatccatgacggagttgatgaatcatataattagttcagccatagaggaaggaatttctctcaataaaggttagtagcatagttatttgtaccaatcttatgatacatatttgaataaatttagtgcgttctctgtcagcgtcgttagtatttaatgcacagcatattatttcagaaggtcggccgactcctgcaactgggaaaaagaacttcaataagaaaaggcctgaacaaatctgcttggtaagggcccaacaacatttaagaaattgtacattttgaaagcactgatccatcaattaaagcaccgaacaacctcagagttgatacaattattagttaaaggataggatatgtcattttttgattctttacgtcaaaaggcaccctttttggataaactggcagacagtttcactccaacattaaccagagatgagaaattcagattaaaatataaacttccagctaatgaaaacattttggaagatacgaatgcagaagtttcatttgcaacttccattaaagatggaaaagggcattctgatagagtgaacaataaagggagaaaaactgcttatgtgtattccgggagattgtttttaacacctcattttctggtatttcgagatgcatttgatcattcatcgtgcgtactaatactgaatatttctaccattaaacgtgtagagaggtcgccatccgaatcatatgaatttgctcttctagtaactttgtacacaggagcaaaggttctgattcaatttatcggtatacgttatagatcggagcagttttgtgacaaattgaaactaaatttgaaagaaaatattcctaatgccaaaactttacctgcttttctagaaacctcatattcggagttcttaattgctaaaaatattctaggtaaaaaggacataactgtacccagggcaggtctaggacaacatttcaagtatcccggtaatcctactatggtaaaagaaaaggctaaattgaggctatggttcgattatttcagagagaatggaaggaatttggcagttgtgcaaactcctatgttccgaaagttaatcagaatcggtgttccaaatcgaatgagaggtgaaatttgggaactatgttcaggtgcaatgtatatgcgttatgcaaattctggggagtacgaaaggatattaaacgagaatgctggtaaaacatcgcaagctatcgacgaaattgagaaggatttgaagagatcgctgcccgaatactcagcataccagactgaagaaggtattcaaaggttgagaaatgttctgacagcttattcgtggaagaaccctgatgttggatattgccaggccatgaatatagttgttgcaggatttttaatctttatgtctgaagagcaggctttttggtgcttgtgtaatctatgtgacatctatgttccaggttattactcaaagacgatgtacggtacattgttagaccaacgagtgttcgagtcttttgtagaggacagaatgccggttctttgggaatacattttacagcatgatattcaactatctgtggtgtctttaccttggtttttgtctttgtttttcacttcaatgcctctagaatatgctgttagaataatggatattttttttatgaacggttctattactctatttcaggtggcattagcagttctgaagataaatgcagatgatatcttacaagccgatgatgatggaatgttcattgccataattaagcactatttccaaactctgggacaaagtgctcacccagattcaagcgatataaaatatagacaaatcacgaaatttcaagagctgttagttacggctttcaaagagtttagtgtcatcagcgaggaaatggcaatgcatgcaagacacaaatatgagaaaggtatttttcaaaacattgagactttcatgaaaagaacgcaactgcgccatatgccaaaaactttcaacctgtccagtgatgacttgtccaatatctatgacatgttttaccaaagtatagaaacctacaaaattagtatgggaacgggatcatctaatatgggtttcgaagtattcattcagttcttgagtaaattctgtgactcctgtagaccgtgtgaaaaggacaaagatccagctttccggaaacaaaaaaggaattttctgcaaaggttatttgataactgggattctgctcatatcggcgagttgacattgaacgatgtggtaacaggcttggataaactggtaactgttgatcttttacaagctataaactattttttctctttatatgatacagatggcgatggtgaattgcatagagaagaagtgctacagttgtcggaagggctgctactgctaacggaaccttggaagagcggtagatatgtagatctgttaactaaaaagcgcattgaagatgatattgctgaaaacatcatcaaggaaagcggtggagagatagccactatgaaccaaatcgagttaccaactggggttactattgatgaggaaaaatataaagttgaacaagcagaaagatacctaaaagctgcaagcaatttcctacaaagatcttttgaatatgctaaagcagttgatctcgcggaggaggtaaacttgattgacttgtctgatgatgaaggcgaagaaaagcgaacggtaaaacaaaaacaactggaaagcataaaggcaaatgcagccctagatcccacccatccaaaagtaatagatttgccaacatttagaatgatcatcctcgcagatgaaacttacgagcttttcttttctaatactttacgatcatctgttcacgtcgacgaacatgtcaacattgataacaaaaataaagtcctcagaagtatgtttgacggtatattggcagacggcaaaagagttgctgagcaagttcgtcgtcgtgtcgattcggtggcaactaggagcagcattgcttctgtagagagtacgccaacagccgctgcaagttcaataactaccaaagaagaaaagtacgatgatctagatgatttcacgtcagagcatcaacccgagaatgaagagttattacaaagttcctggtttgagatcgacgatgccaatgaaactagcactaaagccatacaagaaaggtcttttgagcctttgtcggcaaattcctcggaagagaagtccaaccttattgaatttgaagcatgaaatcgtgcttatcaattttatgtcaccctaaaacatctgtacgtgtttatatagatatttaaagcaatatttgccaggatttggtgaagatccctcatataactctcataaatgcggattttcggagcgaaaaaagcctaaattcttgtctggaagtataattggcggtgaaatagaaaaggtggcaatcacgactgaaaagggtacagctttcgcaactgacatatacagacagtgaaaagtaataaattgcccaagtgtgaacatgtcaggtgtaagctctgttatgctcggtcttcgacctgctacaagaatttttttccgcagtaatatttcggtttcaccttcgaggacttttgtatcatatattggaagatcccagagcacgtcgatactcaaaaatgctcccaacttagaggacaatgtcacaaatcttcagaaaattataccgaaacggttcttttctcaaacatcaattttgaaatcaaggtggaagcctatattcaatgaagaaactactaatcgatacgtacgtttgaacaggtttcagcagtaccagcagcagagaagcggcggcaatcctctgggctctatgactattttggggctctctttaatggcaggaatatattttggctccccttatttgttcgagcacgttccaccctttacgtattttaagacgcatccaaagaatctggtatacgcgttattaggcatcaatgttgccgtatttggactatggcagctacccaaatgctggaggtttctacagaagtacatgttgctgcaaaaggattacgtaactagcaaaatttcgataatcggaagtgcgttttcacatcaagaattctggcacttaggtatgaacatgctagcgttgtggtcctttggtacttcactcgcaacaatgttgggagcatccaattttttctccttatatatgaatagtgccattgcaggttctttgttttcgttatggtatccaaaactggcacgcctagccattgtcggacctagcttgggtgccagtggagcgctatttggggttttaggatgtttttcatatctattcccacacgctaaaattttgctgtttgttttcccagtcccaggtggggcttgggtagcattcttggcttcagtggcatggaatgcagctggttgtgctttaagatgggggtcatttgattacgctgcgcatttaggtggctctatgatgggggtcttgtacggatggtatataagtaaagctgtagagaaacaaaggcagcgtcgccttcaggctgctggtaggtggttttaatcacttaaaaaaagacacattctcattcgaaatattgtaaatactgctatgtcttctatgtacttaatcttatttatgcatttgaaaaatatttcagccttatcgtggtggtacatgtacaagaaaattcataggcaaaagaatatatagaatagagcgtatgtgttacttttctaagtcttacttcctgtttttgagtagtccctctttgacaacaaaatatgcatttttggattccgcggcaagtccagttgctttccaagatccgctaacttctcctagctcagcatcctgcttttggtggctgatgccttcaagtagctttgtgtagttcagctgtttcgtatttctttgcaccaaccgagcatcatattccttggtgtgcttttcaccttcgacaggtatgttatggagtttgttgatgaatgataattgcttggcaagtcgcatttgaatttctttaatatctgctccttccaagggaagacctgataaccgcaacaatttttttacagcttcagcagacggtggctctagtttttcctctttagtgtttatgcctaaatattcgtggacggaccatacaggtcttgataaataatcccttatttgattcatattttcaaattttttaccaatctttgcccctcccgtagatacgaaccgatgacttccatcatggcataacccacccactgtatgtgttctgcatagacgccatgttttgtacatcgttctagcactatgggtaagtgcaaatagttcgatctaaaagcctaaatgctagtcactattacctccttgatgttatatttacagaataatgtcatgtcgtctgtggtgactattattattgcctgaaaaaattaaagaaaattttttgcgatgagatgagatgagaaaaaatgaaaaattttggaaggttaattagagatgtgtagtaaatcctgctggtggaatacattttattcctgtagaaaatagtatagtaacagcggtatcctacttatacaatgagaatcaagaagaaaaacaccagaggtaacgcaagaaactttattaccagatctcaagctgtgagaaaattacaggtttctcttgctgatttcagaagattatgtatattcaaaggtatctatcctagagagccaagaaataaaaagaaggcaaacaagggctctactgcaccaactactttttactatgctaaggatattcaatatctaatgcatgagcccgttttggctaaatttagagaacacaagacttttgctaggaaactaacaagggctttgggtaggggagaagtctcttctgctaaaaggttagaggaaaacagagatagttatactttagaccatattatcaaggagcgttatccaagtttcccagatgctataagggatattgatgatgctttgaatatgttatttcttttctctaatttgccctctaccaaccaggtttcctcgaaaattatcaatgatgctcagaaaatctgtaatcaatggttagcctatgttgccaaggaacgcttggttcgtaaagtgtttgtatccattaaaggtgtttattatcaagccaatattaagggtgaagaagttagatggttagttccattcaagtttccagaaaacatccccagtgacgttgatttcagaattatgttgaccttcttagaattctactcgactctattgcatttcgtcctatataagttatacaccgatagtgggttgatttatccgccaaaattggatcttaaaaaggataaaatcataagtggtttgtcatcatatattctagaatccagacaagaagacagcctactaaaacttgacccaactgagattgaggaagacgtaaaagttgaaagtttggacgcatcgacattaaagtctgccttgaatgccgatgaggcaaatactgatgaaacagaaaaggaggaagaacaagaaaagaaacaagaaaaggaacaagaaaaggaacaaaatgaggaaacggaactagatactttcgaggataacaataagaacaagggtgacatcttaatacagccaagtaagtacgattctcctgttgcttctttgttttctgcatttgttttttacgttagcagagaagttccgatcgatattcttgagttcttgatcttatcttgtggtggtaatgtcatcagtgaagctgctatggaccaaattgaaaataagaaggatattgacatgtccaaggtcactcatcaaattgttgacaggccagttttgaaaaacaaggtagctggcagaacgtatattcagccacagtggatatttgattgtatcaataaaggcgaattggtacctgccaacaaatatcttccaggggaggctcttccacctcacttaagcccatggggtgatgctattggttacgatccaactgctcctgtcgaagaaggcgaagaagaagaaagtgaaagtgaaagtgaaagtgaagatcaagttgaggaggaagatcaagaagttgttgctggagaagaagatgatgacgatgacgaagagctacaagctcaaaaagagcttgaattggaagcacaaggtatcaaatattctgaaacttcagaagctgataaggatgtcaataagtcaaagaacaaaaagagaaaggtggatgaagaagaagaagaaaagaaattgaaaatgataatgatgagtaacaaacaaaagaaactttacaaaaaaatgaagtattctaatgctaaaaaggaggaacaagctgagaacttaaaaaagaaaaagaagcaaattgccaaacaaaaagctaaactgaataaactagattccaagaaatagttttctcttcttttccaatagcctctcaaaaattttgtcttttaatttaacatctttattactttataattcctcggtatagcaacattagatatataactacacatttttgtttgtagatatagaaatacctgtacattaaaagtggttactgttgttctgtataactatatgagtgaattttgtaaaaatatgcccaggtgccaatgattatattagaatatttccatgtgctaccctcgagtccattgactgtctatcgggtacacttaactctatatagccttgtagttccttttttaagttcatcaaggcagtctctgtatagtttatacgatcgatatcggtccccctactaacattgatgtatgcttttaaaaggaaccctccgcttgttatttgtgaattgcctgcttcttctatttgccaaattttttgtaactcaagtattaaaccatgcttcataaaaaatttcacaccaattgtaagatactgaaattcgaatacataacccaatccgttcatgagcgaggatactgaagagtttttgccagctgaagataatatgatagtctcagctatcgtttgcattgaaacacttctattgtttcctgcagcaggaatatctgaaatttgcaatgaccaaggggaacatgactcgtttgaaggggcgggacttgcatccatgtcgacatctatgatgtcatcgctgtttcgactttcatttacagtatcttctgtatgcttactgttgttttgatcttcgtttgtgctgttgaagttggtgacttgcggaactgtgttgtgcaagatattccgtgtcatagcatagttaagcgggattttatcgtttgtaaaagatttcaagattctaaagtttaatggcttatccatcattgtttcatcgatcaggtaagaaaatggcacctctttggaaagttttattctatttggttcaaccaattggtttctagagttcacgttctcgacgtcgtaagatggatttggtttccagacagtgcataaactgttatacagtagcggaggattacctgatattgtggtcaaagttgaaattagtaaatcgtagccgtcatcaccaatagatccaaaaaggcttagttgctgaaccatcttttcttcttaatatggaataccttggctggaaaattcaattttctacctttttttttattttggttgtttgtcttcgatatttgataattttctaggttattttatttttttcaaataaaagaaaggcaaaagagctctcactatatattactaacctgcaagctaaaatgaacgcaatactggaaagcaatagtagaaactaaccaagacttcaaaagaatcaaataatggctgtagatgttcctcgtgcggtgattaataaacttatgctgtttactgcagcgatggtggtactgcccgtactcacttttttcattattcagcaatttacgccaaataccttaattagtggaggtttagctgctgcaatggccaatgttgttctaatcgtttacattgttgtagcgttccgcgaggatactgaagatcacaaagttgatggtaataaaaaggaagactgattgagtagtatatgttgctagaagagaatatacaagaaaaatagtagaggctaaataaaaaaaaagtagcattaaatgttatggatgattgggatatatatgcaaataacccaatcttacatatgtttctttcaaatatatgagtatatataacgattaattgtttttttttattgggtttgttgatttttccaacgcaccatatgtgatatccaaattagatatccaagaaagtgcaacaatcaaaatgaacaatagcaacgcagaaactattaaacacattagtagtccttcagtccagatggagcttaaaatatcatcgtcgccttctttacccttgttgttatcatgatggctcaaagtctcttctgttgcatattcatcgtcaccatcttcatcttcaaaagcccaaccaagagagttaataaccacagtcaaattgtcgccagatttatcttccaaaaacgataagcaagaatcaataaattcatctaattttttcaaatcgtaggcatccgaggtaaacttgaacaaaacgatgcttttatcatctaaggagtattcatatagtaagtcagaggcactttcaggtaattcatccacagtaaattgttccataatgggagataatgattgagagatgttcaaaggcgaatcgtcatgaacagttaaactgacatcattggcaaagaatctattgaagaatgggtattcttcgtcaatcatcaagttgtccaataatgagaaattgtcaaattcaaaaacagcgatagcactgtcaacggatgatataacatctgccgttgaagatatagtgctgatggtatcccagttactctctttgtcgaacgaaataaaggaagagctttccttggatgaatctgcttgcacagttttggaaatacaacatgataacgtgaagatgaaaagggcatacagctgaccgaacaccattgctttaactttacagttcgattcttattatatatagtcacagcagtggttattatcaatgactttttaccctttttattcttgctataaacttatcaacagtttgctcttataagaaatagcgttctttctttctttcgtgtaatgtgacacaattttgctattgcggaaactgcagcatagtcagtgtaataatcgtactgttgctttttcatttttttttttttttttttttttctcatatagaaaaactgttattgaatgttttgactagtctcatgaaataaacattaatagttactaaagggttcacagcaactatgagaggaacaaaggtcacacaaatgatatcccttgtgttcaattgctgctaattatccgtggcggtttcacttgtattataacaacgaagcgtatctcagacagaagttatcgtactgttctcataataatgatgaggtgcgttctttctgacgctccgtacaaagtggtaatgttgcaccaattgttcaaacgtttctttcgtttataaaaagaatttcttaacaattcagagataattgaaatagcgacatgaagttatgagcttccttcaatctcatttttcgtgttttattcctttcaagagatggttcggacacacctcatttatcaatagagatgcctcagatatgaaaatacttgtggattttgtaaagattcaacctgtatggtctgcgtggattgccacttatagggcttttcaaattagtattttaaaggagttagatcggtttcaaaaggtcatgctccggagtaattgacttgattttgcaaagcttcacttaaatggcgtatcttccttttataaattgcgtttgctttattcccttacccaacagatgaattggtactctggccgagtggtctaaggcgtcaggtcgaggtcctgatctcttcggaggcgcgggttcaaaccccgcgggtatcaatatttttttgaatctacgcacttcaataagaattaggctgttaggatagcattttttttctatgtaccaaaagtattcatacgtggctccttgttaccccacaaaacttttttagacttgagtgagctgaaagacacctaaaaggaaggacattccattgatggctattgtagccaaaaaattaaaaaagaagaactcctcatagggggctcgaacccctgacatttcggtatccttgcttaagcaaatacgcttaaaagccgaacgctctaccaactgagctaacaaggatgagttcttcattttttctgtagtactctcttgtacttgctatctagtaaaagataaagattgagaaacagtcactaaatttaatagaagctaagatgcaaggattgatactgtattaggataatgtaatatataaaacggaaggagaaataatcgcaatattattatgtagaaatactgattccattttgagaattcctatatcctggaggagaacttctagtatattatgtatatacctagtataatagcgtttaccaatactggaatctcaatgattatcagattactcacgaatttctttaatagaataatgaatgataccatacaaaatggaaaaataaaaattataaaattttcatgtacaattacagattcctttttggggatttctatattctcgaggaggaattttaatgcattccgtatgcccattaatatggcatttgataacaatgaatcccaaaaactgttccaagattcatatatttctcgcacccgttcccctaaactttatcccatcttagcgggttgaatccacgttaacgttccactagtagattttccacttctgttacacttactgcgcaagtggctcgtttatcgtttatttactttgaaacagtgcgacggcactacaaaggagcgcgtaacaaacgttactatcccgtttcattgtttcagattatcaccatagttacatatgtagggaatggcaaccaacctgttccaacattctattcagaccgagaaaatccagtaggacttaacggtggttccgaaattctatttatatcattgctattagctttatgtatattggcaattgaagcggttcttcttcatgacataatagtccatcaactgttcgtgcaattgatacaaattaattttgaaggcaatatttaagtttggttttcttacgcagaatactttttaaagtatcaactttcgtgcatcagcttctgtcaggttcaatgattgtttaattctggtcttcaggtcatataatttcacaccattttttatcatcgcttcttgaaaattcgatgtaaggtaaataatagcttcagtttgttgcatgagtaatatgcggaagataactgattgttattttagcagaaatcaatcaagatgaaaatatccactacttcgaaaatacgtagcaagccaagttcaatcggtaatctataggttcggcaagagactttgcaatgctaatgtttacatttccttgccacagttctcgttggaaacaagcctaatgttaacgtattttcacccgcattaaactacaattgttttggacgtaagaatttacagcgcaattgttcttttctattttatcattacgattgttccaagagcttcttgcgttatttaccatatattcttgatctatgaatgataataaacaagagtaaatgaatgttttatatgttcataatgacaacaactgggggggaaatgaaaatatttatcttctattcatagtaaaaataatcttaaaattgaaactaacgctgaaaactgcaacagttacggcattttttattgatgcgtaaaagcattgtctttgtcaatttttgaactatcgaattgctccataatatcattcatggtgttatccaattatttagtaagcttcgcttgtactcagtcattttttttttttgcatccaattttattgaaagtccgcccgctctgttaaaaaaggcgtttcttccaaatttgaataggacacgatcgagattccctccgattaattatgtgctactggctcctctttcgtcgtattgcaagtggacttttcaacgaggctatgcatgcccagtgtcattcttgaagcaggcacacacagacgcgcttcaattagttttctttactagatgcatcatttgggcggtttttcactaccgttttcgagtaggggctctcacaaaacgggcacgaccttttgtttacaaccgcccaaagaggaaaaacatcaacaatcaagaagcggacacaaaatatagaagcaccataaaactcacgtcaacggtaactttaaatttgttgtattaattaatcattttcaacttgcatttttacagcatcatttatgggtatcctgcaagttaggtgcggaacgtacataacatattacttcaatttgcgttccgcatacggtctgcccaatttgttttgtttgtgatttcctcattcgtcttcctctgcagaaacgggtttgatccttcttttatgaatacggcgtgtagttatatatattaagtaatagaagttattgcacttctgtgtaagaagaagatactagggtgatctattctaggcaattttggttgtattgtgttttttacattcggccaaacttgagcaggctgcaattttagtgtcttcggtttttccagcgacagttttacttgtggctcttggtatagtttcttaaaactattaaagttgctaactggtgcagctgtttagatcacaaaagcgtaattaagaataagatctaccaacaagaacagagccaaaatattttcgtccgttatatcaaccatcaaaggaagctttaatcttctcataatgtcacgatcccttttggtagagaatagtagaaccattaatagtaatgaagagaagggggtaaacgaaagtcaatatatcttacaaaagagaaacgtcccaaggaccattctcggtaatgtcacaaataatgcaaatatcctgcaagagatttctatgaacagaaaaattgggatgaagaacttctcaaaattgaacaacttctttcctttaaaggatgatgtttcgagagccgatgacttcacctcctcttttaatgacagtagacagggggtgaaacaagaagtactaaacaataaggaaaatattcctgaatatggatattccgagcaagaaaagcagcagtgctcaaatgatgactcttttcatacgaattcgactgccttgagctgtaatcggttgatatactctgagaacaagtctatttccactcaaatggaatggcagaaaaaaataatgagagaagattccaaaaaaaaaaggccaatatcaactcttgtagagcaggatgaccagaaaaagttcaaactccatgaattgactacagaagaagaggttctggaggagtacgaatgggatgacctagatgaagaagattgtgatgatcccttaatggtgagcgaagaggttaatgatatcttcgattatttgcatcacttggaaataatcacattgccaaataaggcgaatctctataagcataaaaatattaagcaaaacagagacattttggtgaactggataatcaagattcataataagtttggccttctgccggaaactctatatttggccataaacataatggatagatttctttgtgaagaggtggttcagttaaatagattgcaactggttggtacatcatgcctgttcatcgcatctaagtatgaggaaatatactcccctagcataaaacattttgcgtacgagacagacggtgcatgctctgtggaagatattaaagagggtgaaagatttatattggaaaaactcgattttcaaattagtttcgctaacccaatgaatttcttaaggagaatatcaaaagcggatgactatgatatccagtctaggacgttagcgaagttcctaatggaaatatctatagtggacttcaagttcatcgggatattaccgtcattatgtgcctcagcggcaatgttcctttcgagaaaaatgctgggcaagggcacctgggatggcaacttaatccattatagtggtggttacacaaaggcaaaactatatcccgtttgccaattactgatggattatcttgttggatctactattcacgacgagttcttgaaaaaatatcaatcgagaagatttttaaaggcttccataatttctatcgaatgggcattgaaggtaaggaaaaatggatatgatattatgacattgcatgagtgaaggtgctagcctacacagaaaaccaaaatctcacttccttactttatcatctattttatagaaaaatcaggcattcattattcatataacggttatctcatatatattatcacacggtatcagttttgtaggctgtaataattaattcatttataaattttttctcccataattggaaaattatctttaaagtgaggaataatgcattttctttctttttttgaatacataaaagaaataaagaagtatgtctatcgatgatatttaagatgcagggggttagctggctataattttgatctatgtttcaacgtttttgtttacaccagtcaaaaaccttgaaataaaccatgccatgtttaggctttttgtatttaagtctcaaggaatctagattcgtatcaggtacagcaatatcttcaactagttcactgataaaatccttaaacgctggatctgattcaatatcaatgccgccactataatgaataaaagtttcatcccatttggaattttcatttttaatttttctggcgatatacatggacattgcagctaaatatgatggcttcaggtggatgaatttattacaacaaatcgaatattccatgatgaatttggccatgttccttgtttcaatgcagtaattgtcagcttttgaaattctcctaatgaaatttagggggtttggtagagatatgttataacctaaagaacttagaacgaatagctcagccttcctaattccttcgacagtggcagcaccgtcagtcacgtacgcaaaatttgttatttttggtaatttaacttcttcaaatttacaggcaatgaacaggcaagtgatgcatagtagttgtaatttattcaatttaacaacattttgtgataaaaatcgatctagcaggttgatcgctaaaaataatgtttcaggtaagcagtgaaatttctcatgaacttcaaccaaccagtcaattaacagcgccctcatggagcttttcaaatgatagggagattgcgtgtccattaaatagttatgtgtcggtagcatttggatttccttctcgtaaagatgagaaaatatagaatctgtatattctgctaccatgaatggatcatccatctctatcgaatccaaatttttccattgatgacattttatttttttcacagtttttggctctataggatcggttgaatcatttgataattgtctctttcttgttttttccaaatgggtggaatctctttgcaatttacctcgagggagttgtaaagaatcgattttgttactgtttacctcggatagaacttttttttcattcgtagagtgaggtgtcaagttaattgaactttctcttggaatggtatggaaagcattttccttgcctatacaatcttcattattaatttggattttcctttcactaattggactagggatacaattcattttaaaaatttaaaaggagggagagaatatcagagaataataattttcaacacactgatttgtatgttgtatgaacgctagattagtgaagcttgttattatttaataaaagataaaagtcacttgtatgaaatgaagcagttatatatatgttaataagaaaaaggcaaaaacttaaccctagcaaaaaaggtaatcaatgtgctaaaacggtaaatatttaaacgcaggttgcgaattgccaattgccaattgtaggatacacagggagagtagaaacaaccaagtcctgtgtcctgtggtagacccacttgttttaccgcagagggccctttttttgtttaccgtcgcaaaaaaaaaacgcgaagaatacgcgttggtcgttaaattttgtggtacgcgtaaaactgctatttggtatcctctttagggacgcgcccattgtctatacggtaatatagggctttcttcattacctgcttgcgtcaattagctttactcatgtaacacataataacctcttacattgtaatgaggcccaaaaaaaaaaaaagaacatcttcaaaaaaaaaaaactttcatggaaggaccacctagttaataaaaagctcgcactcaggatcgaactaaggaccaacagatttgcaatctgctgcgctaccactgcgccatacgagcttgattttctgaaagtgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacacctggtagcgttaaaggttactaattgttcaaacgaaccatcgaaaagccgaacctagctacaccacaccccagtatgagctttatggatcaaatcccaggaggaggaaattatccaaaactcccagtagaatgccttcctaacttcccgatccaaccatctttgaccttcagaggtagaaatgactcgcataaactgaaaaactttatctccgaaataatgttaaacatgtctatgatatcttggccgaatgatgccagtcgtattgtgtactgcagaagacatttattaaaccccgctgctcagtgggctaatgactttgtacaagaacaaggtatacttgaaataacattcgacacattcatacaaggattatatcagcatttctataagccaccagatatcaataaaatctttaatgcaatcacgcaactttccgaagctaaacttggtattgagcgtctcaaccaacgattcagaaagatttgggacagaatgccaccagacttcatgaccgaaaaagctgccataatgacatatactaggctattgacaaaggaaacctataatattgtcagaatgcacaaaccagagacattaaaagacgccatggaagaggcttaccagacaactgcactaactgaaagattcttcccaggattcgaacttgatgctgatggagacactatcatcggtgccacaacccacttacaagaagaatacgactctgactatgattcagaagataatctgacccagaatggatacgtccataccgtaaggacaagaagatcttacaataaaccaatgtcaaatcatcgaaacaggagaaataacaacccatctagagaagaatgtataaaaaatcggctatgcttctattgtaagaaagagggacatcgcctgaacgaatgtagagcacgtaaggcgagttctaaccgatcttgaactcgaatcaaaagaccaacaaactccttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcatataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccattcagagtgtagaacctaatgctactgatcacagcaataaggacaccttttgcactttgccagtttggttacaacagaagtatagagagatcatacgtaatgatctcccaccaagacctgccgacattaataacatccccgtaaaacatgatattgaaattaaacctggcgcaagactacctcgactacagccataccatgttacagaaaagaacgaacaagaaatcaacaaaatagttcaaaaactgctcgataacaagttcattgttccctcaaagtcgccttgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcacaccatccggtaagtatgaatataccgtcatgccatttggcttagtcaatgcacctagtacattcgcaagatacatggctgatacatttagagacctgagattcgtcaatgtttaccttgatgatatattaatattctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccaaattgctccaagattgcacagccaatccaactgtttatttgtgacaaaagtcaatggacagaaaaacaagacaaggcaattgataaactaaaagacgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttggaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacctagctggacccaagaacgttgtcgcagatgccatatcccgtgccgtatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactatatcatgaccataccttatttggaggacattttggtgtaacagtgacccttgcgaaaatcagcccaatttactattggccaaaattacaacattcgatcatacaatacatcaggacctgcgtacaatgtcaactaataaaatcacaccgaccacgcttacatggactattacaaccactccctatagcagaaggaagatggcttgatatatcaatggattttgtgacaggattacccccgacatcaaataacttgaatatgatcctcgtcgtagttgatcgtttttcgaaacgcgctcacttcatagctacaaggaaaaccttagacgcaacacaactaatagatctactctttcgatacattttttcatatcatggttttcccaggacaataaccagtgatagagatgtccgtatgaccgccgacaaatatcaagaactcacgaaaagactaggaataaaatcgacaatgtcttccgcgaaccacccccaaacagatggacaatccgaacgaacgatacagacattaaacaggttactaagagcctatgcttcaaccaatattcagaattggcatgtatatttaccacaaatcgaatttgtttacaattctacacctactagaacacttggaaaatcaccatttgaaattgatttaggatatttaccgaatacccctgctattaagtcagatgacgaagtcaacgcaagaagttttactgccgtagaacttgccaaacacctcaaagcccttaccatccaaacgaaggaacagctagaacacgctcaaatcgaaatggaaactaataacaatcaaagacgtaaacccttattgttaaacataggagatcacgtattagtgcatagagatgcatacttcaagaaaggtgcttatatgaaagtacaacaaatatacgtcggaccatttcgagttgtcaagaaaataaacgataacgcctacgaactagatttaaactctcacaagaaaaagcacagagttattaatgtacaattcctgaaaaagtttgtataccgtccagacgcgtacccaaagaataaaccaatcagctccactgaaagaattaagagagcacacgaagttactgcactcataggaatagatactacacacaaaacttacttatgtcacatgcaagatgtagacccaacactttcagtagaatactcagaagctgaattttgccaaattcccgaaagaacacgaagatcaatattagccaactttagacaactctacgaaacacaagacaaccctgagagagaggaagatgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacagaaagttccattttggatgctctatttatgggaatatgactatacgaatgtcacccacgatggccggagtagctgtgatgagcatctttttgtcctgggcggcttaaaacgtgagcaaaattgtactgtaaattacttacgttatcaatggaagtgtgtgaatttcgtgataaaattattgtcagaatagtgacttcattattctttataactaaccattaggatcatataagtaatcagatgcagttcgtcattaatatgtcaggatggataaccataggtaagcacgtgattatggaaggacagtaaagttaccgatctacttttttgaatgatcaacttggtgttttcatctataaggatatgggtcgttacattgaaactatagtaaaagatctcgttattggtatatcggtcataatgaagatgaaatagtcggtatgtatttttatacccccccctatatggtaaaaaggttaagattcatatttaaatcttcattaataccacctctaatttctaattaccaacatttttaactccacttttattatatgctatatacaacattatgtaaaaggagtataccaaaaattctccttcataatataggaattcacaaaatggaaccgatatctccgcataatgctattatcatttcttactcgttttatacattgtcattcattatcttattgcatttgcaatccttgttttccggcttctgtgaaatttgacgactgattctcaattttatgtcatctttttacacttatatatgacaatatactagtagtatgaagactaatcaacggaggttatttgatttctattctaacttatttgaacatatataatttgtaaattttatgcagattagacttgggagttatcacaacattttgtcagtgtttagcctctttcacctttgcctttttcagccttttttgtgtaaattgatggtgtagtttgtttctgaaagggctctttttatttttttcgcttccgccgttcgttattggataatccccgaaatatgctagagtggctgatacattatagaacataaaagtgagctgcaatgagcactcaagcacgttattgacaaggataacggaaaggtacactaatacttatactgattaataagggttagccttttaatgttcaagtcaactttaaactccataataagaagacccttgaaaggttttcaacttcttagaggggctgactcatcgaatacacggccacagtcccctagagcctccgcaagagatgttacagagaaacagatattaagaactccgtcagcaccaactgcaataccattaagggagattatctatagagtcccaagcttgtttcctcgccctttagaagattctgttaaggacttccgagattttatcaagaacgaggatgcattccagactgaacttttgaaaacgctgccattctaccccactccttcggaatcaaaaacagcaagacttataagaactgttgttgatgatgagggcaattacatcaatgaattttgcatacgccctcgaaaaacctcagtgcctgaggctgacttaaaacatctggttttcattcatgggtatggcgccggattgggttttttcatcaagaattttgaggatattccactattggataacgagtggtgcatacatgccatcgatttgcctgggtatggtttttcttcaagacctaagtttccgttcgagtatccgagagataatattcacagcgttcaagattggtttcacgaaagaatacacacatggtttagtaaaagaaatcttttgaaccgacctgagaaaaacattgttatggcacattctttagggtcttacttgatggctttatatttgcaaaaatataaggaatctccatcttttaaaaagctgatcctttgttccccagcaggcgtgtcttatagagatttcaacaatactgcttcagaggttgaaaaatggaaaccgcctccttggtggtatgtcaagctttgggacagaaatatctcgccttttacactagtaagaaattttcgccagttaggttcgaagattacaagtggatggtcatatcggcgctttaagcacattttgaatggtgatccagaacagtcaaaacggtttgaagccttgcatagatacgcatatgctattttcaataaacgtggttcaggtgaatacttattaagctttgctttgaaatgtggtggtgaaccaagactatcattggagcagcagctattcgatggcaaaaagtctgatattttaaagaatagtaattgtgactggctttggctttatggcgatgacgattggatggatgtgaatggtggacttagagtatcaagattcttgaaagagaagttgaaacaaaaaagtaacgtcatcattgttcctcattcagggcatcacttgtacctggataactataagtttttcaataatattcttacgaaagaaatgcaaaaaatataatgaagaaatcttgtgcatctacattatataacgaaatttttacatacattttcgccgctatttttcttcttatctcaaaatgaaattaccgtttgcaatcaacaccggtcgctgttttattttgttcataataataatttagatacagcatgaactgtatattaaagtcaacgatttcaacaattcatttctgtgtaactatttttccaatagaaccactgtctttatggagtagttgggctctataaaaattatttagttccaaagtttgtttatattttgtttctataataatgtattgaagatataaacaaacataattttactgttaacatttaggcgcaacaaaaggacgatctttttttatttatcacaagttaaagattttcgatacaaataatattgtggtttaaggtacgtccaactctacttaaatcactgaatccttcagataacgaaattacgaataatatctactctgtttctccttgtctttgttctttcttgcagccagccaagcccattcgggatcagagattcaaatatccctgacggctggttctggattaagttgattttgtggaacttctgtcttcacaattatattgttacccacttaatgcttctcgggggttagaaacactagcacttgaaagaacatgaaaaattgaaaaaaaaaaaaaacaatgcacaataaattccaggggttagcgactttatacttcttctgttagctactgtagtgttctgtacacatattcacttgtagaagttgattagaatgacagcctcatcaaatgacgatgacctaatattcgaatgttatagcgatcctgagttaaaaagatggacacaccttgctaatgcaaaagcttggaaaggtattctgaccgtgcagcagtacgctgatagggaacaattgctagggtcttcagagatttctcaaaagaataaatcaaatgaaatgatgacaaaatacccaaaaagttaccagtggcttgggcagaagtactttgttttaaaggatcgatctttgccagataatggaaaatttagtcaagttgtttccagttgcgaaactttaaacaggattggatattgtattcatccgggttctaatggaaaaatcgagccagctttgattgtatgcattgggggcgtctttacctttgaaaaccatcgcggcaagggctacgccaagaagatgattatcaaactgaatgaattttatgacaagattcgtgatgacgctaacaccgtactagaattgaaaaatttggtgattaacctttacagcgaagtcggagaatattattccgcattaggatacgagagtatgcatgttcccttgcaccgcatttctaaattagatgaacttactgagagatactgtggagaagatgatgaccatgatggtaagtacttgggatttgatgattacaggggtttagtaggactacatgagacacagttcaaagaaagcttattaagtttacacaaagaaaacccagagaagtttgtttttaccgttgcgccagactttgacattttcacatggtttcagtatcgtgatctttttatcatgaataaatcaggaagaaaagcccagcaaaatctgttttttggatacgcgttgagtgataacagccacatcatatggcatcacaattggaacggtgattctctgattattgtcaaaatccatatacctgaagaaacatttcaaaggaaagaattgaagctcaaaaaattactaaggaaggccatagaagagacaaagcttcatggattgcaagaattagaattttgggacgaagaaattcccatcaaaaagtacccacaattgtttcagttattaacagagcttgaaaatgaatctaaagttttctcagaaaacggttccatcagtgctgttcgtccccccaaaggatatacagccgagcaggtaatttgggataacaataccaaattctgttggttttaagtcaaatattgtgttgcttatacaggaaaagtcaaggtttcaaactacatatcattatttactgttaaaattcacatatactaatacatacggtaatagattgaacctcttctgtgctcttctctaaaagtacttctgaacgtatgtgtcatttttcctttcagttttctttgtagctcgcattgatgtagccgagtatatttaagggattcttatgcaatgatgaaatatttttcacctataacgccgactactgaaaacagagggccatcttaaccgttttgcattcagtaacccatactcaggatttaataaaagaggaaagcaatgtctctactaggcgccaggtccacttaccgttggttttcaatcgctgcatcaattccgactaagaatgctattggcaaatccacgtacctcttagcttcaagaaatcaacagtaccgaggcatcataacgtcaactgtagactggaaaccaatcaagacaggtaagagcccaaatgatgattctcgaagagaaagatcctttggcaagaaaattgttctgggtctgatgttcgcgatgccaataatatccttctatttgggaacttggcaagtaaggagattgaagtggaaaaccaagctgattgcggcatgcgaaactaaacttacttatgaaccaataccacttcctaagtcatttacacctgacatgtgcgaggattgggaataccgtaaagttatacttaccggacacttccttcacaatgaagagatgtttgttggtccaagaaagaaaaatggagaaaagggttattttctgtttacaccgttcattagagatgacaccggtgagaaagttctgatagaaagagggtggataagtgaagaaaaagttgctcctgactcaagaaatttacaccatttgtcgttgcctcaagaagaacacttgaaagtggtttgcttagtaagacctccaaagaaaagaggctcgctacaatgggcgaaaaaggatccaaattctagattgtggcaggtgccagacatatatgacatggcaagatcatcagggtgcacgcccattcaatttcaagccttgtatgacatgaaggaccatccaataatcgaggaacacacaagaaacgaggcttcacaaaacaattccacctctagcctgtggaagttctggaaacgagaacctacgactgctgtaaacggaacgcaagctgttgataataatacatcgaagcctcgttctaggcaggaaatgccgacagaccaaacaattgaattcgatgaacgacagtttatcaaagcaggtgttcccataggccggaagcccactattgatttaaagaataaccatctacaatatttggtaacgtggtatggcctttcgtttttgagcacaatcttcctcattgtggctcttaggaaggcgaaaagagggggcgttgtgtcccaagaccaactaatgaaagagaaactgaagcattcaaggaaatatatgtaaacggcaaactcctctgcccatactatcgaactctatccaagaagcgcgtaatttcacgagcactgcctaaacggttttccacattagttttgcaactacaatgattcggatatggcacatttacataatttaaacttgtacataactaacacctttttatccatataccttatgtgccgctcaagatatgaacattgcgcgttgcccggacaatatcgataaataatagccaaaacaaacatgttttatcgacgcatgaatcctttggcgttaaacttgtccaattgcactgaaacttggagcgtataagctcagcaattgcaccaaaacaatatcagaaaaggcttgtattgccactttcacctatgagcgaagataaagctaaattagggaccacaaggtctgccacggaatatcgtttatccattggtagcgctccgacttcaagaaggtcgtctatgggtgaatcctcatccctgatgaaatttgctgatcaagagggattaacgagttccgttggcgaatataacgagaataccatacaacagcttctgttgcctaaaataagagaactgagcgattcaatcattactttagattccaatttcacgcgcttaaattttatccacgagagtttagctgatcttaatgaatccctaggttcgttgttgtacggtattatgagcaattcatggtgcgtagaattctcacaggcgcctcatgatattcaagacgatttgatcgctattaaacaattgaaatcgttggaagatgagaaaaataacttagtaatggaactctccaatatggaacgcgggattaaaagaaaaaaagacgaacaaggtgaaaatgatttggccaaggcatctcagaacaaacagtttaaccagccgctatttccctcctcacaagtaagaaaatacaggtcatatgacaacagagacaagaggaagccctccaagataggcaacaacttacaagtagagaatgaggaggactatgaagacgatactagtagtgaagcttcttttgttctaaatccaacaaatatcggtatgtccaaatcatctcaaggtcacgtgactaaaaccacgcgtttgaataataataccaacagtaaactgagaagaaagtccatcttacatacaatcagaaatagcattgcttccggcgctgatttacccatcgaaaacgacaatgttgttaatttgggagatctgcatccaaataatcgaatatactcggaagtggtgctgcaagagtggtcaatgggcccgttacgaagaacagaaattcaatgttctcaggacgtgctgaaaggaaacccacagaaagcagacattctgttgcaaagaaaactgaaaaaaaaataaatacaaggccccccttcagatgactacgcccaacccaaccaaagaattatcctcctcacaaaatatatcgctagcatgcgtgagttatggataagaagaatatttgatgagctgactgattctttatagcaatagggaggaaggcagtacacatatcagcagtgcatgggcacaacccgcattacaacgaaacatgatatatctatataaaagaagatacggacaggcggtcgaggctattactgtgccactatgcgagtcatgaatgatttttaaattagttagtacccctttatataacgtcttcaataaaagtgcgggaaaattcgggtaatattttctataactgtcatttttttttcgttatgtatggcaaaccaaattgacaagaaactggacaacggttaaagcaaaaggaggaagaaagatattgatttgtgctttgaagaataacccaagcgaacaggtcattaattgcctagaatctttacatagaatttgccttttatggaagagacgggagattcgaagctggtccctagggacgaggaagaaatagtaaatgacaacgatgaaactaaagcgcctagtgaggaagaagaaggagaagatgtctttgactcctctgaggaagacgaagatattgatgaagacgaagatgaggcaagaaaagtgcaagaaggcttcattgtcaacgatgatgatgaaaatgaagacccaggaacaagtatttccaaaaaaagaagaaaacataaaagaagagaaagagaagaagatgatcgactatccgaagatgatttggatttgttaatggagaatgctggtgttgaacgtaccaaagcgagctcctcttcaggaaaatttaaaagattaaagagagtaggagatgaaggaaacgctgcagaatcagaaagtgacaacgtcgctgcatcaaggcaagattctacgtctaaattggaagatttcttttctgaagatgaagaagaagaagaatctggtttacgcaacggtaggaacaatgaatatgggcgtgatgaagaagaccatgaaaataggaacagaacagctgacaaaggtggaatcttggacgaattggatgatttcattgaagatgatgaattttctgatgaggacgacgaaaccagacaaaggaggatccaagaaaagaagcttttaagagaacaatccatcaaacaacctacacagattactggtctatcgtcggataagattgacgagatgtatgacatttttggtgatggtcatgactacgattgggctttagaaattgaaaatgaagaactagaaaatggtaacgacaacaatgaagctgaagaagaagagatcgatgaagaaactggtgctataaaaagcaccaagaaaaagatatctctacaagacatttatgatttagaggatttgaaaaaaaacttgatgactgaaggagacatgaaaattagaaagacagatattccagaaagatatcaagaattaagagcaggtattactgactacggaaatatgtcatcggaggatcaagaattagaaagaaactggatagcagaaaaaatttctgtggataagaacttcgatgccaattatgatctcactgaatttaaagaagcaattgggaacgcaatcaaatttatcaccaaagaaaacttggaagtcccttttatatatgcttaccgtcgtaactatatttcctcaagagaaaaagatgggtttcttttgactgaagatgacctttgggatatagttagccttgacatcgaatttcacagtcttgtgaacaaaaaggattatgtccagagattttatgcagaattacatatcgatgatcctattgtcactgaatacttcaaaaatcagaatactgcatctattgcggaactgaattctctacaggatatttatgactacctagaattcaaatatgccaacgaaatcaatgaaatgtttataaaccacactggaaagactggtaagaaacatttgaaaaattccagttatgaaaaatttaaagctagtcctctttatcaagcggttagtgatattggtatatcagctgaggatgttggtgaaaatatcagttcccagcatcaaatccaccctcccgtagatcatccaagttccaaaccagtagaagtgatagaatctatattgaatgcaaacagcggtgatttgcaagtctttacgtccaatactaagctggcaattgatacggtccaaaaatactactctttggaattgtctaaaaatacaaaaataagggaaaaagttagatccgatttttccaaatattatctggctgacgttgtgttaactgctaaaggtaaaaaagaaattcaaaagggatctctgtatgaggacataaaatatgccatcaatagaactccaatgcacttccgtagggatccagacgtttttttgaaaatggtcgaggctgagtctttgaacctgctcagtgttaagttacacatgtcgtcacaagcccaatatatagagcatttattccaaattgcacttgaaactaccaatacctcggacatcgcaatagaatggaataacttccgtaaactggcattcaaccaagcgatggacaagattttccaggatatatctcaagaagtcaaagacaatttaacaaaaaattgtcaaaaattggtagccaagactgttcgccataagtttatgacaaaattagaccaggctccattcattcctaatgtcagggatccaaaaattccaaaaatcttatctttaacctgtggacagggtagattcggagccgacgctataattgctgtctacgtcaacagaaagggtgattttataagagattacaagattgtcgacaatccatttgataagacgaatcctgaaaaatttgaagacaccttggataatatcattcaaagctgtcaaccgaatgccatcggaatcaatggccctaacccaaagactcaaaaattttacaaaagattacaagaagttctacataagaagcaaatcgtcgacagtagaggacatactattccaatcatttacgttgaggacgaagtcgctatccgttatcagaattccgaaagagctgctcaagaattccctaataaacctcctctagttaaatactgtatcgccttggcgcgctatatgcattccccattgttggaatatgctaatttaacaagtgaagaagtgagatcattgtcaattcatccacaccaaaatctgttatcctcagaacaattgagttgggctcttgaaaccgctttcgttgatattgtcaacctggtaagtgttgaagttaacaaagccacagataataattactacgctagtgcgctgaaatacatctctggctttggaaaacgtaaagctattgatttcttacagtcccttcaaaggctaaatgaaccattactggctcgtcaacaattaattactcataacattcttcacaagactatttttatgaattccgcgggattcctctatatctcatggaatgaaaaaagacaaaaatacgaagatttggaacatgatcaactagatagcactagaattcatccagaagactaccatttggccaccaaggttgccgctgatgctttagaatacgatcctgatactattgccgaaaaagaagaacaggggactatgagtgaattcattgaactgttgagagaagatcctgaccgtagagctaaactagaatcactaaatctagaatcatacgcagaagaacttgagaagaataccggattaagaaaacttaataatctaaatacaattgtccttgaattgttggatggatttgaagaattgagaaatgactttcatcctttgcaaggtgatgaaattttccaaagtttgactggtgagtctgaaaagacgtttttcaagggtagtattattccagtcagagtagaaagattctggcacaacgatataatttgcactacaaactctgaagttgaatgtgtagtaaatgctcaacgtcacgcaggtgcacaattaagaagacctgcaaatgaaatatacgaaattggtaaaacatatccagcaaaggtgatatatattgactatgctaatattactgcagaagtttccttattagatcatgatgtcaaacagcaatatgttccaataagctacagtaaagatccttccatttgggacttgaaacaagaactggaagatgccgaagaggagaggaaattgatgatggcagaagcccgtgcaaagagaacacatcgtgttatcaatcatccttactatttccctttcaacggcagacaggctgaggattacttaaggagtaaagaacgtggtgaattcgtgatcagacagtctagccgaggtgatgaccacttggttatcacctggaaattggataaggatttgtttcaacatattgatatccaagaattagaaaaagaaaatcctttggctttaggtaaagtcttgattgtcgacaatcagaaatacaatgatttagaccagatcattgtagaatatcttcaaaacaaggtaaggctcttgaatgaaatgacatctagtgaaaaattcaaaagcggtactaagaaagatgtggtcaagtttattgaagactactctagagtgaatccaaataagtctgtgtactatttcagtttgaaccacgataaccctggttggttttacttgatgttcaagattaacgcaaatagcaaattatacacatggaatgtgaaattaacgaacactggttatttcctggtaaactacaattatccaagtgttatccagctttgtaatggttttaagacgcttctaaaatctaacagtagtaagaatagaatgaacaactaccgttagatgcgtatgtagtgtccattgttattattaattttattattactttgaccattgtttaggtaaggtatgtaaactagaacgcttcaactgtattttttacgtaattatttgctgcatgtttagtttcgcaaagtttgtaccgtgacgaacatagcacgaacacaacatttaatagaaatagcttgggaaccaaaattttagaaatttttttcactaatgagaaggaaagcgttgcaaagtggcgactattttggttcttcaaatatttgcaggaaataaataatttactgtgcatttctgattacatttaggatgtaaattgacttagtagacgttccagcgaccattctcatttggtccttactgatatccatacactttatcctgtcgtgcaaggagtttgcctcaccaggaatatttaaaattctcgaatcaccagtcatcaaatcaacactgtaaataccttcatcatttcctaccaatacaccattagaagattctaatttgccgagaattggtaatgagaaatcatcttgatatatttctgtcgcaaaatttcgtaagattttatcgtagtaagtctgaactttatccaatttcattgcctttggatggcctgtattcataggtatttctactaaaatcaatctcatgtatggtttatgtgacgtggctacaactagcatggtactgggtgataatcctatcgtatccttagtattggaatgaacataatctactgccattacgtctcgaatgttgaaagcgtacgtgctaaattccgcattgtttaaggcaatattgtatgaatggacaagatttttggcatctataattgagtaacatgctatatgagtgtattctgctctggtaagaaacacagagaaactattctgaccattgccgtcaccgttggcgattacattcaacgacgtacaattggaagccaactttatttcggagagttttgtgaggaaagtgttcccgttttttatctccaacaaactcaatcgcaggaagttatccattccactagtaataacaaaccaagatgattccgtaacattgcagatctttatatgcgtaatcattctggcatgaattttccatactgcgttgttcaccagttcaaaatcgttatttagcaagtaaaaacttccgttcattggacatacatattggtaaccggagctaccaatgggtccgtacagcttgacgatgctcttgactttttcattaattttaaatgacttcgacgtcgctttctcaatgtcgtagattactaggtatccagtagctgacgaaagtaatatatatttgctatcttctgtaaaagttgcgctaatgaacaaggtatctttgggtaaggatttgttcaattttacatcaatactaaatttcaaactatggttccaaggttgaattccatacttagcattgtcaattggggctaaatcatcgtttattgaaagagttttaaacctatctttgaaagaccgtcttttgtagtaaatcctatcttcaacgacactctgcaagtcttctagcggtatctcaccgacattactatttgaactatcggacttttctaaggcagaaagaggtaacgctgtctcccttatgaatgcagctaatgtatcttccagaccgttatgtttgagataattagctatcaatagattagtataaaatctggaagtagaattgtcagccatgtcggtcgcactagacttttcttctcactgtcacttacctgtttgaaatcatgtcctttttttttttgccattcttatacattttctttccttctgaaattaactgtacacccataccctatatacacccataccctatttttaaatataaaaagtaaacttcattttgaaagaccactctgcatcagcacgcgggctctggaaggaagaaatgacgtttcggcggaataccctttcagaaggtctgctcttgtggctggttcatgggagacacccagcggagctcctcccgagaaaggccccttcatctctgccgattgctgacggaaagcagtagcggaggtttgagttctctacgccgagagtacactgccgtaatatcacaatgtttcgactaacggttacagtacgttaaattagatactgcctatgaattgacatattagataatgtcaaattttacaaaaacctaagacaacaggaaataaacaaagatgggtaaaggtaagccaagaggtttgaactctgctagaaagctacgtgtccacagaagaaacaagtatgttgactatttcaaaattaaaaaaaactatcaaccccctattgtgatatcgttttaggtgaaggaaatgttgtgagctctggagtgataaatttatcaagtaacatatcctggcgcaaatcagtttggagaggcttaaaatgacacgtcacagtgataaaaagtaatgaatagtgaacggtcagcttcggccattcttcccaatctatagtgtggaaaataaaccttttcttcccaaaataactcagaaagtcacaggaggccgttttttacaacggaatcatttttttactaacagtttttttttattattatagccgttgggccgaaaacaactacaagaagagattgttgggtactgccttcaagtcttctccattcggtggttcttctcatgccaagggtatcgtcttggaaaaattgggtatcgaatccaagcaacctaactctgctatcagaaagtgtgttagagttcaattaatcaagaacggtaagaaggtcactgctttcgttccaaacgatggttgtttgaactttgtcgacgaaaatgatgaagtcttgctagcaggtttcggtagaaagggtaaagctaagggtgatattccaggtgttagattcaaggtcgttaaggtctctggtgtctccttgttggctttgtggaaagaaaagaaggaaaagccaagatcataagcacgaaagttatcctctcgaggactacattgtttttgtaccttaatgtatctctttattcttccagaaagttccttctaatttcttattaggaatgggagagaatcacatcaatattttctctttaatagaatgtataattcaatagaaaaaaacaacataatttgcactttattttgatgctgagaaaagttttatagtgaatgtctgcttcccttgggttgaagttctgttcatatactaagttggttaataatgctatatatgtaatagatcgatctttatacaattcagtcattgatttaagtaacctgattacgttttatttttatatttttttacaattgcagcatctttctctaaaacctcatttaaatatgttataccgcgttgttgattcgtcagaatttccactatcttattaatacgatcattagattcttcaccggtgcctttggacatgctgtcttggttttttgtatcgtcgttgaaaaccattaatttactatctaattgactagaaatgtttttagcacgttcttttaagatagccaaacgtgcccaaagttcgttagtcttacctaaacctgcaggatcttcgctccgctgtagtaaagtttggaattgcgaccacattttctcttctgcaatacccaatggcagtcctctatttttcagggttgccaattgtgtgcccaattttaagattcttttttcaatttcaacattccttgattgtgccttcaaaattctggacgcagtgtccaattcatgcttttgttgcaattgtgtggatttctctaaaatatggttcaaaattattctagcttgggctacattttcagtctgtacttgattacgttgattcaaaccctcaaatccatatatttgaatgggaattgtctgaggggaaggtttcttttccattgcctgatcccactcttcttgaagtacatgtcctggttttgtatataaaatggcttccgtttcgttcactttattgtacacgaaagccctgagttttgttttcgttgtgtttggatcccacgattctttacatttcaacacctgttcttgaatttgctgcggataattagacagctgctgttgttgagcaattgcttgcgtttgttgcaacggtacttgaatttgctgctgctgctgctgctgtaaattagatccagttgaaggcttagaccaagcaaatgatggttgtgtggataccgtgtttccaagtccgggcgcagtgtttgtttgaggctgctgggattggccaaaaaggccacctcccccaagggtattgttattctgggtgccgcttccaaacaggccaccattagttgttgatccttgtggcttactgccaaataggcctcccgtagtcgctgtagtattctgaggctttgcaccaaaaagtccgcctgcattcatgttagatgtgttttgagtgctattgccgcccatcagtgagccagtggatcctactttattaccaaataaacccccacttgtggtactattgttttgtgcactgttgccgaaaagacctcccgttgtggtagttggcttgtttccaaataacccacctccaatggtggattgttgaggttgtgctgtttgttgcccaaataaacctgttccagtagctgtagttcctgaagcggtagtgcttgaacttcctaggctgccaagagcaggcttattaccgaaaaggcctccacctgtactactttgttggttacttccaaaagtatttgtggcctgatttgcaccaaaccctccggtagtagccgtcccagaatttggctggctgcccccaaaaccaaatcctgaagccgaaggttgagtatttgtattgttattgttttgtccaaatgaaaaaccggtcgaaccagctggtttatttccgaacccgttattactaccgctgaaaccaaacatgtgatcaattggtcaacaaggtatgtcttttgttactaacgagcgtttctggaatagtttgaacgggataatcctcgatttagtctttcagtccctttggcaaaaagttgtttacatcgacttggagagttggacttttgcttttactcatttcaagaaacaaaatttttgaaaataatccatttcgcgtacgttcaaaatgatataattacacattggcaacaattatttagattatatcacgtagctattgtactattttcctatgagagaactgctgtagccatgtgggatgatcatgcgggcaaaactaaaatacttatatcagtccacaattgaagtatggaaagttttctcccaactatgccgtttttataatggagactaatgtcaaagataggttttgcaggcttgatgggttttcaagacacttttcggtcaagattttcagtgagatttgaaattcttgcagaaggtcttgatagtcattgcgcagatgatgaatatatggtgaattggaatcagcacaagactccaatattcgacgagatgccgtaatcaacttatacaactgctcaatcaggccagagcaaatttcttcttctaatggttctataccgcacatttcatggagagatttactcaatctctttccaagtgagagcgcttctgtcaattgtgaatggttacgcagagagccgtaaatctcatctaacttctttaggtattccaggacatcctttataatttcttgtgtattgctgatgtcatcctttatcaaatgatctaattgagtcataaatttttgaagatcactttgtgttttctctaaatttattagagtttcattttcttcatctgtataggtattggaaaaagtcagatagtcgtcgtagttacttcttatttgttctaataatgtttgtaccattttttgtgaaagtccagacaaatctctaataagggaatcgagaggaaggtaatggaaatttttctgcactaggaatctgtcgacatcaaagttatcaacatcggtcccattagtctcggattcacgatacttctctatttctgttgcgaataactctttcgatatttctgcggttaccggtaaatctaagtctagttcatcatcattcaaaaagtccatttcgccctgagagaaattgcgactatgactgttgaccattcccttttcatattatttattattctatattttttctaagcttcattttcttgtcctgttgaaaattccatgaaatcgaggtaaaggcccgagcaataataattttaatttaaataaggcaccctcataaaaacggtcttacatcccattatacctaaatacgtattttttggatctagagtgttaactatttcacgattaccggttggtgtactcaaataattaaaatgttgaggactaagagagcctatattttctcgagaacatagtcaaaaagactccatggccaagttggttaaggcgtgcgactgttaatcgcaagatcgtgagttcaaccctcactggggtcgttttttgcttgaaatgagcaacattggaggaagatttgtgaaatcctccagttttctttttttcctctaggttttaacgaatgtgataaaagataactaaataggagggtcattaaaatgctaggtaacgtataaacaatgcacatctatacatatatgaaggtttgaataaggaataaataacacgtgctcataaaaaatcaagagagccaagctggaaacaaaatcaataaaccgtttacctattggcaggatcttcttgatgaattggtaggatcttttcggattgaatcatttctccattcccatccgaggaactattagtaccgctactgctacgttcagcggccaaatgagcgttgttcacccggtgatttacatcagagcgttgtgaatcttcgtctacaccccatagatagtaatctcttctcacttccacataatcgtacgcaaattcgccaatttgatcttcgtccatacccgcctcctctgcctcttctgatattcttagcctcataccgggtatgtagccgagcacaaagcagattattgcagttacagcagcagtgtacccaatggatgcggcaatgtaagcgatctgcttatacatttgcttgtaattgtgagttacccagccgccctcgtgctctgtagtgccatccataccaatgacccagtctgctccaaaaagggcattgaaaattagtcctattacgcctgcaaccccgtgctcagctagaatgtccatggcatcatctactttagcgtagtatttcaacttcgtcgcaaagttacacactacccccgccacaatgccttgaataagtgaaccgtaaagggttatacagcctgagcttggcgttgcagccaccagcccagaaatgataccggagcacagaccaactgtcgaccatttcttctccgatctgtaatccagaagacaccacgtcatcccaccagtaatggcactgagacatgtattcatgaatgcataaactgacctcaaatttggggataatgaggatgcagaattaaatagcagccagccaaaccacagtatggatgtgcctagagtgaccaatgaaacattatgaggcctgaaatttatcagtaacttttcatttcttttgcccaaaaaccaagagtaaacaaacccggaaacagcgcttaatatttcaatgttgccgccgcctgcccaatcgaggactccccattggtatgcccaaccacctggtgaccaaatccaatacgtcactggacaatatccaatggtagctagaataaagagaaaaaccatgtgcggtagcagcctgcctctttcggcagtggcgccagcgataatacttaagttgacgcacgaaaacatcatttggaaggttgcatacgcgagctcagggtaggcatcttcatcgaatttttttccgtacacgtttctaaagccaaacgaatctagattcccaatgaatttattattcggagcggactttgaaaaagctagagagtaaccccagaaataccattgcagtataccgaccaaagtcgccattaatacaacccagattagtgctagtgcagacttccttcttgccaatccggagtacaagaatcccaatccgggcaccataaaaaatactagggcggcacctaatatcatgaaggccacagtggggccatcgtaggtttcagtcgttaaaggccctgtagttcgactctccatagtttctacagtataagaatccgtactgcagttatgtttactaaaataattctctgatcataagcctaaacaagttacaagagcgcctatataaataaactaccttttaagtatcttattctggaactgcattatcgactggtaagcagaaggtgctatagaagcctacaccacttttccgattttttttttttttttttttcaggaaaaacatcttccatcaatactttgtcatttctttcttcttctcttctgtgcttacatagccataagatgtcacacaagggtgtctgtagcaattgtgaatcttatcgttatcgcaatctctgagatgtctcatccaataagaggggcgcgtgtccgcagagataagcaaccagggccttttcttttgcactcagcctgacaaagggaggggaggcgcaaaacaaagttcgtggcaaaggacaaccgtagaagagcatcgccatgttgattttgaagaatgtcaagacacaagtacaagttatggatgtgcatcgcaaagggaaaaaggggagtgggggaaagaaatacgtttgtccctaagtgctcttatgctcccttttgtgcttcagaggttcttgatcaattattaagaggggataactctatcgtatataacttttatcttaaaaatggttcaggtagtgtttatataggctcagtctttcttatctgaaaaaaaacagtacgggattttttgtgcgctcgaatagtgccgaactcaattacgggctgtggtaacacttgagatcttgtcttcccttacaaatagctctaggggtgttgcatgtagccgcagtaacatcttgaagaagtgtacacttttgaggggacgccattgtgttacgttctatgtattgaatagtatagttttcaattttcctgcgctgacgtaaaccggctgtaagaaaaaacgtataatcgagaactggttattcaaaggttgaactttaaagtgaaaagtagctctaacaaaataaatcatgcgtgagaatgcaatgtctacaaagaaacttccctataaattatctggcagcagcaaaataacaacttccatacctaatgatttaatcatactgcgaaataattgcataaattcactgaacagttcctcgtccaaagctgacagcattacatgtatagatacgtggctaaaatacacagagggtttgttaacccacaggtacgaagctaataatgacgccgctctcattgaagaggagatagcgattgcgttaatcaatgttgccgtattttatcaagacatcggtattgaaacattgtacagagcttatgaatcttcacaagcgtcaaataacttatggacaacaagcgggacctatctaaagagaggtctaggcttaatctgctttcttggaaagaattttcaaataaacacagctaatgattgccaaaagatgcaggttctcaacgtccttaatcagctatcattagagtttcaattgctgcaacaactagggattgtcgttttagcactgtctaaactaagatcaaaaatcagcaaggatgctgttgcggaccttgagcctcaagaattggaagagctaggcaagtccagtgtcttttacgctaagctttgtattggatcttatagcactgcttcgcaatgccaaggaggccgtatagtggacgcattatttatgaattatttacagagtttgacctatctcttcctatcaatcaaccaatacaacaatgatgagtgcggaattgccattgggatgctccaagaatcgatcaaaaaactgttaaatatagtacccaattcgcaactaaaagagttggacattttatcctcaaccgatattacaaagaagagggatcttataaagatgtcgtttaaaaggaaaatacatgggtctactttaaaaaaccaacggatatttgagaagaaggtgccattttcatccaaagcgtacatgatgccgttattgaaatcttcattagacgattttgttatcccactaacgatactgttaaggtacagataccagacaaccaatgagaattattccttcaaaacggttgaaaccgacgtttctaaattgaaggagcttttccccaggggaaaatcgtcagatattgaaggcactgtatggagtttccaagatggacatcttacatttgcagactcaaataatgcaacccacaattgcggtaattatttttgaattgaatcaaacgccgttcgaacgtagaggtcaatagtctatatgaataatatttttaaggtctactctactatgaattttgcataaaaatatacacatgttagaataaggaaaccactatctactaatcacggctaaccactgcaaacaatggcattatttactaatataattatgtgtgttggagtgagaatcaattatagtctaccgatctggtgctcttgtcagcagtatattatttttgagaagaactttccttttttttttatgtatacgtaatgatcagaattttttaataaagatgtacttcaaaagctttttttaatattcatagtagaatttagtgaataatttgataattgttgggcttccattgttggtaaaggctattatattagttttggaataaaaattcaactatcgtctatcaactagtagtcatactaccagtatattatcatatacggtgttagatggtgacataggttatgagaagctgtcatcgaagttagaggaagctgaagtgcaaggattgataatgtaataggataatgaaacatataaaaccgaatgagaaataatcgtaattgtattacatagggacaccaattccattttgaggattcctatatcctcgaggagaacttttagtatattttctgtactaatattatagcttttaccgataattgaatcctaacagtaatctcaaaattcaccaatttcccacaactatcgcaaaattcacccatattccaatcttgtgcgcttcatggcgattatttcattatgtttggttaataaaataaacataatcttgcattagagatagttaagttgttgtatctcaaaatgagatacgtcagtatgacaatacgtcatcctaaacgttcataaaacacatatgaaacaaccttataacaaaacgaacaacatgagacaaaacccgtccttccctagctgaactacccaaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaattcaacacaagtgtaatttcaatagctcgcgtggcgtaatggcaacgcgtctgacttctaatcagaagattatgggttcgacccccatcgtgagtgttgtttttttaaataatttcctggctgaagggaataatgttgttcaacaacgaagatatttcttatttttctaagaggtattatgatatgatacatgacaataaacattatgaaattttttgtgaaagatgtataaatttataaaaaaaaaaaaaaagttacttcctccacttcgttagctcatattagtttcttttattcccagactttctgcttttgataataatctagcaaaatagaaaaggcatgactataaaccaaaaccaccattagaataggccattggttttatatctgggtgctcaacagcttcgaatgtctcaattattagattttggtcgtcattcctgccagcctgtaaaataccatggcctggtacaacatgaataacacccccaagattaccttggctatcacaatagtttggagcactgaaaactgtcattaatttacccttctgctcgaattgcacaccacccattcttaactcgtgagatctaaaaatcttgcgcaatttgttgtttcttagaaatctatctgtaatgtcgggtccaaaagcatgtcctaaaccacgctgagaaggacccatcccgttggcttcttgtgggtccgcccatagaagttccataaaggcgccatctctaggtggttgggcaaatctatcaatattcttgaaatcagacaaagttgctgaaggatcacttggtaaaccaccatgcattacaaggtaatcattattaattaaggtagccaatggaaggctctcaaaactttgtgcaaacatgttaaatatcctttgtgaatatttgtatttacactcatcttcaaacccatagattttgttcatattatcactctcatgattacctctgttcaaaaagaaattatttggatgtaatattttcaaacagtagaataatagtgcaacttcacacgaccaagaaccacggtcgacaaaatcaccattgaatagataagtgtgcttaggacctactttaccaaacttgcgaaataaattcaaaacatcataaaattggccatgcgtatcaccacatactgatatcttaacatcaggagtagagttattttctagttctaccatagatggctcttgacgaaataaggtatcagcatgagagataatagctgcaacgtacttttttggtaaatattttccctttaggaaaagatcgttaaccattttggaaataaactcttgagacatgttcttgatctttgcacctttaaaggcattcttatcgtcatacagctgttcaaattctaactttggaccttcataattggctaaatctgcattagcatcaaatgaactcaagttcaaagtctgacacaaactgatcttggcttcattttctgcgcctccgatagctttcctaaatctttcttctctaatgaacctatcacatgtaagtaacgccttagtagcagccggatcattgggcttcgcctttagaagcacattcaaatctttcctagcctttttaaattctagcagagccatgcaggataatgcacgtctatgataagctttgatatttttgggatccagtttaatggcttcatcacagtcatttaaagcgctttgaaagttatctaccttaaagtgagcaaatgctctgttcgaaaaatagatagactgtgtagaatctaaatcgatcgcctctgtatatttttcaatggcctttaaaaaatgtttttccttcacaaaaacatttccttcgttctttctttcaagtgccttcgcgcgatctgctgctgtgggtgttgacatattcgagatatttgattataccaaggcaagcgttatttcttgcctctaaaattgttaaagttctgtgtcaagctctataagctgttttcgccaattttcttacctcatctgtgaaatttttcagtttcccgccgtcgtttttttccctggtttagcgttttaacggaaaaagaaatacatacatacaatgattgaaaaaatattttcataaagaagaaaatgagaaggaacttttgaggactagaagtgttcctgataattgtctcagccagaattttcagtggccaaggtacgaacaagaaactgctaaaaggaaaaaaaatactcagaataacagaagatgacagacagtattgtggaaccccaacaattatctcaaaatttacctatttcttaagtataaacagtacactgcatcagtggtattagatttgtcatggtgtaaaattttatgataaaaaaatacaacatggcgggcgtaaaataaaatacatattcgtaatcctggaatattacgccaactacaaccaataacttatgattatattaccagaatattatcatgtatggctctcaaaatatgacataaatggtttctattaaaagcatcatcaattcaatgaagctgaaatttcaaggattggtgatgtaatagaacaatgagcggcgatatcatagaacgaaaaaagaagtaatcgtcattttttgtagcactcttatttccttttttagagttctaatcctcaaggtgaaaccgtaacatatgcatatacttaacgataccgccttctttgaaaattagaagccttatatctatttcgaacgcacatatgttgtcatacacaatgcgacacatgaaaatactactctttacacctgtattatcaaactattaatcagtgacttccgaaaaaaataggtctcttggcccagttggttaaggcaccgtgctaataacgcggggatcagcggttcgatcccgctagagaccatttactttttagaatgcaaatataagatcccgataaatcatagaaccaccacttacttattcacttatgtggtccttcctgctgtgggcagagagcgatttgcacgtacaaagcgatcaaattacgaacaaaacaatacataagaggtttggacacgttcttaaggctaactccacattgcgataacaagattaaagtgagctcctgctcattcctaattggaactcatcatgcctcccatcaaggtggagcctggattttactaaagaaaccgttcgaacggctctgtatttactaagagggggatatatcaaatcgtggaaaacatgagagaacagtctcgttgcgtgcaacagccgctatcctgctgctctctgcataactggaccttgcgtattgggttcattcttttggctttgtgaaacgattcacaaagccatacgtccgtagtatggaccctgcaggaatggtctacattttctatctactagtaaagctttattcacatatgggtgccgcacggcgcgggtttttgcaaattttcttagcattgactcatggcaagatttctccagaaaatcagtaaagcctcatccagcctctcttcttgaaaaaattatgactttgaatcgcatatttcaaagatttgccacttgcttagtttcatttattctaatttaacttttatactattttttttgcttcccagttaagctcaccaaaacacaaatactcactacaatacaatatgtgtggtatctttgcagccttcaagcatgaagatattcacaacttcaaaccaaaagctctacaactatctaaaaaaatcagacaccgtggcccagattggtcaggaaatgccgttatgaattccaccattttcgttcacgagaggttggctattgttggtttagactccggtgcccagccaatcacttcagctgatggcgaatatatgcttggcgttaatggtgagatctacaaccacatccaactaagggagatgtgctctgattacaagtttcaaactttcagtgactgtgaacccatcataccgttatatttggaacatgatatcgatgctccaaaatatctggacggtatgttcgcattttgtctgtatgattccaagaaagaccgtattgtcgctgcaagagaccctatcggtgttgtcactttatacatggggcgttcttctcagtctccagagaccgtttattttgcctccgaattaaaatgtctaactgacgtttgtgacagtatcatttcgttccctcctggtcatgtctacgattctgaaacggacaagattactcgttactttaccccagactggttggatgaaaagcgtatcccatccaccccagttgactaccatgctatcagacacagtttagaaaaggccgttagaaagaggctaatggctgaagttccatacggtgttcttctatccggtgggctggactcttctttgattgctgcgattgctgctcgtgaaacggaaaaagctaatgctgatgctaacgaagacaacaatgttgacgagaagcaacttgcaggtatcgatgaccaaggccatctacacacatccggttggtctcgtttgcattcgtttgcgattggtctaccaaatgcacctgatttacaagcggctagaaaagtcgccaaattcattggttctatccaccatgaacacacttttacattacaagaaggtttggatgctttggacgacgtgatctaccatttggaaacttacgacgttaccactatcagagcttctacaccaatgttcttactatctagaaagattaaggcccaaggtgtcaaaatggttctttctggtgaaggctcggacgaaatattcggtggctatctatatttcgcacaagcaccttctgctgcagaatttcacaccgaatctgtgcaacgtgtcaagaacttgcatttggcagattgtttgagagctaataagtccacgatggcttggggtctagaagctcgtgttcccttcttagacaaagactttttgcagctatgtatgaacattgatccaaatgaaaagatgatcaagccaaaggaaggacgtatcgaaaaatacattttaagaaaggcattcgacactacagatgaaccagatgttaagccatacctacctgaagaaatcttatggagacaaaaggaacaattttccgatggtgttggctactcatggattgacggcctaagagacactgctgaaagggccatttctgacgccatgtttgccaatccaaaggctgattggggcgacgatattccaaccaccaaagaagcttactggtacaggctgaagtttgatgcttggtttcctcaaaagactgcggcagacactgtcatgagatggattccaaaggccgattggggttgtgccgaagatccttcaggtagatacgccaaaatacacgaaaagcacgtcagtgcttaatacgagcgcaatcgtattcttataattgacgagtgaaccaagaaatgcggtgatacaaacggatattaatctatatagatatatgtatataataaaagttttcaatctgctgaccccttaggttacttatctataggattcgaattacgatatgaaaccctttcggtagatatcacatggaatactgcagccgattgattagttaatttcttatctcgctttttttctctttatctatctatctatctatttatctatctatccttatgctgcaaaatgaaaaattccctaggaagttcgcgctatcaaggttctttttcccacgtatcggtccctgagtggatcccaaaaaatgtgtgggactatgactatatatataacagtcacagttgaatcatattaatgttctatttcttgaggtgatttcaaattgtggctccaacaagtaatctcggcaagctatccctttttaaataatattttgcattctttttcttttttttttttttttttttccatctcacagcccttctttattttttcaataaggtaacagagttgataaggaaccagataacaatcaaaaagaatcgtttcatttcagagctaccaccggtctataagcaagacagtttaaaatctcaaaaatttaatttagaaatatgggaaggactattaggagacgccggagtaattcgtcgctttcggaggccatatcagtttctttaggaataaatcaagactcatctgtgaacaagatgcatagagcgagtgttagcgcaatgtctcctccattatgccgttcatacatgagcggattttttactggtggaaactcacctatgatcaataatttgtcggattcaaaacttcccatctcgaacaaacaacatcctaaagtgatacatggatcagaaaatttgcataggcagacagctcaactatccaatgaattttgctcctcttctgtggaagaaaattctcccacaattaaggattacatggacattataggcaatggtgatagaaaagatgatcaatctatgcgtactatagaagagaatattgatgaagaatattcagatgagtactccagattgctacttagcccagcatcgtctaacgtggacgatgaccgaaatcgaggactacagaatagttcactaccggaattagaagatggttacgcgggcggatatcagtcacttcgtccctcccataatttaaggtttaggccaagaaacttgtggcatatgtgtacgtcatttccttccaaatttgcacattatctgcccgcagcagtgttaggtttgcttttgaacattttagatgccttatcttatggtatgatcatttttccaatcacagagccagttttttctcatttagggcccactggtatatccatgttttatatttccaccataatatcacaagccgtgtactccggaggctggtcgagttttccttccgggattgggagtgaaatgattgaaattactccgttttatcatacaatggcattagctataaaagaggcattagcaggtaatgatgacgaaatcataacgacaacgatattttgttatgtgataagttcgatgctcacaggtgtcgttttctatgcattgggtaaactacgactaggaaagatagtgggattttttccacgacacatattgattggctgtattggaggtgttggttatttcttgataattacaggaattgaagtcacaacgagggtggcgaaatttgaatattcatggccttttttttcagggctgtttacggattatgacacattagcgaaatggttattacctgtactattgactgtagttttaatcggcactcaacgctactttaagaactcactcgttttgccaagtttttacatcttgacgttagttttgtttcattttattgttgcgatcattccaacattatccttggatgctttgagacaagctggatggatttttcctattgccaactcagatagtaaatggtatgaccattatagattatttaatgtccataaagttcattggtcactagttttgcaacaaataccaacgatgatggcattgacattttttggtatcctacatgttcctataaatgttcctgcgttggctatgtcactacaaatggataagtatgatgttgacagagaattgattgcacatggttattccaacttttttagtggattattaggttctgtccaaaattacttggtatataccaacagtgttctgtttattagggcgggcgctgattcgccattcgctgggttccttttaatagctttgactatctgtattatgatcattggaccagtcataatatcattcattccaatctgtatagtgggctctctaattttcctactaggctacgagttattagtggaagcgttggtcgatacatggaataaattgaatagattcgaatatttgactgttgtcattattgttttcacgatgggtatctttgattttgtcctaggtatcatcgttggcattttaattgcatgtttttcgtttttggtggatagtacgaaattacaaaccattaacggtgaatataatgggaacgtcgcaagaagtacagtatatcgtgattacgttcaaacaaaatttttggatggaattggtgaacaaatatatgttttaaagctccaaaaccttctgtttttcggaacaatcatatctattgaagagaaaattgaaagattgctgcaaataagtaacaaagatgcaacaaaacgcagaataaagtatttaatattggactttaaaaatattaatgccgacaatattgactattctgcggcagaaggtttcaatagaattaaaagattcacggaaaccaaaagaatcaaactaatcatatcttcaatcaaagaaagggaccgtatttacaacgccttcaataatgtgggattactaaacgatgtggaattatttgctgatttaaacagtgcgttggaatggtgtgaaaacgaattcctttttcaatataaacaattaagaaaaaaggcgaaagaaagattggaagaaggaaagcaaaataatgtcgtatccgcagtaattgcagccactaaaaacaaaaaaattgatacaataggaaatggtttaaacaggggaagcaatggagacacagcgagaaacttaatgtcactaccaaccaatactcctcgtaattaccaaatactttctgtagcacagaatgtatttgtaaacgacgaacaagcagtgaagaatttcaaaaaggagtacaaagatgatgaacctgtcctgcctatattgttatttgcattaaagcagtaccgacccgatataatatctgaagttcaaaaagtaagagaaaaggaaatcaagttttgggcacaactctgcccctacttcaccaggcgcagattagcaagtcaatcacatttactacatgcagacaacatttttttccttgtggaaacaggtatgttgaaggcaacatatgaactaccacaaggaaccttgtacgagattttttcaaatggcacatgcttcggaaaaatcattgcgccagggaatgctatgcctagagaacaaaagctcaccatcgaaactgaaactgattccgtattatgggttatagactctagctcgttgaacaaattgaaagaagacaatctagcattgtacgtggaggttgcattaatggtcatgtgtatcaaggacaccagattcaaagaattactaggttacacacttgttagcgcatgagagcgtacacgtatatttatttaatttcttttattgccggcgtattgcaagtaatttacaccagtactaaataaaagcaggatgctcctgcatctgtataagtgatgccgttgtaggatttttaccatctcgactataaactttttgtacttgagtcttcacttccggaattttactgcgcgattttctttgatagggcccctatcgtagacgaaaagtgataattcccatcgatgagcaactacatacctcacttgacttaattgctctcctaaagaaaaaaaataccgttacttttttcattaatatactaccacaacaattcacaacgggtagttgtacggttagtttatatccgcattaacaaatcaaagtcataacaacgtatcaacgtagactatgcctgtcccatctgttactgtcactaccgataatgaatatgaagacatatcgtccttttcttctattgactcttacaaaccggagccctttactgggttcaaagattctgaagctccagaacagcctcttttaaaaaacgataccattgttggaaaggggcaactggaagatgatagtaatgtagatgatcaacaccgtcattcagatgtgcattctcatcacagttctagtactttaaaaaggccaacttcaaattcgatagaaaagatggttacccacaatgctttagagggcaactcagaaacagttgattccttaaaagaagatggtttaaatttgaacaagaaagctcttccggatattaccgccccagtaacaaactcagctcacgatgctgcatttccagaagagtatcgtttagaaactgaaaccgggttggtcaaattgaagacgcttgaaagtttgaagagggaggactctcgcgtatcctcaactaaaaaagagcatattaacgaccatacagatatgcattcgacacgatccaaggttactacaaattctcaaggttcttctctagaaccaaacaagttgaacatggcagtagagaagaataagaagaggatcgaaaaatatcaaaaacataaatcagaaaaggggatcaaggggttttttcatagaattttcgattaagtggcatagcaacatttagttcgcaatgcgtttacttcagaatcattctttttttttttttttttttttttttgcctcacattatattcttggcatctgcctagctttcgactttttcgttcaattcctaaagcgctaaaaaaatagtctccccctgaaagtggagtaggatagtagtatatgaagtgaggcagaaaaggaaagaaacgcttgcatttattaacacacctgtggctaaagtattaaaaaccaaaaactaacgaacaaataatgtgcattttaatggccacaagggcacatcctgactatgaactcatcttaatatctaacagagacgaattcttggcaagaaaaacacatgctacatgctggcataacaatgattttatcctttcaccctacgatctggccaaaacctcagcagaaaaacaaatatttggcacttggtctggcataaataaagaaggaaaattagccactattcttaatttaaaacttgacaatgagcaaaataatacgaaatcaagatcccgtggtctgttaccatttatatttttgtcgatccataaagcagattttgaagattgggataattacaaaaagtttgaaggtcactatgatgggttgaagtccacaggtgattttaattttttttacggcgacgttatcaaaaagcaatataaagttattgattctctaggaagaacttttgatgtgttgagttctacctgtaggaaagatcttgattcttacatggttgtttctaatggtaaattttatgacagctccagtataccagggcaggcttgggaaaaagtaaaggtagcacgtgatagtttagaaaatctagttttagagaatattgaatcagatgaggagaaaataatatcaagttgctttcaactcgcctcgaagtcttcccttccaagcactatttcaaacccagatgtcttgcagatggtagatccaaatgtaaccatgaataccatatacgtaccacctttacggaggcctcccagggatgacttaggtgcctcaattcctgatggtgattactacggaactcgctctcaaatagttttactcgtgagtaaggattcaacgagagttacctttatagaaagggtcctttatagctcagatgaagacgtgcgcaagtattcggtaacctcacctaaggaggaaaaaaggtttaaattcaaattgtaaaaatcacaatcttccattttatttcaaactagctttaaattccatcttcttcccctcagaacattccggtatctcttgttggacacatctaatgtatatgatgttttcaaattctaaatgcctgttagtttatcagtaaccacagtagacgctatatatattagttccttttctatataggtattatacaatacaatcaaattcattgcatactcaaatgtccaagtattccatggtgtaagtgggtaaggctcgcttctgagaagttccgttatcaaaggttgagctagcaaacccatgctgaaaacctttcgtatcaatcaaattccacaattcggtatttctttcagcaatctcaacttgtttgtcaatatataaggttaagttctccaatagagcaccttctaatgaaaatagcccgatagaatctagcacaagggacaagagttgaaatagctgcgtgctttggctagggttgaagcattctggtgagctgtcttcaccaccgcttgttatgaactcaatgaaattttgaacgtctaatttacttagtttcttcatttcttgtttaatagagtctctggtgaaatcctgcaaaatcctaaatgagatatcaagtaatagttccctgtttctgatagaaaacaattcttcaagtagttcatttaatggcaagtttgggcatgttacaattgcttgtttaaataatctaggttggtctcttagtaaggatagcaagttgcgtgtacgactcaatggaaacaatgggtgtgtcaataaaaacgttaaagtttttggataatcatttccgctaaactttccgaaaattagatctaaaactttattcaaaaagccaggatcagaaatatatctatctttttcagtataatgttcttctttgatttttagttctttgaaaaatatgtcatcaaatgatgtaatgtcattatcttgaagggctgaaagcttttcaataacttcattacagtggaggactggaacgcttgaatccccgctgacgtcgttacatttcactctcttgtcatttatgtctttatcatcaaatagcggctttaaaataactgagctatcattatttccaacttgaaaactcttgcctaatgagtccttcaacgtattagttccaacatcaatattaattatttctaaggaagacgttgggtttggtccatttttcgttgaaataccaattgctattgtttttgaattatgcgacttttctgaattgatcactgcagattttaatagttggaatgttttcacgtgagttaattctctttggcttaaagtagaacaatgcagtaagtctagtagataaatgacgttgtttacggtcagtagaactctgtttactgaaacaggttggaaagagattaagtcatctccaggactgagtttatccaccatcggaaattcaataacttgttgcaattggcaatgtggtaaagagtaaatgtatattttcccctggttcaatttgtaaagttttccaaattgataacaaagctttgaattttcaaaagaaaatccttcgatgatagtagatgataattcttttatgggcgaactttctccactgccacaatctgttagctcgagcaatttatagcagactttatcatcctgtaatggacagagaacaaaaacatattcagttccattttcagtgaaccatttagcatattttaagttatcataagatatatcaaatgaatgcaaaagtgttaacttaaaatcaaaaatttcaatcaacccgttctgtaaaattgcaattactaagctgttcttggtgtcaattttaatactcatgactttggctttcgccttgatcttatactgagataaaaattcgtctgaacccgtgtatgctttattgtcaatatcactctcactcagatggtcatttgaggtatcagtggtatcttccagtgccttagtgataacatttagcgtataattacccttatttaccattaaaccaaaggcccaaatttcaacatttctttttttttgggtgttgatagtcttctcgttgttggcttcatcatcggtactggcttctatatttccgtcaatgttcgcttgacctttctcagcattgcatgccgtgataatatttgtagagggtattgggtaatcgaatgttaactttggtgtaggattaataatatattgagatatagatgacccggaaatacctaacgttatgttatttgtagattcattaaaggtgccatctgcgacttgaacgtaatctgcttgtaaagaaaaattgctcaatgaagcaatttttgggagagttgctagtctaaatggttgagacagggatggcattttgaatctttactatcctccggaatgatttgctgttcaaggagcgctaggtgtgacatataatattacaaatttaacagtgacctcatctcatcaaagttttcaaatttttcaggcatctgctacagcataatgaaaaaatttgaaaaatacagacatttccgtgtagaatgacaaaaaagctagaatattactatattttccttaaaagagcaatatttgcgatgaggggctctcaatgacaatgtttgacttctctattgaactgtaagcgaagcaaaaccatatcttgtcaaagtattcgaagaatggatttttacaaattagacgagaagctgaaggagttgaaaaggaaaagagtagatgtatctataaagagtaggaagttggctgacagagagattcaggaagtaagcgcaaatcgaaaaccaagagtatacagtatggaagacgtaaatgatgcagatgaatcagtaggagatacagaaagtcctgaaaaagagaaagcatttcattacactgtccaagaatatgatgcgtgggaacgtaggcatcctcaagggaagactgggcaaagccaaagaggtggaatttcctatgatcaacttgcaaaattgagttatgagaagaccttgcggaatctcgctacgcaaacacagaattcgagcaaacaggatagttccgccgatgaagaagacaataaaaacgtacccaagaagggtagaatcggcaaggtacagaaggacactaagacgggtaagataacaattgcagatgacgacaagctagttaataagttggccgtttctttgcaatctgagtcgaaaaaaagatacgaagcaagaaaaagacaaatgcaaaatgcaaaaacactgtatggggttgaaagcttcattaatgacaaaaataaacaattcaatgaaaaattgagcagggaatcaaaaggatcagaataagcttctcttttatttagaatataccgatataaccaaaggaaagttttaataccctggatttttcatcgaccgtcacgtgacgagctgaggttaaatgcccgcaaaagtgcttcagaagagagtccatcttactcggttatttgagcacgaaacactagagaataactaactggttgataaattgttgattgagtaaatattggtacataaaacggttacaaagagaggtagattaggaagggtgaaaataatcaaaggataacttgatgatactcgacaaagaatagaagagaaaaataaaatagaggtgggatattccttgaacaaaagtggaatattattttttttaggcatacatgacgtcttcctcagtatgatattcatacaaggaatcgtcctttggaaggacgctcgtattcttttgtgaacggtcatttggtattttgtggttttcagccgcgtgtataccttcagcttgtttgtgctgcctactcaatatttcttgcttcaaggcctcatcagcgtttttctggcgagtttgttcctcgatagccttttcagcttgtaatcgcgttctttccctcttgactgcctccagttctttctcttcggttgccagcttatcctgtagttcagtcaattggtcattataggtttgcttgacttgagtaatttgctgctcatgatctaattgagcctgatgcgcttgttcctccagctcttggcgctgtttttccaataagttctcttctttgcgttttctttcttcagcttctagcttcaactgttcttcatgagcgcggcgctcatcttcgagtcttttggtaattgccgatagttgagttttttcattggcgttttcctgcttgattatggtcacttcgttcaataagcttgatatttgattatcaatatcattaatttgtggaagatattccttgttctctacactttccaaaacttgtacatttttttcatgcagcttcttattttcttcagtttgggtaaccaaatcctcctttttcttttccagattatcgatttcgttttgaactttgccttgtttcaaattaatctggttaatcttaaagatctgagcatccaactgttgagataagttacttaagttcgtggtccagtcattgaactccttttggacattcgttttctcattgttcaaatcatcgatttctgacttaacgttggtttgtttgtccaagacctcatttttctcctgcaacttttggtttttcatattttcagtgtcttttaatatcattagtttcttattattatgctcggcattaacatcaatgatttttttgaccaaccggtttttactaacttcaattttctcagaagtttcttctctcatggccttcattgaattttcaatttcgtcaatctgattttgtaaatcttgtagcttttctttgtattctttatttttagcatcatatttatccttttcctttgctcgaagatcagctaaccatgcttgatgaattttttcatcataattgattttatcataaactgcctttgataggtaaccatgttcttttgtctttacaattaattcaggattttctggagtggccactggattggatggagcggcggtcttacttttttgggtagatgaagaagtagggcttttccataaagcgaaaattccggttctttcctttcgagaaggttcctgaaaagggaccttgggagccttgcttggatcgattgggctttcatcttcttcggattccggttccgaggtttctggagtagacgttctctcagcagattcctctgcagacgattgttcggtttcctcttctgcatccccttccgcttccacttcctttttttcttccccactgggaggattgactttttttacatcggatttttcctccttttgttcgtctgttggcacgacacctgactttgaaccgccactttgatctgtagtgcgtggttccaacaccccattctcggatgagattggttccgctacattaatttgagctgaatcagcagtgcctttgccaattgaagtagactcactcactttgtcttcatgttcttcctccacggaagttgcttcatcagcactattttcgacagcattagtagtagaagtgctggtagtagaagtactggtggtagtggttgtcgtagttgcagtgtcagcagttgcttcagtggcctcagatgtggtagtagaagtaacgtccccttcatctgatgaagacgatgacgatgacgatgacgatgacgatgacgatgatgatgtagaagtggacgaagaagtagtagtgtcagtgtcatctttttcatccttagttaagtcagtaattttctggcacttcttcaaatatttcaaatgtttctcctttagttccaactcagttagtaactgatattgtctttcttcattttgagttaggtaagttggaaatctaatatctttggctctcttagcattttttggtatgtttttgtaccctaaatccttaggttgctgttttgaataggcagaagtagcacttacggtaggaaactttctgttttttgcgtcttccccatatgcccggttgttttgcctattggcgagggcatcttgtctaaatggcgagacccactcttccttaccttttggctcattggacacaaccttttgcaaaaactgataagggctttcctgctgatgcgcttgctgattttgcgtatttgccgaagattgattgatcaattgcgtaaaggggtcgtcttcttgacggttgatattgaatagcatgttttgaatacgtagttgattgacctctttcttttaattgcgtgcagctgctctcaggtttaagatgtacgagggtccacggggtagcaagcacaagaacgatgatatatatgacagaacgatggataagaatggtatgttgtctgcactgttcagcattcgactacccctctcccggttcttttctcctcgtttcaatttaaaaaagcaactcgctacccggccgcacaccccttattcctgttcagccgtttaaggtgagaaccctttacttcatagcctttgtagatctttctattgctaccattgaagggtcggtgacgtggaaattttgacatttatcagtggcgtattgggaggcaagcaattgaaagaactgtgatttatttccgcttgttcgaaattattgatgtttagcactttgcagtagcgacaatacaatatatgtgcttttagtgctgggatagttcgtagctccatttcggggcgcttgttacatttattgtatatgcgcggatgtggcacatgctgttgagatctcactcctttggtatctctttcctgcgccgcattgtgccggcagaatgtcgcgcttgtattctcatgaacttttcctctttacgaaccctttggcggcatgccgtttaaaatctgttgaagatttcctttacgaacaatgagcaatgttttgcacaggcaggtgggaagtagggcctatcgcgccttggatgcagatataagtataaatataaattataataattggctgtatcagtaaatccttcttgcgatgggaggaagcacgatagagtatgttaagcttttgagaggcttcatattcattggaattttaaataacaataaagcaacaacaataataaatgctatcagctgcagataatttagtgcgcatcataaatgctgtttttcttattatatccataggtctaatcagcggcctgataggtacacagacaaagcatagttctcgagtgaacttttgtatgtttgccgccgtttatggtctggttacggattcattatatgggtttttggctaatttctggacatcattaacatacccagcaattttgcttgttttggattttttaaatttcatatttacgtttgtagcagccaccgctttggctgtaggtataagatgccattcgtgtaaaaacaaaacatatctggaacagaataagatcatacaaggctcaagctccagatgtcatcaatctcaggctgctgttgcgtttttttacttttcctgttttctattcctcatcaaagtgactgtggccacgatgggtatgatgcaaaatggtggatttggctctaataccggattcagcagaaggagggcaagaagacaaatgggcatacctacaatttcccaggtttaagcctactggactgaaaaaaaggcaattcgcgtacaattttcgttgatcgttctttatataacctttgcattaaataaatttaacaaaaaaagttctttctaaaataatattatggtgatacatgaatgtgctttagttttttcgtaggctcatccatgtatatatataaatgataaaaaactaagttacgatattgatagcatacgtattcgtgttggtaactaaatggaaagatggaatatgttattggcgttgttatcccccatatatacaggtttctaatatgattaaaaaaaaattttctcccctagtttattgtgttcatagcttttccagacttaacggccaatgttcaaaagcaaggaatttggtgatcccgaagactcgctgttaccaccaccagaatgttgacttggtaaatagacaacgttagatgagtttgctaatgtttgagcgatgtccttagaagcttctaatcttctaatcaataacagaccatcaccaactttagctaaggcttttgaaatgaattcagcactttctgcttcaccttcagctctgataacagaagcttgtctctcttgctctgccttttcgacaaggaatttggctctttcggcatcttgctgtgcaatctgcttctgctcaactgctttcgtgaattcgggaccaaacgtcatatgagtgatagagacatcttccaacttaataccgaattcgttggccctcgtagaaagctcttttctgattttttgagaaataatttctctctgagtaattaactcagcagcatcaaattgagctactatagactttaaaacctcattgccgatagatggtaacactctttcgtcgtaatcgagacccaaattttggtatattgcgggtagctgtaagacctctggtctatgtaagactctcaaggtcaatgacaccatttgcaaatccttcgtaccagtattggtagcaatgctctttggtttcgtcctcacatcgtatatgatcgccttctgtagccaaggcaccaagaaatgagtgccttcacccacaacctgttgctttacaccattgattctgtcgaaaataacaccacgagaaccacccttcacatcatacatggagtactgaatcccgctagcaattataccaatgggcaacgccaccttggtgatgacatcgataagtttggcagaattagacattcttttctaaagtaaattattgattttgaatgtaagtttcgtaccgttgatggttggtttaccgatttattttttttcctcttctttctgcttaatattatatacctcaaccgttgcatccatgagatcgtcaaactccctttccctgaaatttattgatgcgatacattcgcgttacccgtatcatcatgaagacgagtttattctcatcagtgttgatctctcatacttgaataactcatttgcaatggtctaagactccaactatgtagtcatagtcattcactgaagtttctcttttcgaaatcctgaacggaagcggaatatatgtggtatatatcgcatattactgcttcacagcatgcagcgcagactggccgggttatgctgccacttactggagacaacataaaatatacataatcatcgcctttatacataatatgccaaacttctggattcttgagaatcgtaggagctatacgtctgatacatgtatgtcgaggatcgtgaaggagtacaaagtcatactgaaaacattggccagtgatgaccccatagcgaacccctaccgggggataatcgagtcacttaacccgattgacgaaaccgacttgagcaagtgggaagctataatttctgggccgtcagacacaccttatgaaaatcatcagtttcgaatactaatagaagtccctagttcctaccccatgaatccaccaaagataagttttatgcagaacaatattttgcactgcaatgttaaatcagccacaggagaaatatgtctgaacatccttaaaccagaggagtggactcctgtatgggatttgttacactgtgttcatgctgtttggagactcctaagggaacccgtttgtgattctccacttgacgtagacattggtaatatcatccgctgtggcgatatgagtgcctatcaggggattgtaaagtacttcctagcagaaagagagcggatcaacaaccattgataccacgtaggatggatgtgttcgaatggcaaacaatgggccctcacttttatctgatgcaatttctaccttacccgggcagcgccaatttatgaatacaaatactttaacaaattgcactattgatgtattgacacatttgtatatacatatacatatattaataaggagcacgaatttttgacaagtagtgcacgcaatatctacattagttagcttttccattgacgctgaattttattttggcagcccagtagatcgttgaggagcttttttcaaacactttttctctcttaactccacatacttacgtaagaaagtgatgacgaaaaagaaagcagctactaattatgctgaaaggcaaaatttagccagtgaagattcttcaggtgattcggttcattttaaggactttattcccttacaagagttactgaaagataaaaattatgttccatcggtggaaaatttggagaagatcttatataatgaaaccatgtttaatgatcagaaaatatgctctaacctattgcttgaggctctcataattacgttgttcacaacaatttcagggaagtcagctttacgattaattcagacttcttctttgaaggaaagaaaatcctgggcccagtcctttgaaaataacagttctagctatgcttccatagtactgagttggaaagataatgatatattactcctgaaattcttaaggtttttattagcaaataaaacggcccctcttcaaattaatcggtacaatcttccagaatacaaactcccgttgagctttttaattgtttcaaaaattactattccgtccatattactcaatgaaacgtataatttgttaaaggactatttgtattcgataactggccgtatagagagtttgataagctgcagctccacatttgataagccagcacttgtcgttagaaaaattttaaaagattacaatagaatgatagaatgccgaaatttttatttctggtattcctttaatgctgagaacagagtaaatcttacttttagtgataacattagcctgttaatggaaaatgatgaaggcaatgctggaagtggccttgacgatagccgttttgatcatcaaaaacaaccgagagaggcgataatgggccgaacaataaatgaccaggaacaaatatattcattcgaactgaaccaagatggaacgcttgaaatacccaacgttatggagcattctttactaagacacgagcttctttttaaaatattaaatctcactacggtattgacgccattattggaactacaattttctacgctatgtggcttagtagatccattaatgcagcctactcccaatgataagcatattatatcgatagactttctttttcagctttttttgggattaatgtctcagtcgatcaagacttctcaagaacacaacgaccattatgactggaaattttatatgtgttttaacatgcaaaaaattattgatgctaccatgttgaggctcaactgctttgattttgatatattaaactcggtaaacaatacagataatgcagttcattggaagacgcaacttcacagatggctaccgcatggcctgaatacacaagacttggaattactctatatgattgatatactggcggtatataccatctacaagttgtatgaaaaaatacctatacaactaaacccatttttattttcattaatatccttatggaaaaacctctcctgtgttatacttttagccttagaaattgatagaattgaagaggagaatggcacttacgaaacgccgcttatggttcgcgccacaattcgtggagccgcagcattgaggtctgtaatagctaccgttctcaatggattagtgaaaaataatgatcatgatttcaagcacgagtctttaaacacattcatgtcgccctatggaagaaaattgtgtcatggtgctttatatgccgatttaaggtcacatactgcatctctacttgcgcttggagcaagcatcgaagatgtaacagatttatttgccgatttacagtcaggtgatagatttgatgaggatattagatatatgtttgattatgaatgtgaagattatgatgaatctttctctgaaagcgatcatggaggattggatgaaagcgttgttaacccaacagaaaaaatagcatctggtagtaataatgttttctttcggagacggtgcaattgcatcttcaatgatgataagttggtggcagaggatggtgcaaatgaagcctttgggtcaacaaatagcgaaaacgttgaaggcgcaatgcataataataggaatgcggtacataacgcgactacagccacttctgatcacgtcgttacgtcacctaacccactttccgttagatcaagaagtacttttgaatttgactatagtggggaagattggagggacgttcccagagatttcaatatgtactattcgccatcttattcattcatccatgagcctaagttagatgtcatatttagtttgactctacgtggcgcaacagaaaagttgaataaggaggaatccatattgttagtgcgttcagttgcatcgtgtgtaaggaacgagcaggaccaaatgattttagcagacctggagtctaatttttccgcaagtataaacggcgatgtagaaggtgaaggaaataccaaaatgtccaagatagataatgaagatctcagaagaaccacgccggatgatatttatgaaatatggtctgaagaatcagcatttgaaaggatgctaaacgtgaatcacgacgttgcgtggagattaatggatgaaatgttaatgtgcaccggttataggagaatattgatatggttccttacgcatttggagttaaaacattcgttgatatattacgtttttgaactaataatggggttacgtggaaaaccgttttccggagaagccagtgatcaagataaaaaggatgatatgatatatgagatcttgaagaaaaagcagaagaatgaagatgcttcaggacttcccttttcaaggcaaggacctatcgtattatctgatattgagactaaaatgttactgcaggagttttttatgaatgctgctatttttttgtcatcaaaaaataacgaagaagagaatgaagacggcgagaaaatctccttgtactcccttggtttggttaggttgatctgttacatggtgcagacactcatcgcgaacgacaagtttttttttaccaaatcagaatgcacttttgagcttcaaactttactgatgacatggattggcatccttcctgaagccaaagatttattctttaagatcaagacaaggctcgccatggaagaagaggatagtgccgatactatgcagcatgagggcaggaagaactctgacatagagaagaagctaaacgctaagccagcttctgaactgaatctgaaattgttaaacctgtttccctcaaagcctgcaaacaaagacgatagttcccctattaacacgttgcgtagttttatcgctgattactccttcgacacccaggtgaaccctccaggaagaagggtggtgttctacgatggtaagattttgccattgcccaaagccgataagcctatcccacttcatgaatatataacactcgcagagctcgatgttggagacagtgagtgagcagtgaattgctcatgttttctctgcatcctcatttaatgacaattagccatgtaataacatcttgaggcagttaaatattcgttaccctgcaggtggcaaaaaatttatagaataaaagcataaaaagatggatatctatgtaataaggaaacattggcagagcgaagagaacagactgctttctataaaaagttttcgatcagtctctattttaataattgattattggatatagttagtagtgttaaacatgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataaggttggaaagtattgtttgacttcatgcttatataaatatgtacgcatagaaacatatctctaaaattaaaagtgaaagaaaaaaatcgctaagattcccctttcgggggaaggctgaagaaacttttttttgcgcaaatttcaagatcggaatcgctcgagaggcaaatataaaaaagggcctgctcgtttggcctacttgttgttggattctaactccaatctaattttggcagcacttcaaaaataaacaaaagcgatgtctgcgtcactagtgaatcgatcattgaaaaatataaggaatgaattagaatttttgaaggaatcaaacgtcatatcaggcgacattttcgaattaatcaatagcaagttacctgagaaatgggatggaaaccaaagatcgccccaaaatgcagatacagaagagtacgttgaagctttatatgattttgaagctcaacaagatggagatttgtcattgaaaacaggtgataaaatacaagttttagagaagatttctccagattggtatagaggcaagtcaaataataagatcggaatattccctgcaaattatgtgaaacctgctttcacgagatcagcctcacctaaatctgcggaagctgcttcaagctcgactgtttctcgtcccagtgttccacctccatcatacgaaccagccgcatcacagtatccttcacagcaggtttcagcaccttatgcacctccagccggttatatgcaagctccgcctccacagcaacagcaggcgcctttaccatatcctccacctttcactaattactatcaacagcctcagcaacagtacgcaccaccttcacagcaagcaccggtggaagcacaaccgcaacagagcagtggggctagtagtgccttcaagagttttggtagcaaattgggaaatgctgctatatttggcgctggttctgctattggtagtgatattgtcaacagcattttttagtattctgtcacgaaatatttgtttcagtgatttaaacttacccaatgattttcgtagcttgaaagagagaaaaactcatacagaatacggatatgtgatggttgcttaacgtaaagagctccagcaggatttttgagttgcataatgtcaattagcgtgttgattatcccgcgcttgaaattattatgtagtacactatagatgtatgtacacacatatacatggaataaaaagttaaatgtgatactgagaacattatttgaaaacaagagacattggccacgaggagtgtagcggcaattacaataatgttaaaatttaaaggtgcaactgtgtcgtcttcgaataagcaggctttatgtgagaaataacggtgtatgacttcaggaagagtagcaagagcgatcttgatattcagaagctgcaaaacaataatactttgatatttcgttaaagagtatgtagaaatgtccgacgtttttttgagaagttcctaatataaaatattaaaaattaatttttcagaatatatgtggaaatttgttatttttgtatcgtatatatgaatgactagaacatcattatttttaccggaaacttgcaccagcttacatctcaacactgtcgatggaatagtccttcttggacaacttatgtctcaagcccttaccccagtaagaaaatgcaaaaggtaaagcaatcatagcagtggagatgaaagccaacaaccaagaaccccagtgcaaattcaatttgtggtacatttgaatggtaaacaaggggaaggcagcaccaccggcggatcttaagaaaacctttgtagccagagcactggatgcgtattggacgtagcaatcaataatgtaattattcaatgaataataaatcaacaccataccgaaaccaaaagctaaaccagctgaagctggaccaacccaaataatatgtttataagcggtagcacccaggatccatagagcaattgcagcaaatggagcaccgatcttagcacctagcaaacgatcttcaggagtaggtttacgctgtttgacaatttgtaaatatttgttttcacagtagaaagttgtggctaacgcccaaagagcaccgataacaataggaataaacattaaacccacaaggttatctttgtagccatatagttcaccgaaaatgacagggaaggcaaagaagaacgcatatagtagagagtaaatcaaacacacgtagaaacaagtggcaactagaacaggttcagtgacagcgaagtacaaaggtctcaacagacaagccctcatcatttcactcatactgacaccttgcgcttcctgctcagtcataatcttgggattaccagtttcctttcttaatctagcagcctttctcttcaagataactggagcgtacgtttctgggatggcagaagatatgatccacataacacctgcaaaggccatattgacccagaaaatcaggtccatacgtccggtagaaacggaaataaaaccgttaactagtggaccaacaacgggaccaacgtaaggagcaaaagcgaagaaagcaatagccttacctcttgtttcacttgggaacatatcggcaatagacccaccaactaaacacaaaccagatgatgaccaaacaccacataaaaatctacaagctaaaagacaacctagatttggagctaaggcgcaagggatattgaagatgacataaagacccatagaaacaaagtaagcaactcttctaccgtaaagatcactaacaggagaccaaatcaaaggacccagcgagaacccaataaccattaaagaacatgataaaatagcggcttccatacctacatggtatttcttttcaacggttcccaacccaccactgatacaagcagaaccgtaggcaacgcaaataactaagatggacaacaggacagtgtaactccaacgaacccatgagggccaattgtgagggttttctggatcaccagtaacaaaagtaacgaattcgatctctggatctagctcgttttcaccgctctggtcttcacgttcttcagtttcttcctcttccatttcttctttacctgtggatgaggaattggtagcggtacggttcaattgctttgttctagtacgagataaggcagaggcggttctacccatagattgtaaggtagccactggaaccagcccagatggtgtttccatggtatattcttcagggaaaatgttattcttagcagtttgtggcgcattgatatcaggcactggggcggctgaagtgacacctaaatcttgtaaagacttgacggtctcagtcttagttaacttaagttgatttgcacgagagttggtttttgaggggacatactgttgaggttgttggccctcaacgtccaccatggaagtgttttgtgagttgaatgaaacaacagattcttgatcactcatatttgttttgtgtattatttttgtgattagttattagatggaattaaaggaaaaatatcaatggacaaaaaatattagggtgtagaaataaagaataatagcagggctttgataaaagaatgtatcaattactttttgaaattaaagttaaaattaaaattcaaaccgaaaaaaaaaaaaaattaaatattaaacttgatatagtaggagaaggaagttgtatattgttctctataaacacaaacaataaaatgatatatttgttttcttatttcttcttgatgtcttcaggaaaaaagaacataaacaaatacaaaaaaatcctagtacgaaacctcaaaagggtgtatgcgcaatgtatatatatagcaagaaaaaaaaataaacagtggcattacagtgcatgcggatggcagtgttcttcggtggctttttcgaaaaacctagaatgcgtttaaaagactcagacacctaagcagaatatgcgaatgactcgttcagtaaaatgcgacgcgacagtttgttttcgttctgcgctgctgtgttctctattcttttgagatgaatttaacggctatggaatcatctcgagaaatcggttctagtaaggcaccaagacattatgtccctcgggaggagaagggcgcacgcgtcaggcttccacgacgtccgccgtgcatgcgctctcgcatttttaaggtttagtgcggcaggcgactgcgctgcggccagcccgtgagaccacccgagggaatttgagtaagcgcgcccattgcggggtttttgcggtttgcgctgttttccgcacgaggtttctccggacacagttaagcagtatatttcactcggaagcgccggaaaatttttttaagcgcaaatatattcaggtaagcagcaaaaaaatactttttccggtggcccgtgatgtgtttgtaacagcttctgcggtactttgggcggctaaatggcaaatagatcaggggaagggtttttgcataggtacaaaataaccggattttgggtaagattcgatcttcggcacttgtggcgaagtaaaagtgttgaaaaagttcgcgtaataatagtgttagccgtttcagcttcgtccataaagtacatatccacaactctcatggtgcgaagtacaaacattgaacggcagctgtcttgctcagctagtggtatgtaagcagccgcattctatttttattttcgtgcctttaagtgttaaaacctgaggcagattttttatttttttgcattccccttcctttttgccgtaatggcgcattcagtgctgatatatttatacttcaatggtgcttctccttacttttcttatagaaataaacatcaaaacatgaacctcaaattcatccgaaaatgactgcggccactcaccttgcttcttccccacaaatatttgtgttctctgctttctttgtgtgtactttgtcttgctctatataactttctctctgctgctgagtcttcaaataggtagattgatgcctgtggacttttatacaaaggagtttgagtgattacattcaagataaacgtgaaaagttattattatatcttatgctaaacaacagtgtaattgcgtttgttaagcacaatctcaaaataatgcgctaacagtggtgcgcatactgccatttgttatgggctataatcggatagtgtattcttcttgtttggttatgtatctcaacatccaggtatccgttaccccactttgataccaggaacctttcgcgttttctctcgcttttatttttttaccgcatacaaacaaacaagaaaaagtagaaaacatatgagatcatcgattttgtttctactaaaattgatgaaaattatggatgttcagcaacagcaagaagctatgtcatcagaagataggtttcaggaactggtggactccctaaagccaagaactgcgcatcagtacaagacctactatactaagtacatacaatggtgtcagctcaatcaaattataccgacaccggaggacaattctgtaaatagcgtcccctataaagacctgccaatatctgctgaactgatacattggtttttgttagatacattaataaccgatgataagcctggagagaaaagagaagagactgaagatcttgatgaggaggaggagaattcattcaagatcgctacgttgaagaaaattataggcagtctcaattttttgtcaaaattgtgcaaagttcatgaaaatccaaatgctaatatagacacaaaatacctggagtcagtcaccaagcttcatacccattggatagattcacaaaaggcaatcaccactaatgaaacaaataacacaaatactcaagtgctgtgtccaccattattgaaagtgtctttgaatttatggaacccagaaactaaccatctctctgagaaattttttaaaacctgttctgaaaaattaagattcctggtggattttcaattaagaagttatttgaacctttcatttgaagaaagatcaaagatacgatttggttccctcaagctcggtaaaagggacagagacgctataatttatcataaagtaactcattcggcggaaaaaaaagatacgccgggccaccatcaactccttgcattattaccccaagattgtccatttatctgccctcaaactacattagctgcatatttgtatttaaggttctatggtataccatctgtttcgaaaggggatggctttcccaatttgaacgctgatgaaaatggctcacttttacaagatattcccatactaagaggcaaatcactgacaacttatcccagagaggaaacatttagtaattattatacaaccgtgtttaggtattgccacttaccttataaaagaagagaatatttcaacaaatgtaaccttgtttacccaacttgggatgaagacacttttagaacatttttcaatgaagaaaaccatggaaattggttagaacaacctgaggcctttgcgttccctgacaaaataccgttcgacttcaagaaaatcatgaacttcaaatcgccctacacttcgtattctacaaacgctaaaaaggacccttttccgcctccaaaggatttattagttcaaatatttccggagattgatgaatataaaagacatgattatgaaggtttgtctcagaattcaagggattttctagatttaatggaagttttacgagaaagatttttgagcaatctaccatggatttacaaattctttcctaatcatgatatattccaggaccccatttttggaaattccgattttcaatcatacttcaatgacaaaactatacattcaaagggttcacccattttatcattcgatatactaccaggctttaataaaatctataagaataagacaaatttttactcactcttaatagaaaggccttcgcagttgacatttgcttcgagtcataatccagatacacaccccactcaaaaacaagaatctgaggggccattacaaatgagtcaacttgatactacacaattaaatgaattattgaagcaacagagtttcgaatatgtgcagttccaaacactttctaatttccaaattttattatcggtattcaataaaatttttgagaaattggagatgaaaaaatcttcaagaggctatattttacatcagcttaatttattcaaaattaccttggatgaaagaattaagaaatctaagattgacgatgccgataaatttatacgtgataatcagcccattaaaaaagaagaaaacattgtgaatgaagatgggcctaacacatcaaggcggacaaagaggccgaagcaaattagattactctcaattgcggattcctccgacgaatcctccacggaggattcaaatgtattcaaaaaggacggtgaatccatcgaagatggcgcatatggagaaaatgaagatgagaatgactctgagatgcaagagcagttaaaatctatgataaacgaacttataaactccaaaataagcacttttttacgggaccaaatggatcaatttgaattgaaaataaacgctttattagataaaattcttgaagaaaaagtcactcgtattatcgagcaaaaacttggttcacacacggggaagttttcaacgttgaagaggccacaactatacatgacggaagaacacaatgttggatttgatatggaagttcctaaaaaacttaggaccagtggtaagtacgcagagactgtgaaagataatgatgatcatcaagccatgtcaactactgcatcgccgtctcctgagcaagatcaagaagcaaagagctatactgacgaacaagaatttatgctggacaaatccatagacagcatagagggaatcattcttgaatggttcaccccaaacgctaagtacgccaaccaatgcgtgcattcaatgaacaaatcaggtaacaagtcgtggagagctaattgtgaagctttatacaaggaaagaaaatcaattgttgaattctatatttatttggtaaatcatgagagtctcgacagatacaaagcagttgatatttgcgaaaaattacgagatcagaacgaaggttcattttcgcgcttggcaaagttcctaaggaagtggaggcatgaccatcaaaattcatttgatggtctgttagtatatctatctaactgagggagcttcgaagtttaaactgtttcgtatagggataccgacatgtatgtttataatataatgatgtttactatgagaaaaaggctgccggaatatcaacggttgctgtggtgagaaaatcgggtaacacctataggggttccatcacttcagatgccttgaactttgaaatctatacgaatataggaagactgagttggtagacctggtaagatagaagaggaagaaggcttctttattaccgcaactaagaataaacttatagcttcatgcgaatctcaaaaaatagtcataagcggcaaagaacgaggctatatttcctcgttacatttattatttattcgataataccctgccgtgcggtactcgtgccttggctggatgatgacccatttgaagcaacgcttctagaaatgggggatgaaccatggagtaaggacatcctttcaagcacacctccgttacatccatctgaagttaccgaggataacaaaagcttaaaacaaaggggcaatgtaccgcaatatgtcatcgataatagccctctgctccatttatatagtgaagaaaagtactggccagctgatgttaaggattttgtaaaaagattccagttgagagaccacagtggggagaaaattatcaatgaacaccttcgtgacttaagtgacttacaagagtattattcggtagagttagagaacggaacgtggggccgagtatccagtgaaggtacatatatgacaagtttagatgattttgataagggccctgactggttgttgggtgaacaaccagaatatggtacaggtcacataaagaaagcaccagcagttctttttgtcgttgacaaaggaaatggttgggtagacgcgttctggttttatttctaccccttcaattggggtccttatattatgggctccggaccatggggaaatcatgtaggggactgggaacattctttagtacgattctataaaggagaaccacaatatctatggatgagtgcgcatgggggtggtagtgcctataagttcgaagccattgagaaaatcaaaagattgcgtcgtgttgacggtaaattgacaaacgaggttattaagaagcctttaatatttagtgcaagaggcacacatgcacattatgcatcagtcggtcaacatgcgcacgatgttccgtttttctttatgccattgagtgactttactgatagagggccattatgggatccttctttaaactattatgcctatacagtgactgtgggggaaaaaatgacaccatgcggcgctgaagaaactaaaatgggactagaatggctatcgttcaaaggcgcttggggcgataaacaattaagacctagggatcccagacaaaaatggtgcccatttcaatggaaatatattgacggaccaaaaggtccactattcaaaaatatggaaagggtttctttatgccaaagatttaaatggtggaatttttggaagggctgcccggcaagaagatatataaaaagaggggaaggtttggatgcagaaaagaatgatcttgtgggtgacaattgtggtatcttgctgtacaacataaggccaaagtggctgcgtagcatactccgttttttgacgtggaggggaagcgtatgtttcattatggactactttacagggtaatgaatatttgggcgtttttcgctattttagcatgctgtagtgtatgtactgtgcatcgtcatgtagcactatttcagccgtatttttctttttttctttcgcaccgtctgtggttgtaaagttactgacacttttttttctagaaagttccggaaaattgcgacactcggtggagctcgagagttgtatccagttttcttgttcggcgatattccgaaccaggtcgggttgggctaacagccgcccaggatggaagaattaagaatttcatagaagccttcagttcttggcgaagtaaagtggcaaaacaaatggaagatctattgcattacatatataaaagcattagaacaatcttttctcattgacaggtattctcattgctctatatatattttcttcttcttgaaagaaatatcagtattacaatcataacaacaaccaaaagaaaataactaatagaccccattacaatatagaaatgttttccatattcaattcaccatgtgtttttgaacagctgccatcttttagtcagcccctacattcgcgttattttgattgcagttctccagtgagctattatccagaatgtaaaaggaggaaagcaataaaagctaacctaagagctccaaaaaaaagcgatgcaaattgttcagaacctttgaggtatgcacttgctgaaacaccaaatggttatacattaagcttgtctaagcggattccatatgaacttttttcaaagtacgttaatgagaaattaggtgagctaaaggagaaccattacagaccaacttaccatgttgtccaagatttttttggaaaccagtattatgttgaagatgaagcggatgaagatgctctattgagatctgcattgaaagatctggattttagagccataggaaagaaaattgctaaggatcttttccaagactacgaaatagaattgaatcatagaggtgatgaattgagcatattgagtaagaaggataaaatctttaaggaattctctctagaccaagtgtttgaagatgtttttgttattggctgtggagttgaaaacatagatgatggctcgagagaaaaatatgcacttttaaagattggtttagttaagcatgaggaagaaatttccgaaggtggcatcaacgaaccaaagatgccaataattgaatccaaaatagacgagtctcacgatgatgttaacatgtctgaatctttgaaggaggaagaagcggagaaagcgaaagaaccactaaccaaagaagaccaaataaaaaaatggatagaggaagaaagattgatgcaggaggaaagcagaaaatcagaacaggaaaaagctgccaaggaagatgaagaaaggcaaaagaaagagaaggaagccagattgaaggcaaggaaagaatctttgataaataagcaaaaaaccaagaggtcccagcaaaaaaaattgcaaaattccaaatcattgcctatctctgagattgaggccagcaataaaaataataatagcaattctggttcagcagaaagtgataatgaaagtataaacagtgattctgatacgactttggatttctctgtgtctggtaatacactaaaaaaacacgcttcacccctattagaagacgttgaggatgaggaagttgacagatacaacgagtccctaagcagatctcccaagggaaactctattattgaggagatataatgggtgataatacatactccccatctttcatttttacggcattaaataactaattatatgcatcttatatactactataattcactgactttatgaaaggaatataaatcggcacggcagaaggcggatttattttgttacaatataacaaaataaaagggcaacagtaaagtagaaattattagtatccgtgattttagtacaattatttgcttcctagaaatccggttttccatgttaacatttatgctagtattttatggtggaatggcaagtgattcacaaaatacaagctactttatcgaatgattgaaattcatttctgcttgaatagaattcaactatcgtttatcgattctattttgaggattcctataccctcgaggagaacttctagtatattctatatacctaatattactactgttattaacaatggaatcccaacaattatctcaaaattcaccaatatctcaattccatctttagaaaaattaagttcaaattaacggaaacagtaatcaagtaaaagagctttttttttcttctccccttcctgccctgaagataattgagtaaatgttacgttgagaatggctttttgatatttcattagatttacttcattattcttctctattctcccctttcatcaattaattgggcgtgtggcgtagtcggtagcgcgctcccttagcatgggagaggtctccggttcgattccggactcgtccaaatttttttacttttaatgaggtatactggaatattacggctctttttttttagaaacatattcctcaaatgggtaaacggaccctggtgcaaggtgtgggtgctgagacaaatacgatctgagttgttttaaaaaggaaaacaaatgaatgcgtgcccaaagcggaaaattggtcaacatcgatgcgtaattagtaggcccaggtgagcctgtgccgaacatgtatctctgcgcagattactatatattcccgagcataacagcatatagttttctttcacataggccttcctccaactgccatcactgtacatagacgtttcggcactgtatattcttgtccctttttttttgcctactacattgctgcattcaaacgatatcgctctgcgaaccgtttaaaactgaccaaaatagggagacctaccttctaaggagaaaaaattcgcattgctaaaaaaaagctaaaagagaaagagaagaagaatattaaaccagtatattctactacaactatcgatttactccgactacaaagtgcctcttcgtattttcagtcgctcgaaaaaacaacccatattccatttgattctacgcagctggtagaaacttttacaggtttgataaaattattacaatcgttagcggttacgcaaggaataggaaataaagaaacggtaaataataagaaaaacacagcagatctaagcctattgcacacagtatattataaccattactagctagtgttacataaacaatagcagaatatgtctgtgcgaaacctcaccaataatcgtcattccaacagcgaaaatagtgtttccggaagcgaaaactccttttattcctcgaatgagcaatcaagacaaagctcatcattagaacctgcagatggtcagaacgttagggtgagcggtaatcctttccttggaagtgaagaatttgacgaagattataattcacccagtggagacgatgagcggcgtggggcaaatgaatattccagttcttcatccataaattataataacgatcctaacagcgatacttctcttctggctaatgaaaagaactcacccgagagaaatggtcaaagaatgtcagactataagggctattatgctaagactaacctaacttctgctaataacttaaacaatcataataacaataattataagaacattataagcagtagtaacgataatagttttgcatcacatttacagccgccggacagaaacttaccgtctcatccttcttcaaataatatgagtagcttttctaacaacagcttaattaagtctccaccaccttttgacagatatccgctagtaggaacgaggcatatttcagcggctcaatctcagtcgcagaaccttataaatgaaaagaaaagagcgaatatgactggctcatcttcttctgctcacgactcttcattatcatccaccaacttatacatgggcgaacaggatttttcgccctttggcggttatccagcttccttctttccgttaacgttggacgaaaaggaagacgatgactacattcataatccaaatgtcgaggaagaagcaaagttagatagaaggaggttcgttgacgacttcaaacacatggatagaagatctttcttggggcttctgggtattctatttttatttatggctggtatatttattttcattgtattacctgcaattacattttccggggtagtttatcatcatgaacatgttcatgcggcaaattcagcaggatcgtcgtcttctaatactacatccaagtcattgactgaatatcaatatcctcaacttgcggctataaggacaactttagttgatccagacacacctgacagtgcgaagacaagagtagcgaaagatggatctaaatggcagctggtgttttccgatgaatttaatgctgaaggtaggaccttttacgatggcgatgaccagttttggacagctcctgacatccactacgacgctacgaaagatcttgaatggtactcaccagatgccgttacaactacaaatggtaccttgacgttgagaatggatgcattcagaaaccatgacctttattacagatctggtatggtacagagctggaacaaactctgctttacagaaggtgcgttagaagtttccgcgaacctccctaattatggtcgagttacaggattatggcctggtatgtggaccatggggaacttgggcagaccaggttatttggcgagtactcaaggtgtttggccttattcatatgaagcatgtgacgctggtataacaccaaaccaaagttccccagatggtatttcttacttgccgggacaaaagttgagtgtttgtacttgtgataatgaggatcatccaaatcagggagttggaagaggcgcaccggaaatagatattttagaaggtgaagctgatacaattttgggtgttggtgttgcgtcacaatctctacaaattgctccatttgatatatggtacatgcccgattatgacttcatcgaagtttataatttcaccacaacaactatgaatacttacgctggtgggccttttcaacaagctgtctcagcaatatccactttaaatgtaacatggtatgaatttggggaggaagcaggttattttcaaaagtatgccattgaatatctcaatgatgacgacaacggatatattcgttggtttgtgggagagaaccctactttcacactatatgctacttctttacatcctagtggtaatattgactggaggagaataagtaaggagccaatgtcagcgattttaaacttaggtatttccaacaactgggcctatatcgactggcaatatatatttttcccggtgacaatgtcaatagattacgtccgattataccagccgaagggttctacgtccattacttgtgatcctgaggactacccgacatatgattatatccaaagccatctaaatgcatattataacgccaatttaactgattgggaacaggctggatatactttcccaaaaaatattctaacaggaggttgtagtagttcaaaattctcattatcctgaggttgatttttttttttcaactggttaaaacctactatctaagtgcgctttaattctaaggaggcaaaatagtctgcggtcacagtcgttgaaagttctagatttgggtacggaagcagccatgtaaatggtcttcctttgtaataatatcatcactggagtttttaaattagagtacggattcaagttagcgaaaaatttctgttggtatctgatagcaatttgtcgacaaggtggagagtttttgaagtttttttttgtaacagttatgttacactatttaccagagaaacaccaagacaggagccctcagaagctttcgtgttgtcagaacataaatatcttctatatgttttaatcttttatattaatcaatattttatgttaaatcatattattattcgttaatggttaacttgcgctatttcaaaattggaaggatagtgtggttacaagcggtgtttttgatgtatgtttactgctaagagtataccgtcctgtttacttttttaccttttgttccgttattgatttttcgcagcaaggttgaagcttcaaatttgaaaatgaaattaagacgtagagatgaaaaacagcgatgaaattactttttatagcttctttcccatctgactccgttttataaacaggggttctttaagggcttacaaataaatataaacactaacacatatatattattcgacctacagtttttgcgaccaatgaagtttacctattttgagttagtgcttacgtagtttgcttaaggtcaaggtggtattaagcttgcgctttctctaaataatatcatatggtacagacagggataagtacttcataataaaccaattgctagtccagtatttttggtaccctcttactgccgcgaaattcaacaactttttaactcgtgaaagaggttaatattattattcattttgctagaaatactactaaacaccccattaggaagctggtaaattatgaaatcagcaaaataagatccaaccggaacgaatttattagaagctcaaacacaagggttgatagtgtgataaaggaaaggggtgacaacgtgtagagggtaaaacttattgattcctttttgtggattcctataccctacaagaacactgttggatatagacattatatgcaatattaattatgcgactgataggcttcgtaattcctgcttgagtaaagacaagaattttcatttctcattaactgtttttatttataacctaggaaaaaaaggagctgaaaatttgttggaataaaaatccactatcttatatcaactagtattcctaatgtcagtatattgtcatataaggcgttagatggtgacataaggtatgaaaagttgccatcgaagttagaggaagctgaaatgcaagcattgatgtaataggatcaatgaatattaacatataaaacgatgataataatatttatagaattgtgtagaattacagattcccttttatggattcctaaatccttgaggagaacttctagtatatctacatacctaatattatagccttaatcacaatggaatcccaacaattacatcagaacccacactctcttcaattattatgtagaaatttcgattctattttgaggattcctataccctcgagtagaaattctagtatatcctacatacctaacattattgctttatcaataatggaatcccaacaattattgttacaggctacgatattgcgtatagaaaaaatgttgaaagttcttctgcaagatacaggaatccaaagggaatcaatatatctacctaatagtattattatttcttttccattttatatgtttcactatcctactatttcatcgatcctcttatttaagcttttattaaacctaatgactgttctataacttttatgtcctctttttacatcataaatgataattaatatactagtgacatgaatactaatcgatggatggtagtttgttcttattctatcagggaaatgcatcagataatggataaaatggaaagaatggaaaggaattgtaacatgcctatatatggaaaacgagcttttagagctttcaagttaaccccgggcggttagtgtagtggttatcatcccacccttccaaggtggggacacgggttcgattctcgtaccgctcaagattacttttttaattttcatactttttctcctaatatcttgcaaatcatgactgaattgacattaactgatgcaaatgggtgggaaaaatgcttatcaaccccctaaaaagtcaacttcttcgttagtgattgctatatgtggcgtcaagaattacaagaagctggcgagctttccaagccccttcaggattaaccgttttttaccctttttttacaaatttacggcggggaataattctgatactttctctttatgagcattcctcaacagggatcggcactcaattgctttagtgaatagtttttttttacgccaagaacatttaccaccccattttcctgtagacgtccaaaacgatactctactttaagccctttttctgaagttttcataaaatgtccgatctcctaacgtcatttttaaaatcaaatggtcttttaataattatgcacgttaaaaaacatacataattgatagtaaagaatctggtattctatcagttaccaagttcaatcgtaaatttttttacgagcactaatagaaatggatcatgaaattgattttttgattttcaatttatgaactacccagatatataaatattggaataaattgtgtattaagtagtcgggaaatatcttttatgttctctttcttatcatctagaaataataaatcacaaccaaaaaaatcaactaactatcaaaatgtctgctacctctactgctacttccacaagtgcctctcaattgcacttaaactctactccagttactcactgcttatctgacatcgttaagaaagaagattggtctgactttaaatttgctcccatccgcgaatccactgtctctcgtgctatgacttctcgttatttcaaggatcttgacaagtttgccgtttctgacgtgattattgtcggtgcgggctcttcaggtttatccgccgcttacgtcatcgccaagaacagaccagacttgaaggtttgtattatcgaaagttcagttgcaccaggtggtggtagttggttgggtggtcaattatttagtgccatggttatgagaaaaccagctcatttgttcttacaagagttggaaatcccttacgaagacgaaggtgactatgttgtcgttaagcatgccgctttgttcatctctactgtcctttcaaaggtcttgcaattaccaaatgttaaactgttcaatgctacctgtgttgaagatttggttaccagaccacctaccgaaaagggcgaagtcaccgttgctggtgttgtcaccaactggacgttagttacccaagctcacggtactcaatgttgcatggaccctaacgtaattgaattggcaggttacaaaaatgacggaactcgtgacttgagtcaaaagcatggtgtcattttatccactaccggtcatgatggtccatttggtgctttctgcgccaagagaatcgtcgacattgatcaaaaccaaaaattgggcggtatgaagggtctggacatgaaccatgccgaacacgatgtcgttattcactctggtgcatacgccggtgttgacaacatgtactttgctggtatggaagttgctgaactggatggattaaaccgtatgggtccaacttttggagctatggctttgagtggtgttcatgctgctgagcaaattttgaaacactttgctgcttaggcttttaatgaggtatgcttttaaagatttatatattttttatacacgctatatacacaattttcgctgatgattttgttttattattgatttttaaattaaccgtagaaaatactaagtggaaagatccgatagtgatgagataagacttttagttatctctgtaatggtgagttttcgcacatcttgcaatattaaaaatataaatcaattcttcaaatgtcacttcatggtcgggtaaccaaatatgatcttaaaaaaaattaagaaaaaaaaaaattgaaaattttgagctaagctcatctcatctcatcggctgtaatcagtaacacatcatttattacatcagttacaggtatcaacatatatcttcaaaaaggggacattatggttttgaaatctacttccgcaaatgatgtttcagtatatcaggtttctggtacaaacgtttcaagatcacttccagactggattgcgaaaaagcgcaaaaggcaattaaagaatgatttagaatatcaaaatagagtagaactgattcaagattttgaatttagcgaagcctccaataagattaaagtgagtagagatgggcaatattgcatggctaccggtacatacaaacctcagatccatgtctacgattttgctaatttgtcactgaagttcgatagacacacagatgctgaaaacgtggatttcactattctctctgacgattggactaaaagtgtacatttacaaaatgatagaagtattcaattccaaaacaaaggtggtctacattacaccacaagaattcctaaatttgggagaagtttagtttacaataaggtaaactgtgatttatatgttggtgcgagcggtaatgagttatacaggttgaacttggaaaaggggagatttttaaacccattcaagttggatactgaaggcgtgaaccatgtttctatcaatgaagtaaatgggttgttagcggcaggcacggaaacaaatgtagtggaattctgggatccaaggtcgcgttcccgtgtttcaaagctatatttagagaacaatattgacaacagaccattccaagtcaccacaaccagtttccgtaatgacgggttaacttttgcatgtggtacgtcgaacggttattcatacatttatgacttgcgtacttctgaaccttccattattaaagaccaaggttatgggtttgacattaagaaaattatttggttggataacgtcggcacggaaaataaaattgttacatgtgacaagagaattgcaaaaatatgggatagactagatggtaaggcatacgcttctatggagcctagtgttgatattaacgacattgagcatgtaccaggtacaggtatgtttttcaccgctaacgaaagtattcccatgcatacatattatattccaagtttaggaccatctccacgctggtgctcattcttggattctatcacagaagaattagaagaaaaaccaagtgacactgtttactctaactacaggttcattactagagacgacgttaaaaaattgaatttaacgcacttggtgggatccagagtattaagagcatacatgcatggtttctttattaacactgaactttacgataaggtttcattaattgctaatccagatgcctacaaagatgaaagagaaagagaaattagacgtagaattgagaaagaaagagaatccagaatcagaagttcaggggctgttcaaaaacctaaaattaaagtcaataaaacattggttgataaactatctcaaaaacgtggtgataaagttgcaggaaaggttcttacggatgaccgtttcaaagaaatgtttgaggatgaagaatttcaagtcgatgaagatgactatgatttcaaacaattgaatccagtaaaatccatcaaagaaaccgaagaaggtgctgctaaacgtattagggcgctaactgctgccgaagagtccgacgaagaaagaattgcaatgaaggatggcagaggtcactatgactacgaggatgaagagtctgatgaagaagaatctgatgatgaaacgaaccaaaagtcaaataaggaagaattaagtgaaaaagatttgagaaagatggaaaagcaaaaggcactaattgaacgcagaaagaaggaaaaggagcaaagcgaacgttttatgaacgaaatgaaagccggcacttccacgagtacgcaaagagacgaaagtgctcacgttacatttggcgaacaagtaggcgaattgcttgaggtggaaaatggaaagaaatcaaatgaatccattttacgtcgtaaccaacgcggtgaagcagaacttacttttattcctcaaagaaaaagcaaaaaagacggaaattataaatccaggcgtcatgataattcatcggatgaagaaggtattgaagaaaatggtaataagaaggacaatggtaggtcgaagcccagattcgaaaatagaagaagagctagcaaaaatgcgttccgtggtatgtagttatattagaaattgatattttaattatcctttcaccttaaactaaaaatattatatgtatgaagacgaagacagcaaaaagtatgcgtgatacagtttacattatagaattctttccccaaatattgagggttttgttttttttttttaatgcagatgtacgtacatattttctttatcaaaaggatgtgtagagaactatgtatatatgtatatgtgtaggttttttttttttaggatgactagaaaaggaaatcgaaaaagaaaaaataagcatgaatcatgagtaggttaaaggcaagtcgaagaagatacgaagcaagtgaagccgtttaactggaggatagtctaaaccataggttgtagttattctcaatgatctgatctgagatcaaatgatcatcaattagatcgtttgatcgtggcaagttgttttcgtaacccaaatgtgcctttgaatgcaattggtaactagaatcgagtctaagagagtcggctaagttcaaataatgttcattttcatcatattcgtcaacacgagaaggattagactcctgcttaggattgactataccatcctgaggtagcagcaatggtgaaattaataaggactctagcttctccaactcgtcaaaggggatagttgaagatgtcggagatgaagatagtgaggtagtcggctcgaagaggtttgatgcagttaaatttttagaatatgaaagcggtggagtgagattatgcgaatgagaagtttttgattttttatgcaagtgggataataatttctcattaagagggttcgaatccttcagcttacaatcttcggagcaatataacttatttgattgtaaactgctcttggtttcattgtccctttggatcttcctggtattaatgttcgttttctgtggagatgttggaatgagacgatcacaaacagtgcagtaatcgttgaatgcggtgctcattatatgattgatatgcaaatcggtaaagaatacctgaaaggagtggagggataagaataaagtaattattctcgagctttttttataaggaaaaaaaggagaatcggtagcggagtattgtttctctattctttctttgcttactctgttttataattctcacaagtgttcaatttttaacttcttgggacaacactatagttctaagttctttagacagttcaaagacagtttactcaatggcgatggcctgtgtcaatgattatattgtatatatatatgtgtccaagtatggatgtgaatgtatctaaattttccgaaatgcaagaaataaaattctcacaattggggtgttgaaacggaaaagatcggtattcctttaaatataagaatcaccacgtttcaggtctccaagttctagctaaagatcgtacaaacaagtgccaatttgggaaaaaagggcggcctaattgtgaaaaaaaaagatgcccaactgaaagaagggcaatgagcaatagggaatgtaaacgaatgcaataagaaagcacacgttaaattacactcagggaggaaccccataataaaaaagtaagaaaattgaatgatctgaacccggtgcgcaaaagcgatgagatggggcgatgaatgacggtaataaacacggtagcaaatacacccgagtcgtgtgccctacattaagaaaaaaagagatgaaaacttctcctctattccgcggtaacctatggtcacggccagattttttccaagtatttttagctcaaaagctgaaccgctttagctggccgactaagcgaatcttctggaacatatgtgaaaggcgcactaggattttcgttgagggatgagcttcccgttgagaattaatgcgacttcaggcggcacaatacgatctgttgttgccgtttgagtgtcgtttggcacgtggaggtccctcctcagtgctcattgggtggctcggccggggtacagctagcaggattaacgatccctcttagaaggatcgcgagcaatagcactagcaaccgggcttatgtaaaatgagtacggtagaagcttctatgacctgttcacgtggccaaatgttctgttactagtacgtaaacaacgtggttacgtagaaaaaagaaaagaaatgtaaactctatatacatgctaagcctacgctaatattctttcacattaggccatcaaaccatttctggcctttggttcttggtttgcgctttgtaatgtcgagcgctgtgccctcattcttgatgaaatcgctagggttgttccctttgtatcttattttggcaccagaggccatcgtttggaatacctttttctgcttcttcatcaagtcgatgccaaacctctgcagaagcttgacgaaggatggcgttagcactgccgtcaggggtactctaacgatgatcaaactcttgtgtatgccatacgcaattagcaattcggccaacaacgtgctgtccttcatctcttgccatctctcattgaaagttttcctcgatgcgtcctccaccttgtcagcattctctgcttgcactgcttcgcgatgagcctgtttccttctaacatcttgaatgactttgctttcgtcaggctcacccatcccaatcaattgcttacctctgttcagatagatcttaatcttctcttcacctagtgagtggactcccagaaaacataatggcaaatcaacacaagttaagaggatatatacgatcagtgcagaataaccatacttagccattaatcctttaataccgtgtggctcatttttcttcccattgttacttttgcttttattttcatcaaactgactacttttttcctctgtactgtaaaattttctgtcttgtgctgagtgcacacttatcccaggtcgtaggagaaggcattttaccatactcctacaaggggcactaaagtccctgcgcagtgtatgggatacggttttctgtatgggtaaagttacaaatccccatcgaagaaatatcctcttgaaaactggtgaagcactaatcctgggtaccatcatcaccccaactctagaccaaaaaagaaaatttcaaaaaagaaagggaagatctaatctccttgcagcgatctaagaggaatttatgctactttttaactttggttttcccttgttcttaaagatgtgatatcatgtaaatgtcaagcccataggcttcgtgaaaatccacttgaagccgggtaacgatcatgaacaataacaactgctcatcccaaagatacctttatgacgttttcaacgtaacgcagatttctattgtatcacggtcttttatatattatattatttgatacttaacacaaaaataagtacggatcacgtttttatttttttatttcatttttcttgtaatgatatattattaataaaaaactaacaaaagttaattatcttaacgggaagtggcggcaaccttttggaaagcacccttagcttgttgcttggaaaccttggaaccttggacaccagcggacttagccttttcagcctttctagcagccttttcagctctcttcttttccttgttggctttcaatttttcttctctgttagcttttctaacttctggcttcaaagatcttctttccttgatcaagtccaaagaagcaccagtgattggtctttgcgccttaacggtctttctagatctcttcttagcaacttcttcggtgatacccttcttgtgatgctttctgaacaagacggtccaagcgattcttcttgggttctttctttgtttgaacaaagaagcagatttggagttttggaatctgaaaattttggagtcaccacggacaaataaagtacctctacctgggtagatcttagcgccggaaaaggaatcaacttcaaccttcattgttcttctaaattaaaaagctgtgaaaaaccacaaggtgaaatacactcatggtttatatacaaattgatgttagtacacaattttggttcaaagagttttaaatgggagaaaatttatcaagccgacaacgagaacagtatttcatcacgacaagcatatccaacagatcccgatgtatatttgccaatgatgttccgtacgtctttcgacggtcctgatttattcgcatgtacttttctgggaagatgttcaacgttgattaatataacgcctttatcgtgggcctcttattaacctcagcattgttcaaatggtcgcttctttctcaattcctacactgcgaagctcctcgttgtcctcaatattctctcatttcctaatgggcacgcgacatacgtttcaattcaaattgttgctcgcctcttttgttgaccacccaaaaatttaaacgcctataatttagttaatcaatataggttacctgtaaatattggtaatatcaactcccactactactgtttctggctagatgtcaactgcgcaagagcaatcaggccaaacgggaactcccgtcaacccatggctggagttccctcaacgggaacctctacattctcctacagaggcgcaggctcacggtaaggaacccccggtagtgttgcgcgctcaacgacgcgaaagccttaattgccgcagtacagagtataaagtttttaaaaattgaaaattagtgattgggtttagagtatgcacggatgttgtaaggaatattgtttggcaaagtttcacataacgagatatatgctattttcaaacaaataatcctgccaacactagcgataataggagttgtggaaagcttggacaatgtacattttacacacacatatacatacgcacaaacggatgtacgtacaaatatttcattaacataatatcttatccagcacaccaggcatattaggccaccaaattacgtatggctgtatttcggtttggcattataattttgaaaattatctcgcattatgtgtgacttcgccgaatattcacaagcagatcaaatgctggctttttttagacatatcaacccctaaatgggtttagcggataacaaatatatatcaatagtaatataaggtatattcaatagagaagctttgacatcataaaagctcccatttaacaaaaaattatctccacattgtgataccatttagagtggcactcatcgctatctttatcgtaatgtacaagttggacaataacgacattgacgatgaaacgaataactctgtttcactgacgagccttttagaatttctcgacccgatcgcttcaaaagtagtttcaaaatactaccatggttctcatctttcgaaagcagaacagaaattgcgaaattttgagggttttagaagacgtaaaccccatcatgaacatgatagtcatcatccacatcacctgaatagaagtcgctctttcttgcaattagaggacttcaaagtaagagcgttacaaagaattaggaatctggataaacccttggattccatttttttcaaaaacagctcaaggttggagaaagcattttaccctttcacactgtttaatatatttttcatcggatttttgatgggcaggtttccagaatggtttcatgtttactataccatcctgttcttcgttctgatgcccatacgtttttacacatactataaaaccaaaaaccactactttctggctgatttttgttactttgtgaacatgctatgcctattgtttatttggattttcccatattcatacagccttttccagtcatgttttgcattcactttcggaacgttatgctttgccgttattacttggagaaattccttggtaatacattctatagataagactacttcatgcttcattcacataatacctccctgtgtcatgtacgtcatctatcatggattaccactcgaatacaaaatcgaaaggtttccgggagcaattattcaaagtgaattggacatcaaaaaaaatattctttggacatccctttattatttggtttggcaatcattataccattacttcatcacgttgaaaaagtctagcaagatcaagtcaggggaaagaatgacaagttttgaatatttaaccacacaccaatttaaaaacttttgggcagttaaattaaggtcaccttggccgatgataatttacacactttctcaatatttctatcaactattcactatgctattgtgtggcatatggattcgttacaaattagctgcggccctatttttaactatagtatttctatgggcgtctcataatggggctacctactatatcgaccactacgggaagaatttcgaaaaagaagttgatagattacgtcttgaagttgagaatttacaacaaaagttacagcctgattctgatgcagtcatatctgatgcctccgtgaatgataaggattacttgaatgtcaaccgtgacgaagattttgacgactcttcaagtgtatcctcaaagagtgattaagatagttcacttcatttatctgttaactttgagagcttttatttacaggcgctttactatatatatatatgtgcatgcatggacgcgtatatgtcgtttcttgatatataatcacttttagtctaatgactacatgttaagttcttgttcctcccacttcagggcctttgcgtgtgactttttgtttactacatccagtaagatttcaacgctatttctatcctcgatttcttctaatgctttatgcaaattcctaaccatggaataagtccaattgaagcgattttttgaagacaatatgatagctattgcgtccgaatactttccttgctttgtgaagaattcaaccattagatgggcaaatttctgatcctttgctattcttattctttggtccattttcagaaacggtacagtcgtcctaaatttacccctatcattccatactttctttgctaagtcctcattttgaaattctatagcggctttcatcaccagctcatataacgtggtgtccatcatgattttgtgcctcaaacatgtaatataccatatatcatgcattattaagttgaggtcttccgtggtctcaggtttggatactgagatggcttcagttgatattgaattttggtcacgcgtatgggacgaaggaatattacggtatccttcatacaaacgctttatgacagcttcaaattcgtgttgttggaaagtgaagaacgtcaaccttcgcaagaattccttctgttgttttaagttaatgggaattgacaaatatgtgtgtagtgaaattttattgaagacgttcacattaatactttctctttgcattttcgtcacttcgtacataactttaaacttaaactcgttgaaatcctctgcttcttgcgcaaacgaatcaagtaattgcctatattttttgatatcctccaacgccgcttcatttgaagatgtcaatgtattgcgcgttcctccattttccatattgaaactccagattgcgttagattccgccaatacttgtgcctccgaatttaggtcactaattggaagaaatggtaatttaaatttgaccaatttgtctgtatcatctaacctcatggaggaatcaaattcgcgaagaaattttcttctcaattcaatgcctttttcataaccggataagactggcaaatttctgggatcaaatcttgcataagcaagcatcaaataattcagcatttctggcattaaagttgacttccaaattgtatcttgatctacgagaatgtttcctttccaatttgcgcacaaagttttgtactttttcgcgatgaacaagtaatatagagctctacttaattcaatatcaccatcaaacgcggctaatgccatcatagccaaaaataaatttaagtcatcttttttatgtctgtaaagattcttgtcctccaactcatgaaggtatttccatcccagtaatcttagagagtctgatttaccctcactgacaacggcattactgctcgaagaagccaacactcttgccatcattatgtaagtgtttgttgtaggctttatattgtggtcttgaatttcttgaaataaatccaaagccttaggaaaattccgttccttctcgcatattcgcagcattgtgttatatgtgcagatatcagggaaatgctttgtagataaaaatttcatggtgtcaaaagtattccaggcttgcttagtcatttccttcctagagtagaattgtattacagtagttaggttttgcttattaggagttatgccataatcatctctgaattttgtaataaaataatccatgtcgtgaaagcttgaacacttggtcgagtattttaaacaattattaagtattgcttgcgtcatctttggtactttggaagggaatccttcttttttgttaattctttcttcagttatttttaatgccttatcatacctctctaacaactctttcattttgaggataactttatcgttagtaccatcctgattaaaattagttggttttaaatttcctaagttgttaaagatacattcgtacatgtgggtattaaattttacaacatctccattgatttgttctaatagcatttcatccaagtgtagtatactatgaaatggcaaatatttgactgtaccatttaaccaaacagaaaattctctggaatcaatatccatgaaccgtttctcactgacataaagcctatctatgacaggtgcccaattactgtgtgatctatcaaaaaggttttttgcaagtatgtcgtcgtctgctactctttctcttataacttttggtacgaggtgatccattttttctaaaaacgaagaatgaatcaaatctgatagatttttggatttttcttcattaggaacagatgatgttttggtgacattaacattccttgagtcttctgagattggtgcgatactattgctttggtggccatctgaattcaccgatttagtgttgtgaatgcgttcttttaaagtattagaaaattctcgtaattgtgctaatttgaactcaacgtcttcaggtgttattattttatttttacttaaactccccatcatattcttttcatcttcagtttgtagggtatacttgaaacgcttatttattagtcgttttgaaaatagaaaggaaagttgaaatgggaaacacagcacattattcttggggccacatctggccatgtacatgtttatatttatctatctgttaggacttgtgaaacaatgctattttcctgtgcactatggactatggctttgcttttacattttatgcctccaatttttcacaatcctgtccgacgctcagatattggtgtggaagtagagctaactctctatctcagaaaaaaggttagagcaaggcagatcttttgcaataagaatcagttaccatcgatcgatttgaattcatattactagtactttgcaatacactgtgtaagaagatgtcataaagattgagaaacggtcatcaaacttaatgtaagcagagacacgaggattgatgatgaagtaagataatgtgcgacaaggaagaaaaaataatagcattatgtagagatatcgattcccttttgtgggcgctatgttctggaggagagtttctagtatattccttatccataatgttatatgtgatctttatcaacagtggaatcccaacaataatgcaattattcacccatttttcacaagcaagcaagcattatgagagaagaacgaatgtacagtcatttagatgataagattggaagtaggtcatgatagtcaggattatgtaaagacacttggtgtaaccctgtatcggctgatttataatatcgagaaagataatataagaagcgcctgagagtcagtggatcgattatcgaaaatagaatagagacgttcacggagacccactgaatgtttcgtattaaaggagggatgactactaaaccattttcaccgctactggtggccattttgtattcttccatttacaagaattgctcccgacttttgttccatcagtggacgatagaccattgtcaaacacagtaattctattttattcttgagatgagatgccgcaatatgacctgatatgaatcaccctaaatgtccgatctaaacaaataaaaggcgtgcgaaacagcctcacgacgagatatgaagtcgaaaacatcggcctaatttctgtgctttttagaagactactcagattttcaatatcaatacagtgagttagatctcaggttgagaagaaacactttgattttactagataggaaagaaaaatggactaattaatcaatcattttgtcatcgttgaaacttgataacgcacgctaaacgataacgactatgttggagggaaaacattaacgattactcttttaagtaattgcgaagtatatctgagactaaagaccctctgaattaattatatcaatcaacataaactataagaaactacagtgtgagctttagttacgagagtgtggatctgttcatttaatattttttatacgtaacgcagcatctaccgtaaaatcccatagattgcgggcacatggcgcagttggtagcgcgcttcccttgcaaggaagaggtcatcggttcgattccggttgcgtccatatttttaacatttcattttttttgggtttaaatttattttcaaacattattaattgatttctttaaaaacttatacaacgtatgctaatactttaaactaaaccttttagaactataataaaactatttcaagtaaagtctttttatctgatatcttgattcatttataataaaattaagtgactatagaatagtgcaagtggaagcgtttttcttctttttcttttgttgtgaagtagcgctaattcctgtcctgttgctagaaccagatttcggaacggcatgtgacggtttgtgcttttcattaaccggagtagattgtttaactttagcttgtccttgtgaagatttgttatataaaccttttgatgattgcttattgtttgattgtttcgtatcctgtttcgcagaactagggagcctggttgatggagactcgattttgctaaattgttgactttgatttcttgcgtctttaactgcaacactttccatttcattccgaatgatttgcctaactaaatcaacgaacacttcatccacattgctcctcaacaaagcgcttgtttcataaaagggaactctaccccatttactgcttacctctataccttcttccacacttattaccctttcattgattagatcagccttgttacctattagaaccattggaacgcgatcggaatctttgatcctaaggacctgttctcttagctccattaattcttccaaagattgccgatctgttactgaatataccaacaggaaccccattcctgactttatgtataattctctcattgcagtaaattgtgctatacccgctgtatctaaaatttccaggtcgaataccttgttatcgatctcgatggttttcctgtaagaatcttcgatcgttggatcatacgtatccaaataaactccctgtacaaactgcacggttaagcaggatttaccgacaccaccagcacccaatactactaatttatagtctctcattagtcctaatgtttcctagccaaatatttctaagcgatgatagaagccaaaatattagaacgttgtatgtaaatgttctatatcgttactaaataatagtattattgttcagtggagaggatgaaatttcaaaaacttcttggcgtagttaagaacgaacgcaatggttctttttttcgagatcgagctctactttacttttttctttttctgtccttctctcttttctttttaacctttttcgacgatatttcgcgtttgagaatgtcgaggatgaatgcgctttgacgcgaattagttgtgaggctgacgttgtgataaaaaggcgatgattcttgggaatatacagtctgtttccacttgctagataaaatgtatgatattccaaaaatgcctttctctattgaactgtatgactgagatacgcctgcttttaccttgtatattatgagtactattcgccttttcccataaagttgtttttttctaaaatttatgtgtatcgtaaatggtacaaaataataaaattcttatcttgaaaatactgtttaatacttttcatcattactaaataggttacgaaaagaggtctttgagaaatgggaaaggcctgtttgaataaagaagtcggcacttacgaatgtgagggggaaagagatacctactcattttttacctctctctcagatatacaggattcaagtagtaacgaggaacaatgcggtgtaggaagtatattgagtgaagatagtttcacgtttgaagggtccaacgtgagcatacggttattttccttggacttaaatgccttgaatgaaaatgagaatggatccaagaatcctgtgaaatttaccattccgccaaaaatagaacaaagaaaggaagcaagacaaagagagaaacgtttaaggagggtggcagtactacctgagaattcgagaaactaccttgttgaatcaagtatggattcaagtagggaatacagtcaaccattttttgactggaggcatgaaatggtagaacatggagaggagagtgtaaaaccgtgtggttgtcataaatcgagaaaagacaaatgcttcaaagaactggagatggagaatatagaaaagggcgatataaagaagagtctcttttacagagacataattgaatggtgcagagactatgaagtcaataaaactagggaagtctgtgttccgtctatacacgagttttacctacatggaaatggaagtgacaacctcttttgaagtatagccatgcatataaatatatgtgtgtgtaagaaaatattagaagttttcataatctagaaatgtcaggctttgggcctaatggcactataccaaactgattgatcttgttcctacttacttccatcctgatgtaaaagagcttaatatgattaaaatctgtagtaaatctaaactctgcgtaattccagtatagattaatcaaccacaaatgaaggtacgggaaaccatcccttatagttttcaaattgcatttgaagtgctgcacgtacacgacgtcaaatctaattattgatggatacaatctgatatccgcttcagttaacctctgtcctaaaacaaaatatttagccaagattttctgtttgttaccactgaattgctcctctaagcgcttataattttcttttagtacacattccatcttctgcaagttttcaaacagtgtttttacttcagtttcgtaaatctttccgttttctgctaatccgactttatagacaccaagattaatcttcggatgaacccatttgatgttcttatcaatctcgtctattaaatcatgcggaactagatcaatcacgttcgtttcttcgctttggataaattcatcaaacacgccactgttcaaaattcttatgatatcgccactctcattgttaacaattttccttgttttagaatcccacagaacaggcacagtgaactttgtaccggggtacttaggatcatttaagtagtacaactcgcttaaccttgatatattttccaccgggtcgaaagcgccatccacgaacaaccttgcagagtcattgttcacatcacctaactcctcagattcgtctaatttagctgaagcaatgccaccagtggcagtaaagaatctctctttatatttttccggccggtgtggagcaggtaagaaacgggcacccttggagtctaattgccagtgagataacacaagccctagaacaggttctaatttcttcaaagacctggcaagaatggctctatgagtgaatggacacccaagggccccgtaaatataataccttcctttttctggtttaaaaacagaatgtgtcttagaaattgttcccttgtaagatactgacatggcttactgtttatgattatttttacgagtattttcctctataagtggccatctctccaattggcaaagtcaagacttttgttatgtcaatatgtgctaccaaaaatcaagggtattttcccaccagagcttatcaatggcaactgtgagatatgaacagcagttagtaagggtgtgttctcatccgaccctctgattcatttggtggccattacattttccctcaatgacacattcccctatttcataactgattaaaatggtaatggcacgtgatagtagtggctcacaaaacaaaattttctttctcagcgctgacaaagcttcatttgcattctaaccttatcacaacaacttcaacttcacccaagtaaggataatcagctctgtcgtgactgataaatgctatatccggcatatgcagtccacacggcattaccgtttcactaatttattgccatcttcctccacagttttgcaccgaaaggaaaaaaagaaaccaacaccgaaaatttttttctcctaaaggttaaagtaaacgcaaggcacttcaccaggcttgtatatataaatgtcgtgatgcttctatgccaaagtaaaaggcaacacttgaagatttcgttgtaggccacttgctcaaaggacatctagataaatacgacgtaagaataaaaatgactaaatctgagcagcaagccgattcaagacataacgttatcgacttagttggtaacaccccattgatcgcactgaaaaaattgcctaaggctttgggtatcaaaccacaaatttatgctaagctggaactatacaatccaggtggttccatcaaagacagaattgccaagtctatggtggaagaagctgaagcttccggtagaattcatccttccagatctactctgatcgaacctacttctggtaacaccggtatcggtctagctttaatcggcgccatcaaaggttacagaactatcatcaccttgccggaaaaaatgtctaacgagaaagtttctgtcctaaaggctctgggtgctgaaatcatcagaactccaactgctgctgcctgggattctccagaatcacatattggtgttgctaagaagttggaaaaagagattcctggtgctgttatacttgaccaatataacaatatgatgaacccagaagctcattactttggtactggtcgcgaaatccaaagacagctagaagacttgaatttatttgataatctacgcgctgttgttgctggtgctggtactggtgggactattagcggtatttccaagtacttgaaagaacagaatgataagatccaaatcgttggtgctgacccattcggttcaattttagcccaacctgaaaacttgaataagactgatatcactgactacaaagttgagggtattggttatgattttgttcctcaggttttggacagaaaattaattgatgtttggtataagacagacgacaagccttctttcaaatacgccagacaattgatttctaacgaaggtgtcttggtgggtggttcttccggttctgccttcactgcggttgtgaaatactgtgaagaccaccctgaactgactgaagatgatgtcattgttgccatattcccagattccatcaggtcgtacctaaccaaattcgtcgatgacgaatggttgaaaaagaacaatttgtgggatgatgacgtgttggcccgttttgactcttcaaagctggaggcttcgacgacaaaatacgctgatgtgtttggtaacgctactgtaaaggatcttcacttgaaaccggttgtttccgttaaggaaaccgctaaggtcactgatgttatcaagatattaaaagacaatggctttgaccaattgcctgtgttgactgaagacggcaagttgtctggtttagttactctctctgagcttctaagaaaactatcaatcaataattcaaacaacgacaacactataaagggtaaatacttggacttcaagaaattaaacaatttcaatgatgtttcctcttacaacgaaaataaatccggtaagaagaagtttattaaattcgatgaaaactcaaagctatctgacttgaatcgtttctttgaaaaaaactcatctgccgttatcactgatggcttgaaaccaatccatatcgttactaagatggatttactgagctacttagcataaataagaacccacgcttcaaataaaagcaaacatagaagcaaaatccgtcattcctttcctattcaattgcaccgttctctttatataactacttaattaaatagcgcctatacgaagcagcattgttctattatttttacaaattccttatcatgcatgcatcacatcagtgtttgaatctgttaacttttcactttattgctcttacccgactctgaagaaaaacaaaaaaacagcgacatgttggaaaggtcgggcagtaaagcagaatttcagaaatactagtacgattgtttgaggtcttgcgaaaccgtgcattcataatagcacctttttcagtcgctcatccggtcgtcctatctgtaaacgtcactgtcaaacacgttgcattgattagattttattattttatatataggtatatttagaaaactcacaactggagaagacgaagaacgaagaacgaaggaaaaaaattgatgacagatcccagaagaagaacaggccgtcatttcttgacaccggagaatttatcctctacattacaaatcacaaacttacctccagaatggaaccaagatataattacttcggtcgtggccggttctggtccagttatagatataaaagctaagaatgacccgagaactggtaaactaaccggtgtactgttcgattatttgactagtaaagattgtaaacgcgcttgggaaattttaaatagaattgaaaactttcccgtaaagatagagcaaataatcccaccaaattataaggaccatcttagagaaacagcaaataaaaattctcaaaagcaggtattacaacttaatagagattcgtaccccttcgaggcgggtttggagctacctttcgaaatggtgacagaagtccccattcctaggcgaccaccgccaccacaggctgcaaataacacaaactctgtatcaaataacacaaacattcaattccccgacatactaagtaaagcatctaaacacttgccaagtttccaagatggctcgattattgcaccagacaaaatttcacaaaatttaagtaaaattccgccgttgcaacttattgaaattatatcaaatttgaaaatattatcaaaccaagaaaacatccaaaaatcgcaattagaatctttcttagatactaacagtgatatcacaatatcagtgacccaagccctactagaaatgggatttatagactacagcgtggtgactaaagtgttgaaatcccaagttggcgaggccccatctttgctttcgagtaataacacaagtaattcgaacacccccgtaagcgtaattagaaataacactccgttgcatgtaccttctaatgaagtcagcaacaatcctaacaatatgccactgaacgtagctatgccaatgcctatgtcgacaccaccatttatccctttacctctgcaacaacaaccgttcggttttgcgccaccgggccctttcatgcctccagctcaaggcccctccatgggacagcctgtgttggcaaatcaactcggccaggtccagcaacaaaatataagttctacagaaggaccctctaacgcgaataaagcgaatgacagcggcaccattaatatggcgaaactgcaattactacctgaaaaccaacaagatatgatcaaacaagttcttactttgacacctgcccagatccaaagtttaccaagtgaccagcaacttatggtggaaaactttagaaaagaatatataatctaagtaatcagagccatagcgtatcagaaaaccacacctaattagatggttcttgcatctgtacctcttatcactaaaagcggcactaaacttccaacattaaatgtttgccttgttaaatatatatttttgccttggtttaaattggtcaagacagtcaattgccacacttttctcatgccgcattcattattcgcgaagttttccacacaaaactgtgaaaatgaacggcgatgccagaaacggcaaaacctcaaatgttagataacgtggatctccgacacatgtgaatttataagtaggcatatgaaaatacagattctttccactgtgttcccttttattcccttctcatgtgaagagttcacaccaaatcttcaaaatataactaatatagtagagtttgattcaaaggacctttttttttgcctctttgattagtttatcttcttttcttcattttatcccctaattttatacgttagttcaacctaacaatccaggatttcattaacaagaaaggtaaaagtaacctatcaaggctattttgaaaaaaaaaattccgccctgaatatttcgagtgattttcttagtgacaaagctttttcttcatctgtagatgtccagttgtaaaaccactttgtctgaaatggttggttctgtgacaaaagataggggcactatcaacgtcgaagccagaacacgttcgagtaatgtaactttcaaaccacctgtaacccacgatatggtgcgttcgcttttcgatccaactttgaagaaatctctgctggaaaaatgcatcgcgctagctattatatcgaattttttcatttgttattgggtcttccaaaggtttggcttacagtttaccaaatacttttttctggtacagtatttattttggagaattgcttataatttaggtattggactggttctgcattaccagtcacattatgaaacactaacgaattgtgctaaaactcatgcgattttcagcaaaataccacagaataaagatgctaattcgaatttctcaacaaattccaattccttttcagaaaaattttggaattttattaggaagttctgtcaatatgagattaggtctaaaatgccaaaggagtatgatttatttgcctatccagaagagatcaacgtctggttgatatttcgccagtttgtcgatttaatcttgatgcaagattttgtgacttacattatttacgtttacctttctattccatatagctgggttcaaatcttcaactggagatctttgctaggtgttattttgattttatttaacatctgggtcaagttagatgcgcatcgcgtggttaaagattatgcttggtactggggtgatttcttctttttggaagaatctgaattgatttttgatggtgtcttcaacatctctccacatccaatgtattctattggttatttgggttattatggcctatcattgatttgtaatgactacaaggttcttctggtgtccgtatttggacattattctcaatttttgtttctgaaatacgtcgaaaatcctcatattgaaagaacgtatggtgatggcactgattccgattctcaaatgaatagcagaattgatgacttgatatcaaaagagaattacgattattcaagacctctaattaacatgggtctttcttttaacaacttcaataagctaagatttactgactatttcacaattggtaccgtagcggcacttatgttaggaacaatcatgaatgctaggtttatcaatttaaattacctctttattaccgtttttgtaacaaaactggtttcatggttatttatctcgacaatattgtacaagcaatctcagtctaaatggttcacgagattgtttttggagaatggttacacacaagtttattcctatgagcaatggcaatttatttacaattattatttggtattaacctacacacttatgataattcatacagggcttcaaatttggagtaatttttccaacataaacaacagtcaattaatttttggtttaattcttgtggctttacaaacatggtgtgataaggaaacgagactagcaatctctgattttggttggttttatggtgattttttcttgagcaactatatctcaactagaaagctgacttcccaaggtatctacagatatttgaatcacccagaagcggtattaggcgttgttggagtttggggtactgtattgatgacgaattttgccgttacaaatattatcttggctgttttatggacattgacaaattttattcttgtcaagtttattgaaacacctcatgttaataagatatatggtaaaactaaacgagttagtggtgttggaaaaactttactaggcttgaaacctctaagacaagtttcagatattgtcaatagaattgaaaatattataatcaaatcattagttgatgaaagcaagaactccaatggtggggcagaacttttgcccaaaaattatcaagataacaaagaatggaatattttaattcaggaagcaatggatagcgttgcaacaagattgagtccatactgtgaattgaaaattgaaaacgagcaggtagaaaccaattttgtcttgcctactccagtaactttgaattggaaaatgcccattgaactttataacggagatgattggattggtttgtataaagtcattgatacaagggcagatcgtgaaaaaacaagagttggatcaggtggtcattggagtgcgacttctaaagattcatatatgaaccatggattaagacataaagaatctgtaacagaaataaaggcgactgaaaagtacgttcaaggtaaagtgacattcgacacgtctttgctttattttgaaaatggtatctacgaatttaggtatcattctggtaactcccataaggtgttattgatttctacaccatttgaaatttcattgccggtactaaataccacgacacctgaactgtttgagaaggatttgactgagtttttgacgaaagtcaacgttttgaaggatggtaaatttcgtccattaggaaataagttcttcgggatggacagcttgaaacaattgattaagaactcaattggcgtcgaactttcgtctgagtatatgaggagagtcaatggtgacgctcacgttatttcgcatcgcgcttgggatataaaacaaacgcttgatagtcttgcttgagttttttttttttgagtatatatatttaaaaagtactaggattcaagttaacattttgaatagaagtagttatgttgttgtaatataatggagctaccatatatgcagaatgacattataaattatgatgttgatgtacaatgcctttgtgcgcttcttttaccatgaattttttcttaacctctttcacttttctttccgactaggataatctcgtgtctaagtttcctggttcattaaacagcttatcattaaatctctataacggttatattgctccttgcaacgatcaaggcattccaaaagatcttcatcgtcaccatcatccttccaaaaacctacaatttcctctccatttttgatgaatgatacgacagtgccattggcctcaccggcacctgccatatccactaattcgatgccggcatcagctaaggctagcgttatactagtgatacaatgtggtatgagagatgatatttgagaagacatcattttgctttgcgaatcgtcgtcctgaggattatttgtaagatccttatcatacgttaaataaacgaagatatcgatgccggacttggggtagcgagataggtttactactgaattgaaaatgcccattaaaaagctgctaacttccttcagttcatttgtgttatatttttccagaagaccgttctttaactgaatagatatagtaccttgagatgtgaaggatcctctaatggagcgtggtccatagacagcggtaatgagcgatgtttggtgtcctaagcttctagcttctactaatgcagatccattgcagttttcgatgaaaccggtatgtagagaaagttcctgttcactttcattgcctttaggtgtcaaatctgttgatttcttttctggcacatgagtagtagtgttgctaaacgccattggcttggcagcagcagggcctaataacctccttctgtcttgaacattcatttattctgataacaccttaatgtgagtatgttcctacttttaagtggagtatgtgctaatccttaaaggaagttttcgtggctcaatcaagcacaacgcccaagcttttatttagatattcatttcatattactgaaattttttgagtattttccaaggccttgtaatcttccgtatctagcgatctcatctcatcgtgaaaaaaaaaagagtaagccattcgaagaaaagttggcaaatagagatggtgaatgaaaggtttaagaatgtatcctatttacttactaatgtacacaaaatattatagaccaaatttttcctcaaaaatggaatatagtaattaacgtaaaaagagaaaaaattgaaattgaaattcatttcattttctcattaatcaaatgttttctttgaaccagcgaaagaagcggtatttcttgatctgcccaatggagcagtattagcaccagaaccagatggtctgaaaccgccacggccaccgcgagcgccaccacgaccaccgaatccacggttaccgccacgaccaccgccacgaccaccaaaaccacggctaccgccacgaccaccatcgttgtttggtcttggagaagagaagtctaatctaactggtctgttgtcaatgtattcaccttgtaaagcgtctagagccttcttggcgtcctccatgttggagaattgaacataaccgaaaccttttggttgttcagtttctggatgtgttgggatacggacggaaacaacttcaccgtgtttagcgaataattcgaaaatagcgtctctgtcagcattgaaagataagttacccaagaacaaagtgtcagatggttcagatggggtatcaccgaatttcttggcacgatcgttgttaccagctggcttgcttgtggacatatcacagttgattggtctaccatcaatttccttaccttgcatttcttgaatggccttttcagcataagatttgttttcaaaatcaacgtaaccataaccacgagatctatcggtacctctttcataaataactctggcaccaatgacaccaccgatgtgttcgaattccttcttcaaccattcgtcatcaatagaccacgatagtctaccaacgaaaatagtagctggttcttcggtttcttcatttttttgcttcttgttggaagactcttcgtcttcttcttcttcggcgtcctcagatttacgtttcttatcgttagactcttccttttcgctttcgctatcagaagatgaagatgaggatgaatcagagctagaagattcttttgattcttccttcttggtttcttctttttcttcttcttcttcttcgtcggaagaagagtcagaggaagaggaagaggaatccttggattcttccttcttggtttcagcttcactttcgctgtcagaagacgatgaagaagaggattcagaatcagaggatgaagatgaagatgaagattcagattcagactcagactcagattcagattcagatgaagatgaagatgaggatgaagattcggaggaagaggaagagacggccttagctttttcttctttggcttgtttggaagccttaacttccttcttgttaccttttactttagtagtcttagccatcttattttatcctgcctgggttgagtgatccgaaattggttaacagttcgtctttgggaagcaaaagtaagaaaaatactacgaaaggaaataacttaaggtaccaatggattgggaagtgcagacagcaacagctacacttaagtacttttaatattggattgaaaattttcgttcttgcgatgagctgcccttgcaaatttttcaccaaaaaaaaaaaaaaaaaaagaaatggagtgaaaaaagaaacgaaaaaaaagggcatggggacccatacatcaggcacttacccccaggaaggattacgtctttaaatcagaggatcaaagggtaattaacaaccaccagtcgaattgctgtcgtctttcttcaattgctttatccaaaaatctgaatggatgtaagtattgcccagtaagttttcttggcaaaataacctatagcgaaatagacaatcaacgtgatggggtttaaatagctagcggtaagtaaccactagtagaacgtagctccatagcgtgtaatttggcggcaaaatatgtgaagcaagcatattcgttattacttagctgcctgtgaaatcctgtctgtgccttctctttgcctttactttgtataaaaacatatcaacactgtctctgcgtatgaggccgaggtatttagagcataagaaaaaatgtgaacaaaaatagtgtcatctccagtaaggcttaaatgtatattgattttctatatatatatatatatatatatatatttatgaaataaaccatataattataagtagtagcttggaaaaacgccaaagttgtacttagaatgaggttttaaaaaaaaattataaaaaaaaaccaagcgagaagtcacgcttataacgcaagtgcacgaactgcatatgtgttggattgccaaagatcaataggaagaatatatttagagaaactctgttttcttatgtatctcgcttacagcctatttcaatgaaccagtttggaatctctttgccatgagatcagcctttaaagagtttgagccatcgagactgtaattggaagaacgccttctcctgtcatgaagaagagcaccggattcggttaaatcgctagacgaaatgccgcttagagaacgtggaagaagagtgtgatgtggaagatcggcggagggaaggtttctgtttgttgttggtgctgagtggattttagtctcaatggggaaaatcgtgtctgagatgcttgttccgttagatatggaagcgttccggcttgaccttctggcggaatgggaaatgtgggtcatggagtccttgggtgttaagggaagtacggtgtgtctggatgcaccatctgtgagctttagctttggagtgtcgagggtgtaaccataattgcagtcatcatcatctaggatggcagactcgccttcgaaaaatggagacgaccttctagccgggaccggatggtgcagttgattttttaacctagagttttcttcttttaaagtttcaatttcccgtagaagtcttactacaatagcgtcttgctccttttccatttcgtttattatttcttccctcgaaagccttctctgtgctgacattggtgacgaagaaggagacgacgacgtcgaaagtctgcgaggatcacgtgctacagctggtctcatggctcttgtaactgaagtttgtctctctctgcatggtttggcaacagccttcttgtgttttgattctttattcatgtttacggctctggaggtagcgatcattatactttatcttctattaatgctatgattgatgaattatacgtatgtatgtatctgtaagaaaatagccgaatgattgattatcttttcttatatatgattcaagggaacgaaaagaagacaagataatgttaggcaagatagttttttagacgactgaggccgaagataagctttatatatatgcaagtctatttttgtacgggcgaaaccatctaagccaacgataacaatagccagctatgatcgttgagtacagcgtggggcaatttttagcgtgattgataagggcgcattatctcatcatccatcgccaatttgggactctaacggcaaacctcggatttccgtggaaacgcatggaaaaattgatccgggctgtgaggggagtcgagtcagtcactttttggcaactctctccgtcatgaccactactccgcggtagctgccaaatttggtatttccaggttgttttttgtggacagcccgcgatcatatgtaagagcaggatgtgtcatccgcgggtgaggtaaacgctggcttgccattatggttttttggtacgtgttgaacacgttgcttacgatcttggtaggggcgggctgtgatgtgagagccacaaacccgcttcctcgttgtggctctggcgctccgtttcttctttcccccgccttgtaatatgtcgtgcatgcgtccatgatgatatcgtatttattgtatattgtggtgatttcggcatattttagcacatctgtagtataccacagagctaaaacaaccgattatagtcaacattatacagcattatgtctggatacttcaaccatctttcttcgaatgcacatttcgcaaatattcaagccgatcagggcttcataggtgatgctactggcacaagcagcgatcatggcagtagtggcatggttgattttgccctacaactcggagaactgagcctagaagagaaaatacttaaagagttcaccttattccagagcaagaacatggacttattgcaagagacggcgacggcgtgtccgagtactaatccttccttgagacagagccgaattcaaggctggtgaacgcctgatgcgagctatacgttttgtgctcaccgtgcacatatggtggctacttttctactcaaacacgtttgaaaaacggcatacgattagcttacagattgaactcaaagaagtcgcaatgggaggtgcagaagatgacgtgttacttagtttataatacaatgtgttttatatatcgattcttcgtttatgcatttctggacgattgcttttcactgtaaatacgcactaatattcatgaatataaaaaaatgtaacatcatatctcaatgttcttctccgtcagtcagatagtggcaaggctgtgataggacattcttagaacgccaagaaaatcaaaaatttgaacggtatctaaattcatttgtcgaacccttgaagaaactcacagagcggggtatctactattttgttttcgttcttttgaatctccgctacgtcacattttctacaaccctcaggtcccctcaccacgaaaatccaagatttgtaaaatatgagccgcgtatttctgcaatggtagaaacgataatgtacctatcgtacaacgatacattattttagtgcattataagccgcttgattcatgttgataattagcggctaaattgtagtagtcattcaaaataatcgtacaccttcatatagttatgaaaggggtataaaagatgaacgctcgttggccatgtcaaaggtgccttaaaaataacaatgcttgcggtagtacgtgtgcaaagtgtatattcgcatgagaggtgatcggaaattgctttatcgccccactaattctgattcttattcaaatatttatgtcacgtagcgagcttacttatccatatatcaaaggaaatccagatataaactcaaactaattcttctgtttccacgtaactagcattcacattgtagttttctagattacagcaatttatatatattgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttatcaaaaatggaatcccaacaattacatcaaaatccacattctctacatggtagcgcctatgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccgtctatgatgacgtgttcacattatcaaacgtcacctgcgtattatcaaccggacccacactatccgttgccacagtatatcccaccactgagtacttcctcacctgatccaatcgattcacagaatcaacactctgaagtacctcaagctgagacaaaggtgagaaataacgtcttaccaccacacactttaacatcagaagaaaacttttctacatgggttaaattttacatcagatttttgaagaactctaatctcggtgacatcattccaaatgaccagggtgaaatcaaaagtcaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacagtcagtacgatcattcagaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcagttaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaatcaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaggaatcggatattgaatggtctaacgctagcacatatcaatgtcctgactgtctaatcggcaaaagcacgaaacatagacatgtcaaaggatcacgactaaagtaccaagaatcatatgagccttttcagtacttgcacaccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaagcaatccaaattggaccaattcaattatgatacactcacctttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgacttctcgtcccaatcaataaaccctttacaattagacaaggaaccagtccaaaaagtacgtgcaccaaaagaagttgatgccgacatatctgaatacaatattcttccatctactatacgatctcgtacaccccatatcattaataaagagagtaccgaaatgggtggtaccgttgaatcagatactacttcacctagacactcgtctaccttcactgcacgaaaccaaaaccgacctggtagtaccaatgagatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaacccataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcactgtcaatcgcattagacaacgactattatatcacacagctggacatatcctctgcttacttatatgctgatatcaaagaagaattatacataagacctccaccacatttaggtttgaatgataaattactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacataaaaatctgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctctcagtctcattgctttagtaccaaaaaatctgtttctaaatttctcttcattattggatataattatactgattgtagatttactgtcggttagtaatcctttggtaattggtttcttgtcgagttcttgtatcaggtaacttagattatttaataatgggacagattcacttattgcgtgtatttctgcttccgtagttgaagtacatgttaatgaagccttggtggactttcctccaattacttttccattaagtaaatatatgttgccaatttgtgatttataatacggttggttaccatacgaggcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtttatatagagacctggttggcctggggcaccaagttttcttccgtttggattcaaaggtacgtttaatttgggtattttctcagttaatgagttttccatacctaatttcatgtatttacctctttgatatttgatttctaagccaaggatgtcgtattgaatttcatcatcgctttcacctagatttataatcttggtatcgtattgcatcttgagttttgctataattcttttattcgaatttaagtccttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgctgaatatcacctcttgcaacaaatctagctttatgagtaccgtcacgtttcctgttgaagataaacattgaatttattactcttttagggtctatttcttttctgtcataatatttgtcagtgtcccaagtattcattttcaatagttggttgacttctttgtggtatgcttcgatatatttttccttttctttaatatctttattataggtgattgcctcatcgtatcttaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaattgatcggtggaagttctttaaaggagtctgataattcggtaggaggttctggaggcagatcgggaagtggaagatcagcaattatagattcctctgtattctccttaggacaggtatctgacgttttgataggaacgacgtggtgtagtgaattactttctgatgaggaagtatcgatcgaaggtgaacggtgtataatccttttctcagtctcctgttcgcttgtctgcggaacagttttattattggtaccacccgtactggatattggtacgtttgtatgattagtctcattgtcactgtacgagtctgagtgtctgaaatctttagatttactggcgtacgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttcagccgttcagcgactccatgtgctcgggaatccgctgtggttgtatagcatggagttataccatttttttcaaggaatttatggagagttctgttagtatactcagaaccacggtccatttgtataactaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatatttcacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacttcgatgacagcttctcataacttatgtcatcatcttaacaccgtatatgataatatattgataatataactattagttgatagacgatagtggatttttattccaacaaaatccacattctcttcatatatacatatattggttgttgttactactttagcttttttcctctgttcgtttcaagatctagcttgcaattatccctctaggtaataaccagcatagttgtcgtcgtttcatgtgacctattcccctttaattggatcaatcttccaataagagtggtttcgtggtctagtcggttatggcatctgcttaacacgcagaacgtccccagttcgatcctgggcgaaatcattttttgaagattacattaataaggcttttttcaatatctctggaacaacagtttttttttacttactaatagctttaaggaccctcttggacatcatgatggcagacttccatcgtaatgggatgatcatatgatgggcgctatcctcatcgcgactcgataacgacgtgagaaacgattttttttttctttttcaccgtatttttgtgcgtcctttttcaattatagctttttttttattttttttttttctcgtactgtttcactgacaaaagtttttttttcaagaaaaattttcgatgccgcgttctctgtgtgcaacggatggatggtagatggaatttcaatatgttgcttgaaattttaccaatcttgatattgtgataatttacttaattatgattcttcctcttcccttcaatttcttaaagcttcttactttactccttcttgctcataaataagcaaggtaagaggacaactgtaattacctattacaataatgacagacgaaactgctcacccgacacaatctgcttcaaagcaggaatctgctgctctgaaacagacaggcgatgaccagcaggaatctcagcaacaacgtggctacaccaactacaacaatggtagcaactatacccaaaagaagccttacaacagcaacagacctcatcagcaaagaggtggtaaatttggaccaaacagatataacaaccgtggcaactataatggtggcggtagtttcagaggtggacacatgggagccaacagctcaaacgtgccatggactggttactataataactaccccgtttactaccagccccagcaaatggcggccgctggtagtgcccctgctaatccaattcctgtcgaagagaagtcacctgttccaactaagatagaaatcactaccaagtctggtgaacacttagatttgaaagaacagcataaagccaagctacagtctcaggaaagatctactgtgtctccgcaaccagagtcaaagttaaaagaaacttctgattctacttctacttctactccaactcctaccccttccactaatgactctaaggccagttctgaagaaaatatatctgaagctgaaaagacaagaagaaatttcatcgagcaagttaaacttcgtaaagctgctttagaaaagaagagaaaggagcaacttgaaggttctagtggcaacaataatattccaatgaagactaccccagaaaatgtggaagagaagggatcggacaaacctgaggtaaccgaaaaaaccaagcctgctgaagaaaaatctgctgagccagaagttaagcaagaaactccagctgaagaaggtgaacaaggagaaaagggccaaataaaggaagaatccactccaaaggtgttaacctttgctgaacgtttgaagttgaagaaacaacaaaaagaacgagaagaaaaaacggaggggaaggaaaacaaggaagtgccagtacaggaagagactaagagcgccatcgagtctgctcctgtgcctcccagtgaacaggttaaagaagaaactgaggtcgccgaaaccgaacagtcaaacattgatgaatctgcaacaactccggctatccctactaaatctgatgaagctgaagctgaagttgaggctgaagcaggtgatgctggaacaaagattggacttgaagctgaaatcgaaactacaactgatgaaactgatgatggtacaaacaccgtttctcacatattgaatgtattgaaagatgctacaccaattgaagatgtcttttcttttaactatccagaaggtattgaaggtcctgatatcaaatacaagaaagaacacgtcaaatatacatatggcccaactttcttgcttcaatttaaggacaaactaaacgtcaaagcggacgccgaatgggtccaaagcactgcttctaaaattgtcattccaccaggaatgggcagaggaaatagatctagagattctggcagattcggcaataattctagtcgtggccatgactttagaaatacctcagtgagaaatatggatgacagagctaattcaagaacttcatcaaagagaagatcaaagagaatgaatgacgacaggagatctaatagatcttatacatcaagaagagaccgcgagagaggctcctacagaaatgaagagaaaagagaggacgataaaccaaaggaagaagttgctccacttgttccaagtgctaataggtgggtgccaaaattcaagtctaaaaagactgaaaagaagctagcccctgacggaaagaccgaactattggacaaggatgaagttgaaagaaagatgaagtcactactgaataaacttactttggaaatgttcgatgctatttcatctgaaattttggctattgcaaacatatcagtatgggaaacaaatggtgaaacgttaaaggctgtgatagaacagattttcttaaaggcctgtgacgaaccccattggtcttctatgtacgcgcaattatgtggtaaagtagttaaagaattaaacccagatataacagatgaaactaatgaaggtaagacaggtccaaaattggttttgcattacttggttgctagatgtcatgccgaatttgacaagggttggaccgataaattacccacaaacgaagatggtactccattagaacctgagatgatgtcagaagagtactatgcagctgcttctgctaagagaagaggtttaggtttggttcgtttcatcggtttcctataccgtctgaatctgttgactggaaagatgatgttcgaatgtttccgtagactaatgaaggatttgacggattctccatctgaagaaactctagagtccgttgttgaattgttaaatactgttggtgaacaatttgagaccgatagtttcagaacgggtcaagcaacattggagggttcgcaattgctcgatagtttgttcggtattttagacaatattattcaaactgctaagatttctagtagaatcaagttcaagttgatcgacattaaagaattaaggcacgacaagaactggaacagtgataagaaggacaacggtcctaagaccattcaacagattcatgaggaagaggagagacaacgtcaattgaagaataattcaagatctaattcaagacgtacgaacaactccagtaatagacactctttcagaagggacgctcctcctgcatcaaaagatagctttatcacaaccagaacatattctcaaagaaatagccaaagggctcctcctccaaaggaagaaccagctgcaccaacttctaccgcaacaaatatgttcagtgcattaatgggagaaagtgatgacgaagagtaacatgaatagatcatgttaagtatcgaaaatgtcacttggatacaaggatgttggtagaaagtctaataaaataataaattaatagtacaacacaaatttaatcttacgtttaatcctgcgctattaattgaaaatatatgcatggagaagaaaaaaaaagtgtccctaatttaccattgttatattttctcgattaatgggctcatttcttttcactaaaagctataaacaagtttgatgcattttaatgggtaatcctcttactgtgcttttttttcctatcttgttctatatgtcaatgcctttctgtatttttatttatagcttcgccagtcttcgtttacgatatgttttatataatagaccactcagcatatgtatagttttgtatatttatatcatttattagctgacggctttaacttcatatttcgatttaatcatgctactgcttcaccatttgtccttttttttacagaggccacgaaaggaaaggaccgtttccggacaacagaaataataaagatatcagagcttaaactagtaaattggtaggaaaaaaactcccaatagaaccgattaacatccacagattaacaaaactccaggacaacggtactaatacacatacaacatgagtttagaggctacagattccaaggccatggttttgttgatgggcgtaagaagatgtggaaaatcatccatttgtaaagttgtttttcataatatgcagcctttagatacattatatctagaatcaacctcaaatccttctcttgagcatttctctactctcattgacctggcggtgatggagcttcccgggcagctaaattactttgaaccgagttatgattctgaaagattattcaaaagcgttggggcactagtttatgtcattgattctcaagatgaatatatcaatgcgatcacaaatctggcgatgattattgagtatgcctataaggttaatccctccatcaatatagaggtcttgattcacaaggttgatggcctaagtgaagatttcaaagttgatgctcaacgtgatataatgcaacggacaggtgaagagttgcttgaactggggctggatggtgttcaggtttccttctatttaacttcaatttttgatcactcaatatatgaggcattttcgaggattgtgcagaaactgataccggagctgtcttttctggagaatatgctagataatttaattcaacattcaaaaattgagaaggccttcttatttgatgttaattccaaaatttatgtttccacagattctaaccctgttgatatacaaatgtatgaggtatgctccgagttcatagatgtgacgattgatttgtttgatttatataaagcgcctgttctaagaaatagccaaaagagctcggacaaagataatgtgataaatcctcgtaatgagctacagaatgtatcacaattagctaatggcgtcattatttatttgaggcagatgattagaggcttggcattggtggcgattataagacctaatggtacagacatggaaagctgcttaacggtcgcagattacaatattgacattttcaagaaggggttggaagatatttgggcaaacgcaagagccagtcaagctaaaaatagtattgaggacgatgtgtgaaagacgtaaggcatgaaaatattagggtatatagatacatattgaaaatgatagtagagccaatgaccaaaccaagaaagcctacagtacagaggtgccaaagtttttttactaatggggcaaatcatttttattgcaaaaaaagcactcacgatgggggtcgaacccataatcttctgattagaagtcagacgcgttgccattacgccacgcgagctactgtttgttggaagttttcaattattaataagtacataccaaccttagctaacattactataacgacgctgagaaagctatacaaaagatttatcgatcgagaatcattgtttcttatttttttcaggaaggatgaacacattgttcagaatattatcaattaataatttatcgtacggacggtacaacagcaaaataaaatagaagccgaataaaaaaaaatgaaaaggaattctttgaaaagaaagtacatggcaaaaactgtaaagttacaaaaaagaggaaagccactccatacttttagtaatattcgattgtgatgagttacggcttaacaggtacctcttctaagctaagaggaactagttcaatattttcatggactcaggtgaggcacttttctcgtagaagaatagcctatccattttatccattcaagaaattgggaagacaacacccgaagaagcatgatacaaacttaaagactgctatgagacagtttttaggtccaaaaaattacaaaggagaatatgtcatgaacaagtattttacggttccgacgaatcatgtacctaactacattaagccagatttggaaaggggacaaagtttagaacacccggtaaccaagaagccattgcaactaaggtatgatgggacattaggtcctcctcctgtagaaaataaaaggttacaaaacattttcaaggatagattgttgcaacctttcccttcaaatccacattgtaagacgaattacgtattaagcccgcaattgaagcaaagcattttcgaagagattactgtggaaggactttctgcccaacaagtttctcaaaagtatggattaaaaattcctcgtgtagaggctattgttaaactggttagcgtggaaaacagctggaacagacggaatagagtatcttctgatttgaaaactatggacgagactttatatagaatgtttcccgtcttcgactcagatgcctcttttaaacgggagaatttaagcgaaattcctgttccgcaaaagactttggcgtcaagattcctcaccattgcagagtcagaaccttttgggcctgttgatgcagcccatgttttagaattagagcctgctgtagagaccttaaggaatttgtctactgtgggggaacattctagtggccatcaacaatccactaataagaatacgaaggttatatatggtgagcttgtcgaaggtgaaagatcacaatataaatttactaacgcaaaggttggaaaagtgggataccgttacggtagcggaaatagggataacaagaaagacagaagaattggctttaataaactgggccaaatggtatatatataaccactttttgtcttatgagtgctttcttgtatatgcgtatatgtcgtcatattttcagccattattacttgtacataaaatattctacataaatttatatatcccatgaaagagccatggtcacgttgggcacatttcttgaatactcgtttgcaaggcttatttttctgtcttttcacatctttctattttagtgcgagaaatgcaggacctatgaaaaattggtaacaaaaataattaaaagtaaatgctataaaattgtgggtaaataaaagtggaacaagagctgagttcacaactctacactctatatggacaatattcgaattaagcgcaattgataaatcacaactcattgaccatggaatgttttgtaccgctgcgttgcgacttagatggaagtaatatagaacagttacgtcaatcacacttaagccgtaaatttattatatttgatgagcaactgaatctttggctgtggtttcaaggtaattcgcaagagaacaagagatttgtactacagaatatgataatattaataaatgaagcgcaagttaccagaacaagcactatcgatgattattttacccaagttgagaacaatgaaaatctatggaggttgaaaaacgactgctgttcgaagattcttttcaaatcaaatgttgttatgaataatggttataataatcagatcaaatttgtctttgaatataaatctgtggatgcaaatttcaataaccaggattcattacaagatccacaggcaaagtatacattagataagtactctagcgaggagattttgccaagttttgagccagtttattcctggtcttctgcagccaccaaatcatccaaaaatactaataatcatctggagaaaaataacagggcgactcatcgagttagttctaaaaatagcgaagtccacgaagcggacgtttctagaaatccgaatacatttactcttaagctccaatacccaatattctcacttttgaatatgagattgagaaacatctccttgaaatctgagcattgcatattatcatcgttagactttcaaacttctaaagcatccgaacaactgaccaaaaaatttatttatccgcaagaacacaattcttttctcaaactgaactttcaagaaatatcgtataaactaatcgacggaacctctcaaattgaactagatccaatctgtcctttgaaagtgccactcactgcattttcatacgatagcattagcgctacttttaaactggttctgttacccaaatcaactcaaccacatcgtgtgaaaatcaccttagcgtacgaactcgagctgcatcccaatctgaagttacctgtgagaacatcatgggaaacagaagtcacattgaagcgttctatgccaatttcctcgacatcttctcaatactcgagtaacaacaataataccaatcatagcgcttcttttaatggtgcggccaacaacgttaattctggtggtttggccaatctaagattaggtggggtttcctcctcaagatttagtcttggagctgcttcgactacatcattggtgaatagcaaattaagcaatgtaaaattcaagtttattaatagcaatataaaagttattaagggcgaaaagtttactatgaggcttcagatcattaactcgtcatcatcccccctggatcttgttgtgtattataacaatacaataaacccaatcccttcagctaataacgtacgtaacagcaatggtataaacaactgtggcatgaataatgggactatccccaattcgcccttgacactggaaaatcagtaccaactgcataataaatatagaaaaattgcggaggggattatactattatccaacgattacaaaattccagttgtacctccgagagaaacatacttcgcggatttacgatttattggtattatgtccggatattatggcactctctccggacttaaggtattggatttaaatacaaatgaacttatagaagttggaaatggcgcatctgtgttaatccagtaagcggaacaagtatacattttattaacatagactacatactaatctgtaacatttctataaaaaagttattatcatcacattacacgatagaaacacttccatatttttttacactgaaaggggcacctagaagattaaacaactaaactgaaaatatacgtgctagaaaaagggttttacagctttacttaggcgttgcgagtcacccaaaagagcagttgaaggacgccgccgtttcactagatacatatatatataatgtcagagaaattccctcctttggaagatcaaaacattgatttcacacccaacgacaaaaaagatgacgacaccgattttttaaaaagagaagcagagatacttggagacgagttcaagactgaacaggatgacatattggaaacggaggcttcccccgccaaagatgatgacgaaattagggattttgaagagcaatttccagatatcaactccgcaaatggcgcagtctcgagcgatcaaaatggtagtgctactgtatctagtggtaatgacaatggcgaggcagatgatgatttttccacattcgaaggtgccaatcagagtacagaatccgttaaagaggatcgttctgaagttgtagaccaatggaaacaacgtcgtgctgtagagattcacgaaaaggatttaaaggacgaggagttaaaaaaggaattgcaggatgaagctatcaaacatattgacgatttttacgattcttacaataaaaagaaggaacaacaattggaagatgctgctaaggaagctgaggctttcttaaagaaaagagatgaattttttggtcaagacaatacgacctgggatcgtgcacttcaattaattaaccaagatgatgccgatatcattgggggtagagacaggtctaagcttaaagaaattcttttgagattgaaaggtaacgcgaaggctcccggtgcttaaatgatgatgaataataagaaccataatgaactaaggaagagaaggggcttattccctatcattcccgtcatacatgagtatcatacttgataggttcagtaaataactaattcatactgtaaattcatttatcaagacaactataatatagattatttacaaacttgtaaactcttctcttctaaaaaaacacatcacataatactaagctgaaacaaaaagaatagtatatatttcccaaagttgcaatgccaatactttttcaagtaaacattaaccaaggacttcgcaaagaattttgcgaaaaatgggctgattttcattttacttgttggatccacgaaggtgaatgtaagaagcatcacgatgcaccgcaatttgttgcccattaatctgcgccttttcgtgacgaataaatattcgatacactgccttaatatagtccattttagacttggaaaaaaacccttggtgaaatatgaatttattatcttttcgtttatatttgcataattatcatcaattgtaacttcatgtatttcatttagtctgtccattacatgcttcaaatttgatgaagatatgggccaatcattatggttcttgaccccaaggtattgagaaaagttcctgacttcgtggccgccgacattcttatttgatttcgtccctgaagtaaaaaagaattttaatgttctgtgatatactgccaaaactgtgaaaatggcattgattgtgaagaaatctattaaaaatggcctatggtcaaaaagcacacggaatggtaacgaactcctgtccagtttggcaaataatacaataatcgctaaacacacaagaatttgctggaattttattaatgtaccctgggaaaaatttttttttttcaaccattgtgttaattttgcgatctttaatttggaggctatagcttccacaagaaagtgtgcgataatccacgaaggtacctcacccttggtaagcattaacgatattcctacaatggaagaccagtgaatataatgattttttaaaaatgggaacttcatcaaagttggatatagtatgttcagcaagactaatatagtagactctcttagccatggcatgatatcatttatttgaatattttcaccctgtaattttttcaatttccattttttgacataaaatactaggtttattccatagacttgggttattcttttcaagatgatgacgagttgttttcttctcttcttgttcaagaggagtagaagccttcttattatctgcttgaagccagaaactgctttcccagtaccatttggacgattgtgtttcatatagttagcaagtgtatactctcattagctctgttcgcgatgtgtatttcgtggtgctttatatagggtttttaacttttccccatgaacattcgctgttatgtattcgcaactaaaaataatgtctctctttaattttaatttacatccaaagtacggaaatggtaactaaactatatacaaaaaaagttcgctcaaaaaaaagtttaactattgtccaattgtgcccattttggtaaatctgttttgaacttgaatttgccattaatctcctcatacttccaagcatgcaaccataattctaggtctgatagcacaggatcctttaaatcaacagtatgacattcaggacaaaatgtttccattgtccgacaattattttttgtctcatcgacaaatttttgaaacctcactttcaattcctcagcatctaaatcctgctgattctcccatctaggaaactgagttataaacttaagcctttcggggtattttgtaatatgcgaacaataaacactatcgttgacgatgggatgaccgagcctagctaaatggattcgaatttggtgtgttcttccagttattggcttacaagcgacgacagtttcatcagcatgagagaagtatcttattgggtagaacttggtaatagcatccttcgatgtcgataaaccaactggaaactgtctctttggatcgatagaatatatgggtgtcatttccactgtaactttggaagtgtcctcaaaagtcgtttccgccgcattttcattgtccaatatcaattcggagtgaggaaatcttcccttgacccttgccaagtagatcttaatcatatctcttgaacgaatactcttctggatttcccccgcactctgactgttcttggccaatatcaacaagcctgatgtgatcttgtctaaccgataacaaggaagagcatctacaccatgtaacttcagtaattcagtaattgtgttctggtaaaactgaccggttggatgcactggtataccactgggtttatcaatgacgaggatactctcatcttcaaaaacaatattgaatcccgctattctgccaggtaaatcctccgcttcaacttcctggctacaccattgttttaccggcggttcgtgcttatgcgtagttgtttctaaaacatcatgattcttgattatggtagtcatgagatgatctggtaccagcggcacaccatctcggatcaacctatatgtgcctttccttatttggtccaaataataagctcttgggcgaagtttaaattcactaacgagaacgtctattagtaacttacccaaccagcgccccttcacgaacgctgatcttctgttataatagggccgtacctttctcagtccattctgtgtatatacctcaataactttgatagttgacatacttgacaatcatccttttgcccactgattgtctcgagcaatcgtcaataaagttttcacaagaaacatttatttgccttttaatgaaagaaaaaaagtaaatttttcattaacttttatcattgttatcaatcttcttgtatgacagcaagctatatatacatacatatgcaaatctaatgtacataatttcaactattcataccattagtaccataaagtcattctttttactgtaaactacacttgcattatccttcctcgtccctctttattcttataacgttgaacagtgatttcttaccatgtgtatttttgtactcaacccgcaaaagataagcatcctcatacagaagtattattattaccactgttacttttattgtcgttatttgtcttgcgtttttatgtttatggagataaagtgggaatgactttatcatatgcaattattagccgctataaggctaagattcttcaaatttatttcatttttcttttacccttgccacccttgcccagttgctcctcctctgcggttagcaacgcatcgcgctcctttttagctcttgctttttcttgtcttttttgctcttcctctaattttttggcattctctttcctcgaaccttgttcccatttagaagcttcctccgcttctagctgctccatttgtgctctttgtttagcatgtgcctgatctctttttcttgctaagccagctgctttctttgcggcggattctgaaaatcttttacccatctttttacttcctctttgctattctattatttcctgtataggcaggttttgtgctcaattgataaattcttttacctattaaatataaacttgagtttcaacttattcagctttattttaaacattatacaagtttttcattttgaggggtctttaactggaaaaaaaaagctttcacgactcaaagaaaaaaaaaaaaatttttttagggtaaaaaaaaactaagggctaatatgaaaaatacaaaggttatgttactttaaaatgaggtttggaagaaggagaaagacaaaaaagcagggcacatgtcaaactcttggaaacttgagatcctagccctaacgcatgtgctacttcaaggaattcttcttatatatgacaactattccaatttgatgctaaaactagcccaaagtggttgatgctgtatcaattggtaaagaatcctcgattttcaggagcatccaacgacgaagatgaggattattaagggcagaaagcgaggcaagaacaagaagccaacgctaattttaaaaattcatgtcattcaagctgaaaatattgaagccttgaagacattcaattgtaacccggtatgttttgttaccactaatacattttatagtcaaaagacgaacaagctcaagaactcaaatacacactggaatcaaaccttgaggatcaaacttccgagaaatccaacatctgaatggttaaggattatagtatacgacgccctaccaaccggagctccccctactacccccagtagaccaaggacaaccactgcaaatacatcttcatcgacactgtcaaattcagggctaagttctcactctcattcgtcgagaaatttgaatgttacgtccaaaggtaatcaaacttcaacatcaattaattcagtatcatcttcagctacaccggccccttcacattcttcctcttctctctcaacaacaggtcccgggtccacacacaaaaataggattaatagctatctatatttgggtgaagcaaaaatttcattactggatttattcaagaggaaggacaccacgacgagctataaattttcaattgaagctcagcggtaccatctatacgatatgaaaggagggaaagaccaagattccttgaactgcaactttctagtgggcgatattttgcttggatttaagctagaatgtaacgttaaaagaaccccgacttttcaggctttcaatgcttggagaaatgagttgaacacttacttgggcagaatagatagaaataaggcccgcatgagatcttctagttctttgccacctccactagaagatatgttgagcaatagttcagctgttagtggaaatgaaatacgacgcgagaaaccatatagcgatactgatctagcccacgatgaagaggtcaatgccgaggatgaaatagatgctgaggaatctattgaagatatgaatagcagcggcagcatttgtacggagaggaggtacgatatagacaatgatactatattcgactctatatctgaggttgtttcgctaaatgatgaagaactagatattctaaatgattttgaagaagcagatcatccaaatgtgccagacataaatgtgcatgacatcgacgaagatacccgtatcagtctatcttcaatgataacagctttagatgaatatgatatcgtagaaccagaagatgttgcaaaattacctgcagtgtcggaaaatgacataacatcagtggatgacgaagaatctgaaaaccaacaggaaagtgatgaggagtttgatatatataatgaggatgagcgtgaagattctgattttcaatcaaaagaatacattgggagtcggcttttacacctgcaaaggggtaaacataataaatcatatgcaaattacttatacagaagagcaaaaagtaacttttttatatcgaaaaaggaacatgcgatgggggtagtatttatgcatattggggctatcaaaaatttacctgcattaaggaatcggttgtccaagactaattatgaaatggatccatttatcgttatttcgtttggtagaagagtattcaagacatcttggagaaaacatactttaaacccagaatttaatgaatatgccgctttcgaagtttttccccatgaaacgaattttgctttcagtatcaaagttgttgataaagactcattttcattcaatgatgacgttgcaaaatgcgaactggcttggtttgatatgctgcaacagcaacaacatgaaaacgaatggataccttatgagataccattggatctcactgttgagccagcacatgctcctaagcaaccggtattatattcgagcttcaaatatgtttcatatccgttcttaaaaaagagcttttggaaagaagctgttgacacatcagtcaacttagagagactcgacattattcaagtaatgctctatcttgaacgtcttggttcattcacgatggccgattcttttgaactctttcagcatttcaataaatctgcttgggccggccagagcattactagatcacaattagttgaagggctacagtcatggagaaaatccactaattttaaacgcatctggacatgtcctagatgcatgcgttcatgcaaaccaactagaaatgctagacgttctaaactggttctagaaaatgacttgataacccattttgccatatgtacgttttcaaaagaacacaaaactttaaagccgtcgtacgtctcatctgcatttgcatccaagagatggttctctaaggttttgataaaattaacttatggtaaatatgctttgggatctaacaatgcaaacatcttggttcaagaccgagacacagggataattattgaggaaaaaataagcgcacacgtaaagttgggaatgaggattatatacaatggtaaaagtcccgagtctaaaaaatttagatccctcttgaagactttatcaatcaggcaaggcaaaaaatttgacagcactgcatctgccaaacaaattgaacctttcataaagtttcactcgctagacctttcacaatgccgagataaagattttaaaacattcaatgaatttttttacaggaaactaaaaccaggaagccggctgcctgaaagtaataataaagaaatattgttttcaccagcagattcaagatgcacagtgttcccaactatacaagaatcgaaggaaatatgggtgaaaggaagaaaattttctattaagaaactagccaataactataatccggaaacatttaatgacaataactgcagtattggtatatttagactggcgccacaagattatcaccggtttcactcaccatgtaatggtacgattggaaaacctgtatatgtggatggagagtattatactgtaaatccaatggccgttcgtagtgagttagacgtctttggtgaaaatatcagagttattatccccatcgattctcctcaatttggcaaactactgtacatacctattggtgcaatgatggttggatccatactattgacctgcaaagaaaacgatgtagttgagagtggacaggagctgggctattttaaatttggaggttctactataataatcattatcccgcacaacaacttcatgtttgattccgaccttgtgaaaaactcttcagaacgcattgaaacgttagtcaaagtcgggatgagtataggacacacatcaaatgtgaatgaattgaagagaatccgtattaaagtagacgacccaaagaaaattgaacggatcaagagaacaattagtgttagcgatgaaaatgccaagagtacaggaaatgtaacatgggaatatcatactttacgggaaatgatgaataaagattttgctgggctatgaagccgccgaaaaattggctgtagttagtggttaccaaaatggaaaaaaaaaaaaaacatgaacaatctccctcagactttattatagactatagcgtgtacaaacaagtcatcgttgataatgaaagcaatggtttcataccaggaaatttcctatgaaaaatatgcatttttattagtaacaaaagaaactatattcctagtcctcttgcagaaaatacgatataatacttaagttaatatttacagtgcagtaagtacctttttcatgacctcatattcgtttgttcctcttgcaacctgaatggaatttttttcaaaggtacttctcggcctttcttgttagattgctttccatatgttttatcggaacccaatctagcataatttatagtccttttctcctttgaaacatcaatacgatctaggaaactttgtgagagagatggtataatggattggcataaaatggagaggattctagacgtttccatagccaaaaatattatattgtcttgttgatctaattccctctcccaaggtttactattttgaaccaaagtatttgcatcgttgataatactccaaacatgccttagcagttgaggatactggaatatggctattttttcgtcaaaaacctcttgtgatttgttgagtagtttagccagattctcaattcgttcggagactattggttcattttggaaaatctcctgaaattgaaaatttgccttgtcgctaaatttcataacagctctttcaatattgaatttcgagccacaacatctgttaatcagattgccccatttggatactaaaagctctcttgtctcgtataatttggcttcttgaaaatcgccgtcctcttccagtttagaattttctaacaagaaccaacgcacaatatcggctccataataacgtgccatatcaatcggatctacaacattacccaaacttttggacattttcattccattgcagagccagtgtccatgaacaacaatttgtcttggtaaaggcagtccagcagccagtaaaaaagaaggccaatatacggtatggaatttcgcgatatcctttcctatcacgtgaatggtgtttcgctgcacttcttttgggtatggtattaacaattggccttttacgtttgatttgtcgctataatgtcttgaaactacttcagtagcattactcaagatggacggtatgccaccgatggaggagaggtagttacacaaggcatcaaaccacacataaactttttgggacggatcattaggagtcggtataccccatttaagtctcgcagagggtctcgatatcgataaatctggcaatgtcccaccggtttctagttcttttagaatttggtctcttttagaagcaggaaaaatgaaatctggattctttcttatatggtcaactattttcttgttaaataaggatagcctaaagaagtaatttgtctctgactgataaactacttcgtttttcgattctgtattcagatacttaccatcatttttggggtctttaataaccttggattcaggatagaatgtttcatcagaaatggaataccaacccttatgttcgcccatgtaaatatagccatttttcaaacaaagttcccataatttcatcacgttttcaatgtggtcaggatccgtagtccttataaatcttgtataattaatgccatatattttgtctaattgaacaaactctgggtatagcttatcgacgaacttttttggctgatcgaagccattgctttcactagcacactggattttcaatccatgttcatcagtacctgtggtaaagaaggatagattacctttaaataattgccatcgatggtaaacgtcacttaataagctggagtaaagatggccgaggtgcggtttggcattgggatagaaaattggcgtcgttacgtgggagaccttagagtacagacgatgcacaattgatcgacattgcatgttttctttcgatcaaaacctatgctttccttatttacctctggagaatagtaacattaaaatttacattcttttttcacagttgtgcggatttatttgtttgaaaccaccattggactacgttttagtttttaaagaaagagaaggcacttcgtaatccaatgttgcctagtactggtattgcttgcactatacaaggaagtaagtgtgattatgtaatgctgtatacactctttattcaaacatagttcagaaaaacatatatacaaatatcgcccctaagccaattcccttcagacaaaaattaccatgagggcaaaaacactgtagaaaatcaacagtgggtaggcaattagcaatcttgcattttgcaattggagcaaagaatttaaaaatccagacgaggtccaagtactccaaattacaaatagtactgatacaacataacctgtagtgttgttcaaaccatggaaaatgcccagtaaagaaaggaaacacagaggcaaaaagcagtatcctaagatggacgctgtattgaaaaattgtaggttcgtttgagtggaagtatcgttattgctcattaatttcgatagattgtgcaaagaaatggtaccaaacaaagcgacaccatagatatatccaaaatgaacctttccagccatcaatagaaaaagtccgaataacaaaaagaatatcaaaggcccagccaaatctgaatcgtttagaatttcttgtggcacaccactaccaaaacgtattggtataagaaccattttagttttcgttatgatatgatcgaaatttattccaatttcctccagtaatggaggttcatgtggatatcccttagttgaaagagcatgtaaaatacctacaggcaaagggtcgggggcaacacccaaattgttatcgttgccagtattagaagaaccgacggtattttgaaaactcattgacccttggggaacggcaaattgtgcagaaggctgataaaagccaccgccattattagcattgttactagtattgtagaaagacatctcgagagggactaatagttgtcttgcagtacttcccgtccaatttgtagctgttataagatgacttggttcgtgtcacgtagttacctcactcaaatagcaaaataatcaatggttacccgaagtgaaaattttcgtgataatagcgatgagatttaaacccagttataaaagtcgtacaatattgaagctgttgatattggaattgaacaagtactaacgagatacgcattatcaaaactaacgtaacaagcactacaaaatgggtattatcgacaaaatcaaagccatcgaagaagaaatggccagaacccaaaaaaataaggccacagaacatcatctgggtcttttgaaggggaaattggctagatacagacaacaactgctagctgatgaagctggtagtggtggtggaggagggtctggttttgaagtggcaaaatcaggtgacgctagagtagttttaataggttacccctccgtcggtaagtcctccttattgggtaaaattaccaccaccaagtctgagatcgctcattatgctttcacgacattgacatccgttcctggtgtattgaagtaccaaggtgcagaaatccaaattgtggatcttccaggtattatttatggtgcttcgcagggtaaaggtcgtggtaggcaagttgttgcaacagcaaggaccgcagatctagtattaatggttttagatgccacaaagagtgaacatcaaagagcatctttggagaaggagctggaaaatgtaggcatcaggcttaataaagagaaaccaaatatttactataagaaaaaagaaactggtggcgtgaaagttacgtttacctcccctccaaagaccaatttaaccgaacaggcaatcaaaatgatcttgagagattatcgtatccataatgcagaagttctggtaagagatgaccaatgtacgattgatgattttatcgatgttattaacgaacaacatagaaattatgtcaaatgtctttatgtgtataataagatagatgcagtatcattagaagaggtggataaacttgccagagagccaaacaccgttgttatgtcctgtgaaatggatttgggattacaagacgtcgttgaagaaatttggtaccagctgaacttgagtcgtgtgtatacaaagaagagaggtgttagaccagtatttgatgatcctctagtggtaagaaataattccactattggtgacttatgtcatggtatccacagggatttcaaagataagttcaaatacgcattggtttggggttcttctgccaaacattctcctcagaagtgcggcttaaaccacaggattgatgatgaagatgtagtttctttattcgcgaaatagtataaatgaatagattttaaagaaacatgaaaaaacaagatcagcatcgagaactgtagtacggagcagagattttgcatgactaaacggactcattttccttgtagtagaaataaatgctgaaaataggttttttagtgagaaccggaaggtgttactttcatggtatattcgtatatacttttataatgtaatttgaagagctccgttcataaaaattgtcattctgggcttcaaatgaataaataaacccgaatgacaatgaaatctcgaaattataatagtggtacctagtgtagtaagtataaaggaaccttctctgttgtatctcagaatgggatacctcagtatgacaatacatcatcctaaacgttcataaaacacatatgaaacaaccttacagcaaaacgaacagaatgagcaacatgaaaataaaactctgccttccttagctaacctactctaacgtataagtatctgaacaattggtttagatccaagattccgcgcttccaccatttagtatgatccatattttatataatatataggataagtaagatcccgtgaatcaagctgataaaccgttttgacaactggttacttccctaagactgtttatattaggattgtcaagaaccttgacattaccccattgcatgatgcaataatctcatataaataacaagcgcaagtggtttagtggtaaaatccaacgttgccatcgttgggcccccggttcgattccgggcttgcgcaatgttttttccatccccaagtatgggaactaaaatagctaaaaataagtatgaagttatatttttaaacctatttacagtgtacaaataaataatatatcataaatgacacagacgtatgttttaggatgcaaaagttcaagctgcccttcctaattgagtgacccgacccatctaccagaagcgccaccagcttttaacctgcttatcctggactatttcctttgttttctcctccgtttcagatcttagctgagacagttcatttctgatcctagccaactcttctttttgcacctcctccgccctcaccttagcaaagtgatctctgctttgaacgttatcaccgttcctttcccaaggtgattgaagggggcccgtcttccaaattggatcgtcactttgagaagtttccttaacaattttcatcaaagcctgctgctccgactgacgtagttttttctccctctcatattgtaaacgtaattctggggaaagctggctgattaactgttgatctgttggcgttgtgtacttgaaaagcagaaacccgcttccaataatagcgccaccaattgcatagactttcaaccaacgtacccacaatggtctttccatacccaaataatgcttatactgtctttgttttgctattactgcctctctaggagttatcgcgcactgcatgtatataaaattttatcttgataaaataccccgggggatgagcaaaaaaagggatatggggaatgaaaagtgagataaactagcaataatctattctaataagtagaacattcacaaagactactatggtgtaattctgaaaggatttacgagagcacaaatactattatgtataattctgactgcagaatccggcaagcttgatttaatatcacttaaggaagtaatatcgttaattgataaccgaatatgaatctcaatgcatattttgaagcatatcaagccatttttccttttctgttggaggcatttttaaggaaagaacaaaaagtataaaacacttcggttaataataaatgatatgtgaatttttttgaaaatatgtaaaataaataagtaataaataaaaataagatgtgtttatcgtaatgtactatacaagccttccaagccgacttctgtaataaaaaaaaaaggtgcagcttaatgtttgacggttcctatcctctctcccttataagctgtagttaaccaatcaactcaccaaacaaaaatggggtgaatactctaatagctgtgatcaaaatcataataccttccaataaagccattggtaatcccaagaaaccacgttcttccatgttcaagtaaatggtgtaaaaagcgacagcgaagaaaaccctggtcaattgcaaaggctttggcaagacaccagacagaaattcaacgggtttgttgacacaatcgccacctctttggaaatatttgaaacaacctttttgtaatgccttcaagttatcgctgtcagcagcgaacaaagaatacaaagccactgacaaaacgttaataacggaatcgtaactctttctttcgaaatggtagtctagtaattcatccaaaaccttttcacggtcgctgaagtctaggtcacctattttcttaatcaacaagacaacatcatgcaaaccgacagtcataccaccaccagtcaatggatgtctcatatttagagcgtcaccgataacacacataccagtgacgtcgttttgtctagctggcaagtaggagtttggcatagctctaaatttaccttggctgacggcttcatcaaatgaaggacgtagactctttggaatgaaaggttggacatccttaatcatccaactcttgatatcagctgggacctttggagagttgtaagcacaaaggattcttgtttcttctggactgatttggtaaaccaagattggcatatgatcactaccaagaataacgtgaccgtgcataggagcaggattcttagcattgaacaaagacataccgacaaacgaagaaccgacagttggaacatggtctgggtgcaattcctttctgaaacgtgaaaagataccgtcacagataaatgtcaagtgggctttgaattccaccttgccacggccatcaatgtcaaccttggcaccaacaacctcattcttttcatccttcaatatctcaatacagttaccttgcactctagtaacatttggctcttgagcagtaatgtttctcaagttgttcaagaatctaccatgaacaaaagcaacacccctttctctttcatcatcttcgtaatccttgatgtgaatagtgctgtcttccaagaccttgtcattaccatctttgaccaagtccttcaatttttcaactttagggatatcggccttgtaagggtatggaatatcaacttgttcgccgttgaaaaagacggtataaccggtaacaggatatgcttcgatgttgttgatagattgaatcatacccagacttctcaatgctctaacaccacctggttgcatcaattcaccaacaattctatcaggcatagcccagtcacgttctacgataagaactttcttaccctttcttgctagaccagtagcaacacatggaccgataacaccagcaccgatgacaatcgcatcgtaggtaattgtgttgtcggcattaatcaattcaggtgcaacgttaacagcagacatgacccttttctcgatatgtttttctgtgatttttttttttcaattgttcgaaataacctgtattgttcaatactggacaattgttctgatatatatatatatatataattttcaatgaaaaaaaaaaaaaaaagaaagaaaattagaagctagaaagaaataaggaaaaggaaaagcaaacaacaataggaaaaaaaagcatagaaacatataatagattaaatacaaaagatttattatacatgcgaggtaagactattgtctaagacttatacccgaccgagagcagccacggcatgcatcgactacgagcgtattgtgttatatcagctctgtccgatacactgcttgccttttgtacgagctcggccgagctatacgaaggcccgctacggcagtatcgcattaaagcgacgcaaattcgccgatggtttggtagaagagcttgcagaacgattcccattcgccacgatcccgtagagtgccctgaaccacgctcatgtccatgttcataccattcacgtttgtggagcaaacgtttaggccgaacgcaaatctcaaggcgcctgcagactgcgagaagattaaatcccgaacgtagtacggcttggtcgtatcttgcgagacaagtcctgtattactgatgattgcaccgcctctttgctggtgcaaataagagttggcaagaaggctgtctatattcttgttttcaacgataaaatcaagttgtaggacccccagaccaatcaagtggtcaccgttgtcgtacgattctaaaaagcggtcatagtagtattcgacaagactccaaaacttgtcattgtcaccttcgggaatgtcgaatgaggagattagataggcgtaatgcgaacctccaacgttggagccgtatttataagaatctcttaactcttcatcgtttggtaaaaaccttcttgcgttgcttggaatagccacatcgaacccatactcgagaagagattttgtgaacagcttatccagtctatacagggctacaagaaagcacgcttgaatgaagggtgttagggtgcacccatcgtgaacatttttcttgatctgagctctgatttgttctacttgcttagtactgaaatgcaacaagtaattgtaactagcattagcattactagaggggctatatctagctgtaagtgtagattcgctggaggttttaaaattacaatgttcataaatgaaggttgttaaaaagaatttgggtaatgaagtcaatgctggcttgtagtcaatacgatccgtaatcggttttggcaatttagaaatttcagtgtagtctcgatcatagtcaatgatgacttgatcttcgatgaactcttcatcataatcaaaccctttttcttcgattttacaaaagagtagagctaaatctttgaaaaaattcgatccactgacaccgtcggagccgcagtggttagtgacataaacgaagtttttccacgtttcaaacccatcagtatccttacctggtaaacaaatcaatctccaattaggcctcttcggattacccagaggtatgattacagggctaatcaattcgattaacctattggtgactttgaaatcatcctttttgaactgttctgagattttctccatgacttctctgtattctggttgattattcataatcaagtcatcgaattcaagatgagaaatcacctttatgaaatcatgctgtggaaaaggtttactaaggtactcttcgctagagtagtacgcttcatgatgaggataatgcttaggaatgattgtatgcgcaagagttgagtatttttgaagtaatactttcaagacaagcattagttgtctcttattaacacctttattcaattccgcgtaaacagtaaaattcgagtacattttctgcctactcaaaacagcaaagtagttttccaagtggcccatacgtcttgcatggccacggtctatcaactcttgagtgatatgtggttcgtatccttctatatcttccataattaacctggacaatttttattgctgaagttattattcgtttgaaagtctcagtactgtttgtacgcattaggaatgacattgctgttactgcagaattgccctacacatttgttgttgtcttttaagtaacaatttgctctattttcacagacctcgaagaaacgtaaatcttgacaacaaatgtttacgatcgtttaggtgtatgaaaaaatatagaataccaaaataggaaactcgttgaattcgtttactcattatcccgcaatatttatcggtggcctacagagttcaatgtagcctgagattgtggcgattgaaatactgattacttaaaatttgctaaagcctgttctatctgaagaaaaaaaaaaaaaatggatgagccttccagttcattgaaattcttcagttcttatttttttttcaaaaagaaaagtttcagtaccctgttccaaaaaaaatgaaaaaaatgaaaatccagtatccttcccataaaaattaaaagttccattatttatgggtaagtaagtaccactgattatataccatatttataaagtgcatgaatttattactatatattgctttttctgacgtgcttccttcactatttatggccactggtactactattatggtggccatggtggctagtttgatggtaatttctactatggccatgactgtgcattgccgacccgttcgctggcatgccagatggacctgatcccatcattccttggaagggtatccctcctggatacccgaaggcacccataggagcgccagggccagctgccataaaacctgcagggacatggggcgaaatatttcctcctccttcttcagccccattgctacccataactggcatcatttgaggcatagatgggtgataaaacattggctgaggttgaaatggcatgtacatacccattgacccagcagcaaagccattcatcatcggatttggtgatgccgatggacctcccatcggaaagcccatcatcccgcccatattcatgcccatagctggattcataccaggcacagcattgcccatggagttcaattggcgttgttggaacctagtttgagcttcttgaatcgccgtatcctcatctgggaaaaatgtcttatacgattcttcaattgtatttaaccaggttggcgcagtaaaataaggtttttcaataaagaagggttccatattctccgaggcatcatcgcctttcttcttttcatcgtgggcctccttggatttgatgaacatattaaaactttttccgaacaacactctcttggcgtcattagtatgagggttcttggcaccaaaaaaggaaccatgattacgtcttctcaatgaagtactagatctcgtggtatggccggtagatgattggccttgagatatgttgctgccacttcttctagattctgatttccctgcagaaatctgtgtagtaggagaaacagtcttggccgaaggggttttgctgatcggttttggaggcaacgaagaattagattttaatgtagagcttgacctttttaagacttctagcatgtcttttggaatatcatatggaactttaaatttctcggaaaatttcttcaactcttcaatctgggcttctttgctactcaaacttttcttattcttagaagtcttttgtgggggttttccctctggcgcacctgctgctgcgggagtagaggtatccgtggaaacggcattttcatttttgttagaattactcgaagagataattgctggatccatatgatgaggttgctgtcttaaagtaggtgggacatacctattccccttgttggaattaggcttagaattgctttttaaagcggccaacaactcatctcctcttctatcaacaccagagtataagtcttcttcatctagaccagaatcatcaattatgatacctctgtcctctgcaatatgaatattaccggaagttccttgcgattcaatttccttagcgattctttcggcttcttgcaacctcttactgtaattagggtcatccttgttaatctttgttgtatacaaatgttcatcaaaagttgactttacgccaaactttttctcgttcacagcaaattgatcccaactggcagaatcgtcttccaaagctttacccttgttgatatcaaaatgttccgcgccttcttcgggtgtccatttttctaacttacgctccttaatttctctaccagaaccagaaatatcaacatcagtcctgaatttcgtaacttcattcgattctccatttaccctttccttttcaatatttgttctggcgggcgttgtttcttgggctttggaattttcccatttctcatcaagagacaaatcaatattcttcagttccaactcagcgacatcttcaccgtgaatcagcaaggtttctcccaaagtcttagccaagtcatccacagaatcactaactcctgaatcagcaaccctgggaaatcttaatacaacatcgataccattagtagattccaaattacaagatactaataaaccggtatatttcacacctgaagtaacagttactgttacatcagagcctatactattggctaacaaataatcttgacggtcatcaaagtttctcgtaatttcagggttctcatagaacattgaactgttgttttgattagggacgcctccattcgtataattgctgtcagaattaccaccctttcttgagttggtggagctatctcttttcctaaagtttcccttcatattgtttcaatgtaatgaactcctttaattacttccgtgactgaggatgtcagtttttatatcaaatcaattttcaaagatttaattattgcttccccttcaagatcaattcggaaataatcgaaacgtcttctggaaagaacaaaaagaaagatagaagaaaacgcgagtgaatgacctatatcttccttaaagatctatgcgatgagagatgccgatttaagaactgctttacaaaaacgcaaatctcaagtaaagaaagtgcctcccaattgagctttccttccttctttatttttttttttttccagtttttcataatttgttgtggctctccaaggttttctgaggctcgttggcggagaagttacgtaacccggatgctaatagtgcatgattatatatcaaatatttagttatatgcatcgtaatcgtaaactctgaaacaatggattatcgctagtgtatatcttcttcggtcttatcttggtgcgactcatggtgcggtacaaaaacctctttgatttcttcttcatgtgaatccgaaatcatttgacccattgtttccttaagttcctttgatttcttcgtatattctttcaaagaaggtaacaacgacagtacttcctccttatcaagcctcacatcggctgtactttttatggggtcgttcaacatcaggttcaattcgtggctatcatttctaaaagttactgggccatcaggatgcataaatccattagtagattctaagccatatgtatattccattgctttgttaagtactggatgcagatctttttgtattagcttctcagtgagtcgtttcttgttgtttgtttttaaattcatgcacaacttcctagtttcctccaaaaggttttgttcacgtgaaagaattgcttccaatctctcattattttgtagttcttgtgaataccggttttgaataaattgtcgcttagaataaatatactcgatgtctagatctctttccgatatcctagagggaaatttggcctgtcttagcttcttctttatctttgtgaggattatttcaagcaaacgttccttcttagaatatattcttttaacctcattattatcgccatgcgtcatttggttcatttccttttcgtacttctcaaagacagaatcaagagcgcttacagtgttagtctctaataaacgaagtatggatcctatcattattttagaaggctttttccaatgctttaattcataattgcgcggcaacctttctctatactcagcttgtattaccttcctgaattcccaaggtcgtacattgccctctccacttgttgcgcttccatccgatagatgagattgcaatttacctgtactttccttgccaacctcaaatcgaagttgtttagatcctttatgatggtattgtccttcttctttgttcgtgcgctcttctatttctccttcttcagcatcatcagagttctcataaaaaagcgacttctttgattgggtgcttttagcttctggtgctacgtccagacgtaaagttttaatatcattcacattcatgagaatgctgctatcgctttcagaggaacttcggttgggtgacagatccatggcctggccattgttaattgaatcattttcaatattttgtaaaaaattatctctatcagctgccatacagtatacgtagcactagtatcgcttgaattattcgtccatagggtgcaagttacctcatccattgttgctatgtacctctatctgtattaacttcgaggtagtaaacaaatgggtggaccgtattgtgactctccgggtaacaaaaatatgttatttaaatgaaatgaccgggatgatggtactctctgaatctttcccttatctacctacaagaaaatggcaaatattgtcataataaatataaaaaaaaactgtagtttctttttaaatttttctacttaagtttagttatactgtacctaggtatatataaatatatataaataaaagtggccaagaataaaagaacgcaccccgtcgttgacttagaagtcatcatcaaagttaatttccttggatggggtagcggacttagacatgtcactggccttttggtagtcggaaaccttcttttcaaagaaggtggtcttaccagcggtagcgacatcctccatgaattcgaatgggttgacggcgttgtagtatttttcgttaccgaaaccttgtaatagaccgtcagcgacaaattctatgtaggtgtgaatgctcttcaaatccataccaaatttttctactggcaaagagtttgagtagtattccttttcaatttccacggcttcggtaatgattttttcaatgatcttggggtttggcttggttctcaaatgggcaaatagcaagcatgaaaagtcagtgtaggcacctctgtctctacagatgtttctgttggccattgctaaacctggcataatctttttgtcagtcaaccagaacatagaagcatagttaccagcttggaaaataccttcctttgcagcaaatgctactagtctttcagcatacaagctgtcatcgttggaaatccatctctcgatgaaagcagccttatgcttgacttcaggcaaattggcaatttccttgaatagagggatgttcttagggtccttgaagaaggcatcaaccatcatggagtaaacttcagagtagatgttttccatcataatctggaacccgtagaaactcttaccttcagggttttgcaattgggcagaaaagttttcgatcaagtacttgttgacaaggttgtcagaagaaatggacaaggctaacaagttaccgatgtaggtcttctggtcatcagtcaatttttggaaatcttcagtgtccttagccaattcgatttcttccgcagtccagaaagaggcttcaaccttcttgtaagcagcccagatttcgtggtatttgatagggaacatcacgaatctacggctgttttccatcaaaaggatttcatccttttcagcttctttcatatcatgacgttctttttggaaagtcttcaaaaattggttatgtgcttccattgtaataactaattgtgtgcgttgcgcggggttgtgtggctcaaaaagatctgtttttgtattagcaattttttatttccctttttaaatgaattttttttctttctgtttcgagacaaggccttttgcaaaaaaaaaaaaagtaaaaaagtgaaatttgatagtgtaaggggacagaggtggggtcagaaaccaatgtatctattgatagtctttttttgatcgaaaagccaagagacaaaaaatgaagaaaatgagagataaggaatgaaactttaggaacattgaagattcaatcgccgtttttatacgccagagcttcatgagaccaaggaaggaacggacgtcgtctaccgattacagtaagcaaagaggatggtgttgccacaacaacgcccatcgggaaggcaagagacgctgtggtgaacaataactgccaaaacgtggttctcgcacgctgaaaagcgcgttctcgtgcgccgctttcagtgtgctagaacttgcactgtccggtttccggtgcttggtgttgggtggtcgtacctgctagttccattggtgcggtgtatgggcgggtaccctcaaaaagggaaacgaaggtaggcgcacggtgcttattaagctcagaggcgacctcgcagaagggggcagaccacacaagcggtggaggcgctccagatattcagtggagtggggcttgctcatgttctgttgttggttttggatagaaaaagagcgggttgaatagtttgccatggcaaccactctggaagcgaaatcacatagacgcgtaaacactcacacacaggatattcgtatagcaaggtactagtggcgacactcaggtggtcctcgttgccttatctccagattcctcaatttctgtgaaacgtaaacattatgggaatagtctagacgcgtacttcattttctttgtttcgtgaaaagtacactttcccgtcttcgccggttccctttcttgcctgaaatgctcgttctaatggaaaaaaaaagaaataaaggtgggcctgcccattagcaggaaattggtacttaattattgaaaaaaaaattattggttgctaagagattcgaactcttgcatcttacgatacctgagtattcccacagttaactgcggtcaagatatttcttgaatcaggcgccttagaccgctcggccaaacaaccacttatttgttgaaagcgagcgcggtacaagtaatgttacctcatctgatatacaataaaggtggagcgccaatatatacgcatttgactgttcataattcattgaatataatttattccttgttagtacaaaagggttaaacagaaaaagacgtgacgttgtaaccgagaggatggtaacaccgcggtatcacccactcgcccagccgttaaatccaatcatccgaataaaatgtttgtccttgctagtttgtcctggtgataaaagccatgaccacttttcttggagcctgcatctgttatctctcccgtcgataatggactttgcaccggtgtattacccgcaagaattctgataacgttcaagctaaaacaaaactgctaaatgagttctgaaatggcatttatgagtacatatgatagatttgctatgtatcaaacctggaactggcgctagcgctatggtttcacttcctcattaaaccatacccttgacgatttgacaggtcgctacagattcagaaagagatcatatcaatacaacaaataaaatataagcgaataaagagcaatgtctttcccctttagtcacattactagccaacgctaattcttgatctccttcctcttgtttccggtgtatcttagttttcctggcgttgccgaagagtaaaaaaatcctaggtcctaagatttataaaatcgacaaaaagaggattcaagtaggatatctgtcagttcaaaccaatcaatcttttctctccaacaacagtttgagcttatttaatcaagaaaatgggtctatcatctatctttggcggcggtgcaccatcacaacaaaaggaagcagccactactgcaaagacaaccccaaaccctatagccaaggagctgaaaaaccaaattgctcaagaactggctgtggctaatgcgactgaattagtgaacaaaatttctgagaactgctttgaaaaatgcttaacttcgccatacgctaccagaaacgatgcgtgcattgaccagtgtttggctaaatatatgagaagttggaatgtcatatcaaaggcttacatctccagaatccagaacgcctccgcttctggcgaaatctaaacacaccatcaggatcaatttactgcgcagtatgtactcgtacttgtatataagattcaaaggataccaagaaaatgctattacgtttaataacgtcgaagaacagtattgcactatacttgcttggtatagatatgtacaaaatatatgtatatacataaaatgagttattctttttcctaattctctttttcctttagtagaatataaaattataataaggattttgtgaacatctgacagacaggctcgttcgtgtctatttccattctgaaatttgaatgcgctttggcgagacatagatttgtgtcaaaatatgaagttgagtgcctttatgaggttgggttgaacatgaacaaccagccaaaataaaaaaataataaataagacgagtgccacttatatagcttgagagagagagagagcgtttgcacgtatatgtgtgacataatcagcgtttactcatcatcgtcgtctccatcgcctgcagctattcgagccttgacatctttccataattttcctttgttgtgattctcgtaccatgaagtaatagcagtatcaaatacagtttggaaaacaaaggcacctgcaaagatagtaccaacaaaaacagcgtttcgtttgaaaaaggttttatatagtgatgaaaaagactactcataatttatgcattgttagtaacctgaatggaaacgcatggaacatattcatagagctgctgtcaccaatttcataagcttcgctaagtcgttgcgctcatcggtgggaaactaatttccaaagcccatgatacttggctaaggaagattccacggataacatttttagcctgaaatgtgaagcagcacacacacacaccaacataccattttagtccgtattgctattgttgctttacgaaattgcgaaggatatgaaaatcaaccttcaacgattattgactatccgtgacaggacattaaatacaactgctaagctaaagtttgagaggggatgtcattagggaaaggcccaaggattgagcagcttttaggtcctagaattctttcggcattgacttccccgcgtttgattgggtcgtgtataatgatacatattaacaactggggagttcaaaagttgccttcgctagataaggaaacttatgatagtcacttcgaagtatttgtaattaggttggtattacttctttgttaataataaataaaagtcaatcgacgcgcaaatgtttaataatgtataagtttttatatacaaatatgtcaactataaaacatagtagagggcttgaatctaccaaatctctcgctcatcagagtcatcattatcatcagagtcatcctcatcgaggtttcttggatttgtatttcttatgatagtagctccatcaaattgaggtcctaagaactgcaatattggtgggggattctgaggtgcatcatcatcgccatttccctgcggttgtagagtgttcctaaagttttcgaagaattggaaaaaatcacgtactccgccaccagcaataccttctgcgccaaccccaaataagttggcggcctgtccagtttcatcatcaacatccatttcgtcatttccctccgtaaaaaacccgtcttctccctcttccatatcttcatcatcttcatctgttggaggtattcttcttggccttggttctctattaaatgcaaacaagaaaccattggaaagtatagtcactcgaaattcgtcacccattactctactaatataacctggaatttcattgttaatccataatctgtttaagtgctcatatcttttcaaattcaaggtggttaaatcacctcttctcatggcatttctaccaacttcaccatgcgaatttagatatggtgcagatataaaaatattagaaggaggctgtgtcaaatggagacaaacttcacttgaattgggcatcaggaaggcgccaaatggtttaaaacaatttttattcaaatgcttggtcatttcatggcggtccgctcttaaatgcactttgacaccacatgtcaaacatattttgaaatctaatcgattatccgcattcttcatatgctgagaacgctcttcacgtagcttgatttccttagattgggtaacgtaagtattcaaatattttgataaatctatcagttttataatcccacaatattcatatgggatgttctccaaatatggatgcgatacaatggactcctgcgttgtcaaaagatcgactaaggattctttttcagtaatcattttcaatgccttattgacaaactcggcggtatcttcgaattccagttcttcttcaacctcatgaccgttgatgaccagcgtttcattttcagaatctttcactaattcgtgtagcactttgataaagactaagcaccttcttatcgtaggaagaagactcttcaacaggaaggtataagctagatcataaataatactttcggagtccaatccctccattcgtacatcagatatggtccttagggcgaagagcatctgctcacttactttaagaacatccccaattttggacgctttagcatacaatttggtaacctgttctgcatcagaaagaccctgaagaaaatctcttagaaactgtctagagaacgttgttaacgcctctgtaacagtctgacgaagtgaaactggagaaaataaagcgcttcgaacaatatattggaagagttgattttggttccaaacagtatcgggctgctgcgggtacggttcaaactccatacttggcttgcctatgacaaaggtgaacagcataatgcagactaatatattttttaaagttttgtatttctgttccctgcttctgaaaaatgaaatactgtatggcttttctaacctagaagcaatttctaacattgaaatggtatttgcccagtgcacacttaatattaaagaaacgtccttatgcgaaaagttggcccgctttcttaccgctttatcaaaaccttgacactgagatatcatcaacgaaaatatagagtttattgtacgataattttcctcagtaaaaggtttgaagagccttgacaatgtatccaaagaaagttctgattccaaaaacatatctagcgacaaaccagtatttgcctttgaggtttgacaaagaggtaaagtacaattcgaaaatgtttggcataaaggacatataaacgcgtttgatgaaaatctctttttttgaacgtacctcttgaagcagttatgatgaatgtgatgattacaggatacaaatactttcctagatccacaactaccgttttccttcaaagcctctaaaacatcatcgtcaatataagcttgtttttcatcatcgttgtagaaaccatcccacatgggcataaattcatttgggttaaaaatattaccaggtctaaatatcggggaatgatcatggtacgcaggtatcacaaaaaaatcggtcgaactggaatcttgacatagtgcgcaggtaaaatcctccgattcatatactttttcaccgaccatgtcaacatcgttatcctgctcatcaaattcagactcatgttctttcatgaatttcgtttgttgattgttaaacttggctagaagccttgcttgatgtttcttggccaatcttctttttcgttccttctctgtctcttgtaagttaactccttggcgtagtttcttatccttataatcattaacgtattggttgccaaaactggcaattaatgactcaaaaagttcatttggttttttcattatcatcttctctaacaaatagtcggctttacggacaatactctcggaaaatacgtctgatttagcattggctatgctcaagagtaaattacatataggctttgacaaataagcttctggtatagagtccttaccatttatcaattcatcatccctgaatataccatgaactaaatgtagtagctcattcaggaaagtgctatcctccatatccagacatacctggagtagtttatagaccactttggcaaataccgtattccttgtaaaagcacccagattgagagcgtctttatctaactgttttattgagacttggggtattagtacaacttttgctatttcatccttatccttagccaaatgtgatttaataatagttgcactactttcgaattcgttttccaaattcagcaactttaacggatcaacctttgcatacaagcttgcttttaatttaaaaacaccattgtcggccaagcccttaggctcaacgaaaacagagacttcttcaagtgcttcgtcaaactcggtagtatcttcagttaggtagtcaggaactgatcttagtagctttgaatacgaaaggggtttcatgtaaaggttataaatgattgaatttttgatttgatccattcttctatcctttagagaagagaaagttttaaaatattgtctttcggtcaatatttgataaataaaggcaatgaattgttgaatgatgaatgaaattttatcctcatagacagtgtgttgatagtcaacttcacctgtaaaccagtctagtaattcccatctatcaagaatattgtatattattctcggaatgtcatcacgttcccaaaggatagctaactgattcaaatgtatatctctggaataggaacctaattcgggattgtttttataatacgatgcttgatgtaacacagacataccatttcttacccaaaacccgacgtcaatttgagagcacaatacaactgatctcaaagagaaatccgatattttcagaaaatctgaacagtcttctaacgcttcgtatgcatcctttaaagacactttttcgataaggaatgaaagcattgtttgtaaaggattcataaatgcaactctttcgtggcttacgctaaacttaatgacttcatgagaatcatatattaacttgtatgttagtgatctattgcctagaaatgaactgataattcttattgcatttaaaaaaagctttgaatcaatggaatcttttgatttttcgctaactttttccgctgtttgaataatactgtaaatggaggtggtatattctaaataggagatgaaattttgatcttcgtgaagaacatgttcaccttctttacgctttatcttccacgctccattgaagagcttgcaaagagttaatagagatattatttccttaggtctcaatggaatattaggatcatgtaccttactcaataaagtttcaactgtatacaacccttgcttgaatgatatactgtaactctttgttaaattgcttttttgaactctctgccagatcaatacaccaccttccaccttacaaaactccttaaaaatgtctataattgaccacacaatatccaaaaaactttggttttcgaaaatatttttggcattcgtagggcatgtaaataactgtacgacacactctcttatagctgttagctgaggttctctatccatatatgccacagatcttgtgatgtggttgaatatttcgactacctgttgacagaaaatgggcttgtataaatttgaagaggccaacgttggaatgatcacattctgaatatcttttctcagtcttttccaatatctgttatcaaaataaagaatatgttgtaatcttgtattagaatatgttcttgatgttggagtttctacatcatttatcaatggtgaaagtgaatgggtgcttgattcgggtagaattttgtgatgacccaaaggaatttgattgccatctgcaaggatagataaatcgatgtatctgtagggatcattcttatcgaacttgttgctgaaatatttctccaccaccggtgtcatatcacgacattctgttgcatttaagtattctgaacacagggttttacccatcatgttcctaaaagtggtttggaaggaggagtttggtatgtttaaacagtgtgtaatccaaaggatgatatacttgcatgtttcttgatgaagatattctgaccacgatgttaaagtggcacttaatccattcgtttgaacagcaaaaaaaccacctaagacagatgataaatcttgtgaacatttcaacattgctcgaccttctccgtcaatcctggatgttaatagatcaatgtgtacgttatctggaaccccctgtctcaaggcagtcgtagcctgcgaatagttatgatattcatcgttatatattattaccgtgtaattttcgggatcgattttcgcaagcgatggagatgcctcagggctattagaggggctcgtctttgctgttgttgttccgtcaaacatataatcgttttcatattttaaatcgtttaaaaactgcgctctttcatacatttttccctgttgtgtcatctctcttaatttgatagtgatatctttctgtattgtgggtagaggttcgatattctggttaaaaacatcgataaaatagtcaaacacttctgcaagaaccaactccactaatgctatattcactgaatcattccatacatcttcttcctttatgtcggcatttgtggcgggatcttccgatatatcgttttcttgttcttcagctttgcaatgaagtggagaattccaagcttcttcatctccacagtcacaaattccactagtgaattcagtacatatatcggtacaaacatgatgattcacatgatcttttggattaaaacaatgaatacaaagcacacaagtatcatcgcaaccacactcatgacacctatacaagggttcccctattttgaatttcctcccacaatttcttccggtatgtttatggacgtctcctattctggattcatctatcttataaaacggaatagtttgttgagatgttatcttatcaatatccacagcatcttctaaactgtcaggaaaaacagtaagctctgggttagataatttttgttttggatgagcattgaataaagtaggtaagttctctccgctgttagaaatgacaaagtatagatatctgtaaatgaactctttaagggctctgctcatgtcagccctttcagtaggacctctcgtatacctaaaataggggaggttatgaatagacctcagtgttctcctaatgtgaccttgtaaagatcctaaatcatcatcagcaacggacatattggaatgttctatgtaatttgtgtgacctgtaaagattagggacttcagtgagagaaaatagtcaactaataggatacagtaaacttcaactgcctttgtccgaagatgcgaagaaaaaggaagaaaggtggtaaaaaaacttaataatgtatcgcaataagaaggaggggcaaagaaagcaggatgctactattaaaatagtttgcttttgttaaatgcccagtttcacgctataagtatgcaaaattaaagaataaaaagcccaatgaggaataaagcagttttattgaggtgagactaaaagggtctagcaatgaaaacaatatatgtttcctttttaaaatgtaccaaagtctttatactcgctcgttgatgtactgggcgttatcaaaactgtttgccactgggtagttgccttatggtcactatctgcaagttaaattcaatcgcaagaggaagagaaaataaaccgtcgcatcacttttctacacttacccggttattaattttataacgtttatatgatatatcttttcttatttattatattatgaatcgtgaaaacggattaagctatgcttacaatttggtttcctctagtttcgtggcaatctcgttggtcttagtagcgcctgggtacttagtacccttattctttggtttcttagcctttttcgacttttgtggtgtggcaactggataacccttttcggaggcctcttgaaattccttgttgttggcaaattcttgtctgattggctccaatagctcgttgatagcgtcagcaacaccaatttttagatcaggtggggacaatttttcttctttaaaagccaatttcatttcttcgaaggatttgtaggtaattggaccaccgaacttttctggtctatcaatgaagaattcgaagtgatttgtaccaaacttcaattcttggattggtgcaatgacatattggacaaatgacagtaaaccattctcttcgacgttaccggggctacaaaatgcactattgatctttttcttaacttgctttggttcttccaaaaggtcgatttttgaattcggatcagaggcagacattttaccaccttgagccaaacctggaaccatagggttcattaaatgtgctcttttcttgtagcccaaacttggtaaattttcttccgctaagacaaaaatttttctctggtcgacaccaccaaattggcaatcaacatctaagaattgttcgtccaacgcttgcattaaaggatagataagcccactcaataatggattggcgacttgcttgacaacatcagcgcctgcccttttagcatcgttttgtgaaacaatgttggataatctaaagatatccatggtatagtctggagttagctggtaagaagagccaacaacaaattttagcttttcaattggaacattgatgcttctcaagatagctttgatggtcaattcatagtatttggccctatagttcaccacttccaatggcgccttcatgttgtccaaaaaggcgtgcaagtctgctaaaagaacagtcacttcacaacctgctttcaagaaatcagcaagcttggtcataggaacaaaataaccacaatgaggtcttccagtgggcgcggtaccccagtataatttcaaatgtctcttttgtacttcgagaacatctttgatgatttgtgggttcaagacttcttgcaagttcttggtaatgagaccgaacgcctcattagggtcaaccgtggcagcagaggacatgttatcgtcaattagagtatgcggttatggatgctaatctctttttgacaatgactaatttgtattctgaagaaagaacaattaattttcataaaatttttctactttgtaaatgttcgagttccgttcttagtgatgctcgaataaggaccttctcgcctccatgataaaataaaaattatgatagtaagaagtatggatggttcgaaaggttgaagaatagctagggaggcctattcgagtaagcgcaaggatgtccagacgcaatccaccaggcagtagaaacgggggaggtccgacgaatgcctctcccttcattaaaagagacagaatgagaagaaatttcctgaggatgagaatgggtcaaaacggcagcaattctagttccccaggcgtaccaaatggagacaacagcaggggatctcttgtcaaaaaggatgatcctgagtatgctgaagagagagagaaaatgcttttgcaaatcggtgtcgaggccgatgctggcaggagcaatgttaaagtaaaggacgaagatcctaatgaatataatgaatttcccttaagagctattccaaaggaggatttagaaaacatgaggacacatcttttgaagtttcagagtaaaaaaaagataaaccctgtaacagacttccatcttcccgtaagactgcataggaaggatacgagaaacttgcagtttcagctaacaagagcagaaattgttcaaaggcaaaaagaaatttctgagtataaaaaaaaagcagagcaagaaagaagtactcctaactcgggtggtatgaataaatcaggaacggtctcgctcaataatactgttaaagatgggtctcagacacctactgttgattcagttactaaagacaacacggccaacggtgtgaactcctccattcctactgtaactggctcttctgtccctcctgctagtcctactactgtatccgccgttgaaagtaatggactgtcaaatggttcaactagtgcagctaacggtttggatggcaatgcatctacagcgaatctagctaacggaaggccgttagtgacaaaactagaggatgcaggcccagctgaagaccctactaaagttggaatggtcaagtacgacggaaaagaagtgactaacgaaccggaatttgaagaaggaactatggatccactagcagatgtggcaccagatggaggcggtagggccaaacgaggaaatttgagaaggaaaactcgtcaattaaaagttcttgatgagaacgccaaaaagctgagatttgaggaattttatccatgggttatggaagattttgatgggtacaatacatgggtgggttcttatgaagcaggtaactcagattcttatgtcttgttaagtgtagaagatgatggaagttttaccatgattcctgctgataaggtttataagtttaccgcaagaaataaatatgctactttgaccattgacgaagcagaaaaaagaatggacaaaaaaagtggtgaagtgccacgttggttgatgaagcatttggataatataggtacaactacaactagatatgacagaacaagaagaaagcttaaagccgtcgctgatcaacaagctatggatgaagatgatcgtgatgacaattcagaagtagagttagattatgatgaagagtttgccgatgatgaggaggcacctattatagatggtaatgaacaagaaaataaagaatcagaacaaagaatcaagaaggagatgctgcaagctaatgcgatggggcttcgtgatgaagaagctccttccgaaaacgaagaagatgagttatttggggaaaagaagattgatgaggatggtgaaagaattaagaaggcattacaaaagacagaacttgcagcactatactcatcggatgaaaatgagatcaacccatacttatctgaatccgatattgaaaacaaagagaatgaatcgcccgttaaaaaggaagaagattcggacactctatccaaatccaagagatcttctccaaagaaacagcaaaagaaagctacaaatgcgcatgtgcataaagagccaactttgagggtgaaaagtattaaaaactgtgtcattatcttgaagggggataagaaaatactgaaaagcttcccagagggagaatggaatccacagacgacaaaagctgtagatagtagtaataatgcatcgaatacagtgccttcgccaatcaaacaagaggaaggcttgaattctacagtggcagaaagggaagaaactccagcgcctacaataacagaaaaagatatcatcgaggctattggtgatggcaaagtcaatatcaaagagtttggaaagttcatcagaagaaaatatcctggcgcagagaataaaaagctaatgtttgccattgtaaaaaaattgtgtcgaaaggttggcaatgaccacatggaattaaagaaagagtaggttagtttataatgttatgtacttaataggttatttagttttcgttcttttcattctttcctttttctttccatttaatcttatgtagttacattatactgtcattttagttgcagtaagtatacttttttatctagtctttttttctgccttttttttgagaaaagactcagaattctactaaactctaatatattgttatttctgtattatacaattctatgctatgtgaactgtccttgaaagtgacctaggccacttcgacaatttcatcttcttcgtcgtcatcttcttcttcttcactctcctcctcttcttcctcttccgcattctttgatggcatctcttccactgctcccgcacctggctcgcctctcattaacatattaacaattctgtaacataattcaccaatatcttcattctcaacgtttttatgcagctccctcactagtggataaacggacttgtctcttaagtattctcttccagcatgcgttgtacatagcaaaagaatactttctaaatgacagcatataattgcaggaatcgggtctctttccttgtcctctggtaataattgaagttcatctggtaaattgaacatatcttcctcatcaatttcagaatctttagcactagcaataggtagcaggatgtaaggcaacaagtttattttttcatctttgagtaacctttcatgagtttcagaatcaaatagggaatttttaattgtggaagcgacaccttctcttcttacctttgcatcatatttttcggtaaatactagcaattttgaaataggaacaaccccatcgtattcctgctcttcaataaaatacatcctgcccaatttaaacctcgagatatccgcaaaaaaaaaggctaaataattgaaactggcatattttgttaattttttatcataacccttaacaaagcaatccattaaacaatccatggctctcaaacttttgaaaacttctttatttaaagctgctaacttcaaaccatcatcgacctcctcaccgcttgaattccttttgatattcagaacagcaagaatgccgtcatccttggctaagttgcttaataagatacacattatatcggcatttggattggttaaatcgacaattttccaaaccaaaaattttaagaacttcttgtcatcgctcaatataatatttcttactaacttgtcttcagataaattgaccaatatagtgacaccttgctgaataataacacgggtgccgtgttctggatccatgatcatttttattatatccttaatgggtctgtagctatcatttttgaaaacttttgaagtgggaccagcactaaatccaactagattatcaatggcaatctgtcttacggcaggttgtggtgaatgcagaaattccactaattcattcaattgtgaagtcatcactcaattttttgttgatttttttgagctatttttaatttttaaattaaattgataccgttttaagaagaataaacttgtcgttattagagtaggtgcgtcataaattgatggatgagatgagagagctcaatatgaaaaaatgaaaaaaaaaaaaatttgaaaaagcccttcgaggaagaatagggaaaaatctacaataataattatcgtctggggtgataacagaacacatcgaaaggtagcactaccagtaacatcccaattggctctgcagctattagatgaaatatactgcgaattgcgaatcaagacatctattttttattcttgttagttttcgcggtaacaagtggagcaattgctacatactcgatgtatgaagagcttcagtaaaataatatcataacattatcgccatttttttggtacttgtttttccataagtgacagatgtcaagattaaaaaagaatatatttactcaacctgagaacctgctagttttatattaccttttatatattaatgttacaattggctctacctgaagttgtgttgtcattgctatggaatctggcaggacaccaaaaagtcacctatgcgggagatgaaggcatatttattcactaaaatctccttgacggtttccccttatattgaaaatgtgataactcctcttcaatgcttagaattacgtttcttaagtgattttctgcgtgctgttccagatggctttctatcaaattccttatttcaacaatcttttcagtcatcggcaaagcttgattggaagcttgaccgctatttaacagtaaatcaaatataacgccccatatttcttttttccaataccttttgaatgggttcttcaatttgcatcgtccattctgcagctggattgtttctatgaattttccaaaaagcatcgaatgtatgacgcctgctaatccataataatccgcttcataactccatggcttgcccgcacgcatttcccagcaatcttgctgatcagccttccaatttgatttgaatttcgttccaggtggtaacagtgtcatatcaaatgatctaccgaaatctattaaatagattcccttgttttcccagccatcctctccattgcgcatataatgagcacccaggggttcgcctggtttttctaatctgatcatgcagttatctggtttcaaatcgccatgtattattcccacttcatgtatcttttcaagtactttcattagctcgacagtgataaacatgcacaaatattcatccattattccgttgccgtcaattgccttttcccgttgtaaattaattaaatccaagaccgtaccttgactggcgtagtttaaaacaaggtagctctcatcaaggaacaagtgtaaagcactagcgttgattattgactttaatattgtgctcttcctcaacctaaactccacttggctcattatgtaatattcccatacacttgcaggtttttctactttcaacgctcgcagatgtccttgactagattctgctagatatacagtggcataacctccttcgcctaattctccgcgtatacaatataaatcacccgtcttcttgaagtcaacaattgggttcttgttttcgttgcgggataccctatggatttttttcaatagagaactcattttcaattcttggttgtagttataaaaggtgttatattggaataatgggggcgaaatttcggataaaaacttcgctcttaaattattactaagtgggttttcaataatgacaggcggttgattttttattttagtgaagggaggtatgatcgttgggtaatgctctttactcttttccgaatgttctgcagtttgtaaaagcttttctgcttgtggttcaggttgtgtgagaaatggagaactttgaatggttgtgcttgttaattgagtttgtgtttctgtattatcccccgatttcttatcttctgtccttatttgttccttaggtgtctggattataggtaccacatctgtttcagtagtttcttttataggcgtcatgtagtctgccttttctggccgtgtgctactattcgacaatctttcatatcgatcgttggtttcatttgttgaggtagtttgttgtgacaccgtctcttgtttaggatctttaacttcagttaaatcttcaatattctttgctgtaaattcttgggtaaaattttcgaagacgttgaatttacttgtagtggtatcatcaccatctaatagcgcacccggggttgaataatgttgattgaacatggaaaagacctcatttatagcgtcttttgaaaaagctgttactgtaggtgaacgggaagcgttggatgttagtgagggcttcactggtgtctcatgcgcgaggtttccatcaaccacaggcttcaaaggtaaaatagacgttgtcgtttgcacttgtacctgtgtatttttatggtgtgtgctctggctgggattatcgtcatctttaaacacctcaattcgcgtagatttggggacaacgggtggctgtgatgaaggtaagtcttgccgtctctctaccagcacatcgagcttacgtttcttcctatttttgtcacttgtataatcttcggtgtgcttcttacctctgcgctgtaccttgtaaagtcccttaatcattgccaatatttcttcggtgttgaactcctcatcattttctggatatattagattaaaattaaaaactatccgttcaggtttccgtcccggagtattgattagtttgtagactggattgttagattgcttttgatctgcatatattgaagtttttttatttccattcttcaagcgttggttagagggctgtttagagctattcaaattaagcctctctgtttctgacttaaagtcagcaaccactatagaatcttgatatacgttaggagcagacttaccaactccaacattagagttcaggttcgcacgattttccttgtcatcagtcatcaatgatgaggttaaaaatttacgaatgaaaaatggtgctgttctataaattaaccttcccttcaatctttcccttgaatcaggtacactgttctggttttctacgatgttcatttctcggagtctgtcttcataattgcttaatgaccttaatagtctgttgtaaggcctgcaattgttttcagcccctagttctaataacacctttgcttctagaaaaaattgagcattttctagtagcttggagaactcttcataaaataacgaaagctttgttccgattcccttgttaaacatatatttaaaagtattttcactctcgtggaagttgttgctaagaaacaaatttatataccaaatccaaatttttaaaaatctgggatcgttcctataggtttccatatcttgtatgtaaatcaagcatctttccattgtacttcggagaacttcttgacctgattcagaatctacttcaatatagctggtgctaatccatatcatataatctaaaaacaaatctaaaggatcatccatatcctctaaatcatttagaagtctctgttcataagctatttttgtctgattcagttgactatgctgctctttttgagatgagctaacgcctttcgattgcggaaatgtgtctttatctgattcatagcctcgtacagtagaacctaaatctaaattcatttcctggtcagcgttaacattcaaacaataggaaccgtcaataatctttccatgatgaaaactttatactctattctaaaatcacgtatattgtgtatgtatatgaacaacgcttttttttctttatttacttcctagcgcgtatcgaaagcgaaaacaatgaaagaccaaaaaaaccgtgtccgttacaagatgaccccatggacgtgaagtcaaacgttaaacacactcctaaaataaaaaccagctattgagcattaattagtagagaattcattaagacattaccttgaactattttaaaagttggcacaagttatggagtcggtagaataaaactcaactgtcatcagattcaatggaaactgaaccatgagaattggggggataaaaggattaatgagaggtgacgtataaaatcaagataagaaaccattacataaaacgttcaattgcctttctacttgcatgttttcaatacctcaaaaggagaatgttttgatatatgttatatatcattattgtcttcgctaagaacgaaatctaacaattctattttgtaatttacctattcagcatataattgttacagaattggatttttatgttccttgagatagctttcgatattttcttcgtacagcgtcgatgtctctagtttttatccaaccgcactttatattttaacgtttgatggttttctatcttggcagcgttagaacttgatgacaatttatggaacttagtttcctattagaaagggtaactgtggcataaatgtaatagaagttttcttcgagaattataaactgttagaataaggactacaactatcatctattgttggaatgaaactctaaattatcttttatttagtagtattcgttttactaatatattatcatatacggtgttagatgatggcataagttatgagaagcggtcattgaagttagaggaagctgaaatgcgaggattgataatgtaataatgaaacatataaaacggaatgaggaataatcgtaatattagtatgtagaaatatagattccattttgaggattcctagatcctcgaggagaacttctagtatattctgtatacctaatattatagcctttatcaaacaatggaatcccaacaattatctcgaaattcacccatctctcagaattattcacccaaatctcagaagactaaaaaagaaagaaatgtggataatcgagtctatagattcttaattacatattaaacctgagaggtcagatttccaataatagaatagccttgttggcgcaatcggtagcgcgtatgactcttaatcataaggttaggggttcgagccccctacagggctttctttttttctttaaaacacgatgacataaatttcctttgtatgaaccgtacccttaataataaaaggaaaaatcatgctttaggtataagactttctgttgtattaaaatttagtatttatttttattatgctattatttttttcggtctcaaatgttacttagtgatctacgaatattgttctaaaagaaattttccacttatagcaaggctagtaaagctacgagtacggaaaaaagttttccctctcttggtaaactctgagctaaatcagcaccgttagaaatttgaacagagtttgtcgagctggcttcggaggaagaactttggattgtagatgtgtatttgcttgatatctgggtagtagaactggtcacgtcattacttgatgttgcgacaccacccttatcttgtacaggactgtccgatgatacggaagattgttgagtagttggggcaactgtagacctagtggtagaggaaacagtggctggggtcttagtggaggaaataatggactcacttgtagaagaggaagccactgttttcttggatgaagaggaggattgcttttcgaatgaactaatggaactagatgtggtgactgatgaggaagcaagtgttttagatgaagtagcggtcgaagaagatggagatgtggatgaagaggaagatacagaagacgaagaagatacagtggaagaaaccgaggaagacacagtggaagaagccgaggaggacacagtggaagaaaccgaggaagatacagtggaagacgccgaggaagatacagtagaagaggatgtagagctgctggaaatactaccaccgttggctaaaactgcgaaatcttcttgggcttggtcatacctgccgtaaatagaaccaccgtcagcttcaatagattcccaagaaccagattggtcaccatatgtgtactttttaccggtagaataatcagttacaatgaccttttcaatgtacatagtgaatggagcgtcattgtagttggtttcaccaccagcccattcaatggtaccagcagcattgtctgggtcaccaccggcccagatacccatcattaggtacataggagattgtgggtaaccctcacttgatgtgtttgataatactctgacagactctccatcgaggtaccaagtcgtcttgtccatcgcccaatctaaagtgtagttatgaaatttgtcggtaggagtgtcgacaccgtgaaattcgcctctgtcgtatgttgtggtatcacctttagaaaagaagttagattggaactgagtgttgtcaccacccacccattcaatatcaatttcatccaaatcatcactttgtaaatagaatgatgaaacaataccggtaccattggcagcttttaagataacttccaatttaccatacatgatataaaagttagacttcaaacttggattatcgtatcttttcgccagtgtcattgacaaaccgtctgaaccgtacttgatttcacctgcgtgcttcaagtcggtaaaccatttggatgaagatgagaaatcttcgctaaaactagttgccaaagctgtatccggcgtacaacctgtagtttttaacgggttacacgaagcagtgctagaagctgcagttgtactgtctgcagtagcagtactttcggcagccgcgaatgtagataataatgaagaggcactgagtaccgttagtaggtcaagcactttcatggttttttgctgtattgaattattatgaatattatattatcttaacctttctcttgctatttagtagaaatgtagaatatggagaggagtaggcaattattgaaagttccaaaagtgtttcaccttttgttctttttcatgttactaaccagcaagtatttatataacatccattgttgcatgagggaaaccagtaaccatacgctctaattatatcacattcccgattcggaaacattgcttcttgatcgagcgaaaagaaactgcccttgcaattaataatgtcattttcgtatcccataccacgaaaagcaagccctcagaggttctaatgcattatagctcagatctatttttactttcctggaaaacgccatcgaaatagtcgccaaaaaaatcgatgggctgggaaaacgcgtcatcaattcaaccgaataaggaaaactaagccacttcacgcggttcgcgatatttgtccagcctctttttccgaaaaaaaaaaaattaaataataaaatgaaacggacaggaattgaacctgcaacccttcgattgcaatcttattccgtggaatttccaagatttaattggagtcgaaagctctaccattgagccaccgcttcatcttgaaatatcgaagatataacattttacttgtctgccgaaattctgtgtttgctataatgtttgaattagaatctcttaaaatagctactcatacttcttcataactaatccattagtgaccatatgaagtaatcggacgccacacatcattgatgtttcacgatggagaatgataacacactaagtggcattgtgggcaaagtaagttaaacacctattgctcaaatgatcaacttggtgtttgcacatatacggatgtaagtcatgacattgaaatcataatatgctttcatgataatcatatgagcatgtttaatattactaataaggctgtattctatacttctcttatatagaataagaagatctgcatttattcttgattgacactacagttcaacaattaattaccaacagaattaattactacctatcgttcacaagctactacgttatcatacacaatgtaaaaatatgacacaaaaatggaaaaccgtcatcagatttaatggggctgaaacacaagaattcataatgtgatagaataatgggtgaagtgtataaagaagaatatataatattactgtgtagaaatatcaatttccctttgtgagttctcataacctcgaggagaagtttttttacccctctccacagatcgatacttatcattaagaaaatgggacaccaaggttacggaaaaatctacccggtctacctaattactctcttggcgcactagttttccgaaaaaaacaggtaaattcttctttagataaagataaatataaaacttcacagccattcactcacacaaactagtcccttagggtgcgtataatgatctgtacatcttatttctatatatcttaccgtgtattttttcttttctcaattcttgttcgcaaataaaaagatattcgtgtttgtggaagaacactagttccgttttgtattcaacctggaaatttacaatagatcttcatcatcgtatgtctaccatgttaatctcccgttaaactgtttcacgttatcaagattatgtcatctattcctgggcgaacataattccttacaaaaacatttgtcattacacaagtgtaaggggtaatgaaaagtaattttgttacaagtacgcaaaattcgtttatttcaagaaacactaaggatcgtcatttccctttctgaccgatgttccttctttttgctatttttttcccgagtcatctcatcgttttgagtttttcctagtccattaaattgtcaccttactctcggaaaaaagaaacgacaaatgctcctagtgccgtttttcgaagcttgaaaaaaaaaattgcaaattatttaattttgctgctaaggagttgaagtaggtgcattccgccttattgatcaccctgttagatttgttgcgatcgttatagtgctagtttgtccattgttgtgtcataaaagatagctttgggagaaaattcatcaaaacaacatatcatcagcgttattacaattcattgtccttcccaagtttttttgacgtataatattatcgctatctgactcattagtacacaaatacagatatacaacctcaaaatcaaaaatgcctagaaacccattgaaaaaggaatattgggcagatgtagttgacggattcaagccggctacttctccagccttcgagaatgaaaaagaatctactacatttgttaccgaactaacttccaaaaccgattctgcatttccattaagtagcaaggattcacctggcataaaccaaaccacaaacgatattacctcttcagatcgcttccgtcgtaatgaagacacagagcaggaagacatcaacaacaccaacctgagtaaagatctatccgtgagacatcttttaactctagctgtcgggggtgcaataggtactggtttatatgtgaatacgggtgctgctttatctacaggtggtccggccagtttagttattgattgggttattatcagtacatgtctttttactgtgattaactctcttggtgagctgtccgctgcttttcccgttgttggtgggttcaatgtttacagtatgcgttttattgagccttcatttgcattcgcagtgaacttaaactatttagcacaatggctagttcttctacccttggaattagtggccgcatctattactataaaatactggaatgataaaattaattccgacgcctgggttgctatcttttatgccaccattgcactggctaatatgttggatgttaagtcatttggtgagaccgaatttgtattgtccatgattaaaatcctctccatcattggctttactatcttaggtattgttttgtcctgtggtggtgggcctcacggcggttacattggtggtaaatactggcatgacccaggcgcttttgtagggcacagctcgggaactcagtttaaaggtttatgttcagtttttgttaccgctgccttttcttattccggtattgaaatgactgctgtctccgctgctgaaagtaaaaatccaagagaaaccattcccaaggcagcaaagagaactttttggctgattaccgcctcttatgtgactatattgactttgattggttgcttggttccatccaatgaccctaggttactaaacggttcaagttcagtggacgctgcctcatctcctctggttatcgcaattgaaaacgggggtattaaaggtctaccatcattaatgaacgccattattttgattgctgttgtttccgtggctaacagtgctgtttatgcatgttcaaggtgtatggtcgccatggctcatattggtaatttaccaaaatttttgaaccgtgttgacaaaaggggtagaccaatgaatgctatcttgttaactttgttttttggtttgctttcctttgtggcagcaagtgataagcaagctgaagtctttacatggttgagtgccttatctggtttatcgacaattttctgctggatggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacttaagccttggcaacgtgttcaaccaagtcgacaactctggtagagtaaccgtattcgttgtcgtaccaggagaccaacttgacgaactttggagacaattggataccagcggaagcatcgaagatggaagagtgagagtcacccaagaagtcagaggagacaacagcgtcttcggtgtaacccaaaacacccttcaacttaccttcagcggcagccttaacaaccttcttgatttcatcgtaggtggtttccttgttcaacttgacagtcaagtcaacaacggagacatcgacggttgggactctgaaagccataccggtcaacttaccttgcaattctggcaagaccttaccgacagccttagcagcaccggtggaggatgggatgatgttaccggaagcggttctaccacctctccagtccttgtgggatggaccgtcaacagtcttttgagtagcagtcaaagagtggacagtggtcatcaaaccttcttcaataccgaaagcatcgttgataaccttggccaatggagccaaacagttggtggtacaagaagcgttggaaacaatcttcaagtcagaagtgtatttttcttcgttaacacccatgacgaacattggggcggtggaagatggagcagtgataacaaccttcttggcaccagcgtcaatgtgcttttgagcagtgtctaattccttgaaaacaccagtggagtcaatggcgatgtcaacgttggaagaaccccatggcaagttagctgggtctctttcttggtaagtagcaatcttcttaccatcgacaatgatgtgcttgtcatcgtgggaaacttcaccagcgtatctaccgtgagtggagtcgtacttgaacatgtaagcagcgtagtcgttggtgatgaatgggtcgttcaaagcaacaacttcgacgtttggtctagacaaagcaattctcatgaccaatctaccgattctaccgaaaccgttaatagcaactctaaccattttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggtcaaagtatttcgaatttgtgtccattagtggtgttccgtgtgagaactggtaagcttctttcatgaaagagttcaatgattcactcagtttgtcaaacggaatagaggcgggagcatggaacactaattgctcttcaaattctacaggagtaatctttggcttgtcggcagcttttgtttgagcttgctcggctatttttggtttgagctgtataggtttaatgttcgataaatcgagacgttcgttcttcttgataaattctgttaccttgttaaccgaatcttgtggtattttccctaggtatgctagcacatcaccctttaatagtctaccgttggaaccagatggcgcaatttccttcaaagccttttgtttggatatattgttctcagccagtagtaatgacacggatggtaatagcgtctgttcaagattggcttggctgccgtcaacggtttttattggtgtaactgtggctttttttaaatgttgttgtgttgcttcagtactatctgcggatggcttcttaatttcaatagatttcgcatttgcggtgttggcctcttggggtaactttatagtagctaaatcatcatcaacatcagcaatataagcaataggttcaccaacatcaacatctttagagccttcatctttcaggatcttagctagtttaccatcgtccagtgcttccacatcaatttgagatttatctgtttccacttctaatatcacatcgcccgcgctgaatggttcgccaactttatatttccaagacacaatcccccctttctccatagtaggagacattgcaggcattgaaaatgtctttacagcaagtaatttagctgatgcatgatagttgcatttggttaaatatcttgtacatgattttaaagtggagactttggaaattgcacttagcatttttgaatttttccctcgagatgatttaacaataacctagctctttcaatgctctcttatattctcactggaaagcgctaatttgatttgtctctctcgttgctggtcgctcaccctttcataaattgttttttactcttcatttattgattttactttttgtcattttccgaacggggaacaaaatgatgactacttgctacagtatacgaaacatacaagggcattgtcatgtgcacgcataataacggtgatatatatatatgtatgtatattatgtgtctgtgtttgtgtgtacttgtcagggcatgataaattattcaaacatattttagatgagagtcttttccagttcgcttaaggggacaatcttggaattatagcgatcccaattttcattatccacatcggatatgctttccattacatgccatggaaaattgtcattcagaaatttatcaaaaggaactgcaattttattagagtcatataacaatgaccacatggccttataacaaccaccaagggcacatgagtttggtgtttctagcctaaaattaccctttgtagcaccaatgacttgagcaaacttcttcacaatagcatcgtttttagaagccccacctacaaaaaaagtcctttctggccttttatttaggtagtcccgcagcggagattcatcgtaatcaaacttcacgattgtatcttcgttcagtctctgttgtgagcttgcgtttgaatccgaaagcaggggagatattcttaccctgcaacttaaagcctgtgattctacaatatttttggcatcgtgcctcttgtctttgaacttggccacctctctttcaatcatacccgtttttggattgaagataacccttttgtttatggcttttacgctaggaacgatctcccccagaggaaaatatacacctaattcattttcactactttctgagtcatctagcacagcttgattaaaaagagtccaatcgttagtcttctcataattattttcccgttctttgtttaactcgtctcttatcctctcccttgccaaagaaccattacaataacaaatcatacccatataatggtttggcagagttggatgaatgaaaagatgatagttcggagaggggtgatacttatcggtgaccagaagaactgtagtacttgttcctagggaaacgagaacgtcattcttccgcaggggtaaagaacatatagtggctaaattatccccagtcatgggagagaccttgcagtttgtattgaaaccgtacttctcaataaaatatttacagatggtacccgctatcaaatttttcatgggtgctctcattaatttttgtctgatagttttatccttagaagaactatcaattagatgtagtagctcatcactgaattttctttcacgtatatcataaaggttcataccacaggcatctgcctcctctaattcaacaagatggcccactaagatagaagtcaaaaaattagacactaaagaaatggtctttgttttttcgtaagcttctggttctaattgtgcaattttcagaatttgaggaccagtaaatctaaaatgggctctggaccctgttaattgagccattttttcaggcccacctatgcactcttcaaactcttgacattgctttgcagtactgtggtcttgccaattgggggcggtttgccttgcaaatgctacagagctcacgtagtgcaataaatctttttccggtttcttattcaattgctctaacagagattcggcttgggaggaccagtagacagacccgtgctgctggcaggaccctgagacggccataactttgttcaatggaaatttagcctcgcgatatttcgagagaaccagatctagagcctctaaccacatggctacgggacattcgatagtgtcgccgtgtatatagacacccttctttgtgtgataatgcggaagatccttttcaaattccactgtttctgaatggacaatttttaggtcctggttaatggcgagacatttcagttgttgggtcgaaagatcaaacccaagatagtatgagtctaaagacattgtgttggaaacctctcttgtctgtctctgaattactgaacacaacattaaagtactaatctcatcctccttttgtttttctcgagagggcccccttattcgtccgcctgagattgcattggccgaattgaaaagtgacagttatgcacctcagcggctattccctgcgtcgcttgctgaagattgaggattataggaagtagtaagctggaaatggtaatttgtaaaaagaaaatttctaatactgtgacaatgttattaaatcggggttgtttttgtttggggcggccagcggaataatttgttttcaaggacagcagaagctcagaagaacaaaatctccgtgatcttttaaacttttttccattctgatggaataatggtcttgatcccctaaatatttccttttttattgcaattatgatagaaattaatagtagtctatgctggatgatatatatatctcttttgagcttgcttcaaattttttcccgttataatgatgagtgttttgcttattaagggtctaggacatttctatcagtttctataccaaaagaagaaaaagtggagaattgtttgtttattttaatattttgttctttagttttaaaaattcagaagagaaaaaaattttatttgtcacaaggaaataaaacataaacaaaaaagaaaaattaagatttgcaattctgccgcttaagcaaaagtagatcattcactggaatatatatatataaacgcatttataatcttgtaacgtgcactcaatttagctacgaaagccaaccagcaaggaaccttttatttgagtaggtacatttacatcttcgggtaacgcggtgaaattgaaaaattttaaggcattaataattgaaaagctagaagaaatggatgaatgaatgacattgcgaaccattgtgcaatgaacatcatccaaaagaaaacatcatttacacatattttctttccagggtcccactggtaaaatctattaacatataaaaagatttacaaaaaaactttagtgccataactacagcaggatcatcatatgtcaagactagaaatatactcgccagaagggctacgtctcgatggacgtcgatggaatgaactccgccgttttgaaagttccatcaacacacatccgcacgctgcagacggttcatcctacatggaacaaggtaacaacaaaattatcactcttgttaaaggtccaaaagagccaagattgaaatctcaaatggatacctcaaaggctttattgaacgtatcggtaaacattacaaaattctccaaattcgaaagaagtaaatcaagccacaagaatgaaaggcgtgttcttgagatacaaacctccctggtgaggatgtttgagaagaatgtcatgctgaatatctaccccagaacagttatcgatatcgagatccatgtccttgagcaagatggcggtattatgggatctttaatcaacggtattaccctcgctttaatagatgccggtatatcaatgttcgattacataagtggtatatccgtcgggctgtacgatactaccccattattagataccaattcattagaagaaaatgctatgagtacagtgacactaggtgtggtagggaagtcagaaaaactttctcttttattggtggaagacaaaattccgttagataggttagagaacgttcttgccatcggcatcgcaggtgctcatagggtaagagatttgatggatgaagaactgaggaaacatgctcagaaaagagtcagtaacgcctctgctaggtagaataaaaaacgccattaattgccactgtttatataaaagtacataaaaaacagtaaaattgaaaattgaacgcatttacattttcgtgtttctaccgtaaagcaaaacgcttacagttttttcttacctattgatgcgaataaatcctttggtttcatagaatgctggaaaacttttctccttaagtgcgttacattttggttgacactagcaaccgtgttaatgacagtatgcttcttactcaaatcgtccgcgttcgcatatgcttccctaacgtgactatgctgcttatactcctcagctatgaaatccttatccttattagaggatgattttagcgtataatttatccatgtttgtatccccgtatcatattcatctagctcacgcttataatttctcaactgttctatcttaccggcgtgcgaagtcttactgttcagtagtttattcatatctaatttcggtaagttattctgctgccccaatttcgccatttcttcagtactgggttcatggacgcttgtcatttcgccttgagatactgttctgttttcacttttgaaagatgcactgcgcgctgccaaatcattggcagtattgttactattatcattatctgttgtactattatcgtttcctgcatttaattgttcctgtgcgtccatcggtagaggtggcaaattcgattggttaccaatcaaaccgggaacattataaatcgtattgttgtcgtatatagtcttagtgtccctgattgtctccaaatcgtcatcttcgcctttggaagggaatgcatcccaagtactctccatctctgaataagtcgatacaacacgtggtttcatactagcaggtgttaaatctactagcttcccgttagaatcgatcacgtaacctggtggcgctttcttattggctgtatcctgtacgaaccctgatcgtaaggcctcactgtccggcttccaagaatcaacatcagtggagtctttaactgaactttcttccaaaactttgtcttcatttatgtggtcttcctcatcgctgccatcgctgttttccaattcagaaccgctatttgacaaattggtattttcaatggtgtctatttgattaggttgcaatgctgaatcacctttatcatcattaccaatcattttggagaaataacctgatttgggcgccttgagactgccttcatctgaatcagagctcatacctttttcctcctcctcttcatcactcgtaagtagaatggaacctttttccctattagaaaatttatagctatctgtatcttcattttcgtcttctatggattcattatcttcgtttttgtcttctatggattcattatcttcattatcttcttcttctgtctcatttgtcgaatattttattgattcggtatacgacaatgcatcatcgtcagttgtatcaagttgtttcgattgccggttaatatcagcatgtttatcactaaccgaagatcgattatcatcatcactactaccactgttgccttcgttgttatcatcttcttcagagtctgacgaatgctgataatcattgaaaaaagaatttcgatatccattatcactagtttttgtttcatttgctacgggtttcggctttgctactttatcttgcccactagatgtagagttcctattcctaatactagtcttttcttcacttttttctttcttttccaaagctcctgagctctcgacttcaccatcatcttcttgttgtaaattctcctctttctccgcaggcagaatatctgcaaggtagcctctttcggaaactttaaactcgtcgtctttctgctcagaaacatcgccatcactactcaaatgttcatttccattccttgttggcgtattgaaagtggtatcagcttcattagtatccattgaaacccctaaggaatgtgatttttcatcttcttctacaggagatgatgaagagggtaccgcttcccctaatggtgcttcgttttggatttcgtcacaactgtctgaatcacgccgaaaatcagatgtttgcctaatttctggtgtcatctcccttgatatttgctctatcaaattgtctaggtcttcgtttacagccctatttgtatgtggtgattttttgttttcacttggacttttcaaagatgctgtcgacgaaagataatctgatttggagtgctcgctggattttttcgcttgtaattccacagactctcttgaagccataagtttaggcaccccatctgagagatagcctacttccttgtcactaggactaatatcactcttactgacgttattatcattgctgtctttattttcacccgtattttcatcatgctcaccattaacatctgtataattgagcttgggtaaactaggcaaattagatattttttgcttgtgaatttctgaaccttttgtgccatcctcggaagagtagtcatattcgtcactactgtcccatccagcgccgtcataacttgcttgagatgcgctaacccatctatacgatttctttctaccgacctgttcagtgctcataataaatatccgctttccagaaaaagggtaatgatcaaacagtcccttttaactataatgcaagttttgtgtttaccttgttaaccatgtatgaaagtggtatttaggaatacttttaagtgccttacagaattcttggcatgagaaaaacaaaatagctacccggaatgaaacactaatgtgtcaccaaacaaacaaacgacgttatataattgttgtgatatttgcatcttcatcttatgatgatgagaatataaataatttttaatcgtattaagtgtatatatgaataagctattaaccctacccattaatttccgggcgggttgttatttttatcagtattggcctctgccgggcggctagcacgctgggtagctgctgcgacagcggcttctgctgcttgcatagcatttttttgcatttttttacctgcaaacttcatacaaaatggcatcaaggatgtattgagggcaacccatgccacgagaataccgtaatttcttcccatttttcttttggttaaattcaaaaaaatcactttatagatatccacggcattatggattggcattatgtagccgtacctgtaaaattcgttgttcaaaaccattgggtagaatgaagcagaaatatttaatatgatccacgtcatcaaccaaatactcaggtatggagggcagtaagctataactaagctgagaacgttttcattggcaccaccaacagccatcattaccaaccacgtagacatccaatatactacgaatcctcctctgccaaaggcgggggtgaaatcgatcctaaaaattgcagatacggtacagaatccaatggaaagaagaaaataagttgcccaggaaattagaagcctgtagattaaaatatgctttggcttcagaactctggccatttctccgtgcaacttaccatataatgacagttgtaaaacggttaacaaaatacaataaatcagaccgacctgcagaggggccattagaatacgatcagcaaagggacgataatcgttgtaggtgaacaacaactgtcctgcaatcgcccagttctccatgtttatattaagatctctgtcattagaagtgatgttgctcatcaatgagggaagatattccttgacgtaatatttctgaaggcggacctccaattgttgcatgagtggtagaatggtcgatttaacactcgatgggtcacgaccactttcaaacacggattcaaaaaaaattgatgaattgaactccgagtttgcgtcttggctaatcaaagaattatacaaagtgtctgtagcattaggtttaacgtttaacgccagccagtatctctcatcgtaaattaaatcgactatctttctgtcaatttcggtggagttcgtcgtaccaaatttcctatgaaatgatgttgcgttgtatatatgccatgtcccggggacagacgctaacaatgagggtatgatcgcggaaatagattgaactgaagtattagatggcgcatcctgcaatacaacaatatttttcactttgaaaaagtaacgatctgttccgtaacaggcaccccagtaaatcgatatgagcgatacacacacacaagcaatgaagaagttgttcaaaacaaacttcgagagaatctttttcctatgatttcgcagtcttggagaaaaaagccctgtttgaattcttgccaagggaccgccgtcgttaccgcccttctcttcctcattagcgccaccttcccccacagatgacaatgaggacggcttttcatcaggaggccgatagtcttctaatgactttgctaagtcagaagaatggccggaaccctcagcaaatcgctgattactgtacgaaaccccgtccctgccgccagtaaatgcagctgctgctgcaaaactagggtcctcaatgtactgtgactcttcatcaccaaccgatttagtcatatttgttctctgtacggctacttacacttatgtcagtacccgattcttacggcgtataaaagattaaagaaacaggatatgtggcttgatatatacaaaaaaaaagaacgatatggagtacactatgtatctctcaacaatgctaagatatgaagacgcttattgactacgccagtccgttttccattcccttcttcgaatagggtggcccgttgatgacaaagctgcgagtcatctatcatcaaacaaactcacggctttcgcttttctttagtctatttcggattgtaccacctcctcggacattcataaaaggattcgaaaacgaataaccacgcatatacacggaaataggagaaaactaaacgggaatcggtttatttttttctcaacatttctttttcctgattttccatccttttcgagatccacctattgtggtgaaaaataacgaaaatatgtgctttaggtgtgcaaggcataatgtgtggcatactggaaggaacaagttgaacacgccagctggaaagaagttcaataccaacttgcccaatgcctaactcaaatgttcggattcctcctactgttccatcgaagataatagatgtggtcgaccaagcgctaagagcgcgactcttaggtggcagcaccttcaattcagggtttgatagtttagattccgtacttaacttacagtttagactacattaccatgttattggatcgaatgggcctgcaaaaccagtttgtgatgttttactgaaggaaagtcaaaatttagaaaagaatatgagtatgatggaggagttgaatgactatccggagattacaaaactagtggagaaaattctgttcaattgcctcggtattcttttcttccacaggggccaatttcaggaatcgcagcggtgcttgctgcactcgttgaaaattcataataacactgcatcgcaaaaaacagcacttatggagcagtatgataggtatttgatcgtagaaaacctgtactaccgtggtctagtttcgcaagacataaatatcatgcaaaatgttttttacaaagaactactggcccacgtggatacgatccctcccgaatcaaacggtcttcttttcgaatacatcagcttgatcgtcgcaaaactcaggttcaatcaaattcaggatttagcagaaaattttaaaactaccgtcgaaaatccttttattcttttcctttacatgataaagaagttccagtcacctctcaaaaagcacattgataatgatgatctttatttgaagttcggacagaacgttttgttgaaggccaaatttcctactgctagtgagacaaatgatgaagctttggagcattttaatgtctttttgcagtattatttcaaattcactcacataaaaaaaataaaagtgaatcccagttggtataatttcataatatcttcaatggaaaagacttttcaaagtattgaagtttcgaaaacagcaatgtttcttttccaaaacctaagcgataacagtaatgacgaaataaagaagaagacatttaaaagagaatctatactaaattttgttaattttgtgaaatacaacgacaagtactatcaactgcacgataactcccaccgtgacataatttcattcattgatgcgtattcttttattttacaaaactcctccaaaaccgattcaatcgaaaatgtttttgattacgataatacggtatctacgtttgcgacttccttgaattccttctacaaagaatataatttgccattaatgagccaatcagaatctttagattggctagaaaacagcaccagatgtgtatacccaggaaacatttcgaaagttctaacaaatgcgtggtcaacattgtacgaaatcagaaaatatcagttagattttcttgtatctaataatttgacttcatatctatgtaatgcaatgatgctgtccacaaaagaaaaagacaatgctgatgtagaagagcaggaagaaggagaggaggagaaggcattacgtgaattacaatttaaatattcttacactctagcacaacagaggcacattgaaactgcaatcaagactctagaatcattgatattaagtaaaaacccaaattactacaaagcttggcatctattagctctttgtaggtctgtgcaagaggataaggaaatgtcgtacaagatagtttgctctgttctagaagctatgaatgaaagtcttcagaacaatactttacttctgaatgatagatggcaatttattcacctaaaattaacgcaattggcgctaattgaagaaatttttggcactttagaggcactggagacacttccagaggtctttgaattatacgcaacattatttccagattcacaacctgaattgaacagcatgggtcccaaatattctcaaactaaagaatatcttttacaaatggtgtggatttttgctgcaaatatgtacatgagaacaaaagacaatgatgaggatgccaaggccgccatcaaagaagcctccaatgtcgaaagtaaattcaagaatttaaattgtaatattgctaacggttatttatcaataataaaagatgaaccaggcgtggcattaaaggaatttgaaacagttctgtactatgatgagaataatttagatgccttggtcggattcgctgaattaattttccctgaagaactaggcgtcgaggaaactaatcttgagcgttattatactctcagccttgataaaaaaccaggtaagagggccaaacttacgttcgttaatgacacagataggtcagcagcgtatgcaagactaaaatttctattggagtgcgcaatactagaatcgatcgaggcttactattccccagaagtttggtggtatttgtccctcatttacgagaaatatcaagatgacgagtacaaaaactctttgctaaaatgtattaaataccaagagttgaatcccattcgctccctaaggtattgcaattactaacgataattcttctgatatatacacacacatatatacatatgggcgcaagtatattctggtgtaaagatactcatagaaagcataaagatgtaattcaatctagttgtattatattattcattgatttatattaatttgatgaacaatggaacatcttctcttcaataacggttttgcccatatacttgacgttattaggttacccgtttttataaatgtaataagttcaataatttgaaaagagcattagctatagtcacgtttcgcgttgaaacaattctttaaattatcttctcttggcagtttaatataccaaacgatagtcctaacatactgtttttcttattatttaccaatgagtaaagccaagggaacgggattttcatcaattgatactgaagatgaaaacttacgcgaacgttatgttaatcaaccaaaagctaatgcctccgatattcaagatgaacaattagattgctttgagcaactagaagaaaaacataggacaaaaaaaaatgaagaatacactgcgttgaaaattttaagggatgtcataggtccccttttattaactataacttcgttttatctaagattccaacatatagatcagaacaattatgttgtctgggatgaggctcattttgggaaattcggatcatactacatcaaacatgagtactaccacgatgtccaccctccacttggtaaaatgcttattgcattgagcgaatggatggcaggatttgacggtcaatttgacttttcctctaataatgcatatccggaaaacgtaaactttaaactaatgagacaatttaatgccacatttggagctctatgtacaccagtagctttctttacagccaaatggatggggttcaattattttactgtttatttgattgctacgatggtaacgttggaacattcatatattgtcctctcaaaattcatattgctagattcaatgctgctttttttctcgatgacgacttttgcctgtatgataaagttgtatacgttgagaaagcaacaaatgacgaaaaaatggtcgttatggatgttattaactggtttatctattggttgcgtttgttctgtgaaatgggttggtctttttatcacagttgtagtcggcctctacacatgtatagaactatttttgctctattgtgataaagaattgcctagaataaaatattacaaacattggcttatcagaatcattaatctgatagtaattccttttcttatctatctctattgcttcaaaattcactttgtgttgttgtacaaatctggcacgggggattctactacaaatacgttatttcagataaacttggagggaactcagattgaggcgggtcctcgtgatgtagcatttgggtcagagttaaccataaggtcgcatggtttaagcccgaatctgctgcattcacatattcaagtatacccagaaggctctggacagcgccaaatcactggatatggattcgcagactctaataatgtttggaagtttgaattttctaggtcttctggattggaactagatcagaacgggactttgaatggcaaaataatcccaataacggatggtgtggaagttcgtctcagccataaaaatacaggatcgaatcttcactcgcatgatgtaccttctcacgtctctagaggaaattatgaggtttcaggctatgggtcacaaagtgttggcgatgaaaaggatgattggatagtggagattgtgaaacaaatggattcaccaaatcccgtctattctaatgagaattcaactattttacatccagtttctactttcttcaggttgagacacaaagttttaggttgttacttggcttctactggattgacgtatccagcttggggatttaaacaagctgaaatcgtctgcaaagactcctggagtcgtagggacaaatcgacctggtggaatgtagaagatcactggaaccacaatttagaaaccgcagaagattacgttccaccaaaatccaatttttggaccgattttattctaactaattttgccatggcctcctctaataacgcgttagtgcctgatgaggataaatatgatagtttatcgtctgatgcatgggaatggccaaccttgcataaagggctaagaatgtgttcatgggcgggatatatcactcgatattacttgatgggatctcccttcaatacatggatttctactgtctccttaatcatcttcccatttattattctttttatattatatcgttggaggagacaaacgctttatctctcagacgatcaaatctggcaaataacgatacagggtatttttcctttcatttcctggatgacacattatctgccttttgcaatgatggggagagtgacgtatgtacatcactacgttcccgctttatattttgcaatgcttgttttcggatttgtgcttgatttcactttgacaagagtccattggatggtcaaatatcccatctatttgtcattgtttggcggatgtatatacatttataatttatttgctccaatatgtcagggtatgcatggtgataaagcggaatacttacctttgcagtggttatctacttgggatatcgcaccttagtaaaaaaaaaaaaaactccaactcctttacacagaatcacgaaaattgtaaataataatgccaaataaaggcattaacttattatcctcttcttttcacatgagaaatgatatagatattgcctattcatatgctaatgagtatatacgggtggacaaatcactacttcctacacctaaaaataatttaccgtttctctttaaatgtgaccacctcaatcttgtaattttgtctgctggtgttatatcctcgtttagctgcgttattaactcaaactttcccaaagtataactgtataaataaatctcaccgttttcaagacccaccgatatcaaaattttctctcttatcatgctgtcatgtatggaaatagcagtgacagctttagtgtgtttaattgatgcttccagaacgtagtcatcagctggctccttttggtgcctccatactttgacagttttatccctggacgcggtgacaaaaacattaccaaactctaatggtgcccagtctgcatcccatataatccttgtgtgtggtttttcatttttgaatctcaattcaaaagtattatcttccatatttctttcccaaagcgcccattttctgtctctacaaacactcaataaaaattttccatctttagagaattttaatcttgttatcgttagactgtggaacggtaatgcaggctttatttctaaccaattttctgtgctgaatattctaataactgcattctgaacattatttgatctacaagcagaagcaattaatttctgatccggagaaatatcaagacacgttatttcaaaaccatgtccgtaaagcttttccacttcaggccataacaagtgtctttgcaattggtcttccataggtggacattctagcaaggacaatggatcagtgatatctggtgtttctttattaccaccttcctcctcttcatcatcttcatttgcgtcatcctcaccagctttattagacaaacctaacacaggaacggtagcagagtctggcatttcacttttttcctcaaattgaataccaacaaacttttgtaacattcctgccacccctttaggtaggtcaaatgatctcaagattttttcatcaccaccacttacaaatctggtatccgtcactgtctcaacacaaatcatatcataaccatgtatttgtggcctagaaaattcatgccaggtagctatttccctttttctcccgctggcatcataaatccatggagcaaagagtctagtggtctgatccagagaagtagccaataggtactcgccgctaggagaccaagcaatgtccgtcacatccttcgtggcaccggatatgcccaacctttgatcgcaaataatattatcctttgtagcccacatcctccaggacccagtcttaccattggtcaaaaagaaatccattctctcatgagtaaaccatagacaggaccaaaaacctccagaggaacccgttgcagttgaggcaccttttgaggacatttctcctaaccgtagactgcacacccaaatgcctgaagtctcatcaggttcccataccatcaatgaagtatcagcagtagcagctagtagttgtaagcgactttcgtgccactgaagggatgaaatccaatcatcatggcccataattaaggcttcaaaatttatgcctactctcaattcatcatcaatttgaaatttatattgtttattgctcaataatgttaatttctttgaatcttcttcagagtcatcgattaaatcgttaatcctaattctccacaatctaatataacggtcctgagagccagagcataacaaataatcacccggagtttcctggtgacggaaagccaatgacttgacccagtcttcatgaccttccaattctgcaaccactcgacacttctcaatgccagaatcacttaaaatgaaagatgcgataaaaacgttcacattagtacccccaatggcaagtaaatactttttttcttcaacttttgacagtgataaacacagtggatagaagaatcccttttttatggtgaattcatgagcaagaccaaactcatcattttgaatattttgtctccatatgctgatagtaccatcagcacaaccgactgaaataagacttggtaaagcgcttaatgccacaatcgtcttcgagtaatgttgaatggtttgaatacattgtaaatgtgagtaatcagtaaatttccagatcttaacatgatgatcctcagatgcagataccataaaatctgaatctgggacaaatctgacacaagtcacttcagcttcgtggcctttcaaagttgcataaacacctttattatttggttcaatggggtcccataatgcaatagttttacctgcgccaaatgcgacgatttttttaactttgtgtatatcgctaacctgagtttgcttgttagcacctataaaaatggcttcgggagtgatacattccaccatgattatggaacgttaactatataaagtttttgcaggaactgggatatacaaatagatatactagtctctacgtgcaattgtaagctacctctgcccatcgcctaatattaaaacaaaaaaatttttcatctatttcaatatcggacacttttcccgtcacgtggaaacggctgacaaggttaataagaagaaatcgcttaaaggaccgacccaggctataaattatactgatctttatacactatactcttatttaatgggttgcatctcagtctcacacattttgaaactctcaaattcaccttcaaaaaagcgggacttaattactcgattaaaccagcgcgtaacctctggatgcttagacctccatgtttcatcgaaaaaacttataaaccctagcgaaaaagcagccgctgagattaaatcagcaagagtttcgtggtcatcacagacaaggtattgctgtttctttaaccttttctcgtaaagcgaaacaatggtgtcgacattctctcttgcggctttgaattcagtggcattatatggctttacgccaattagagggaaaaacacctcacaaacctcattcaagaaatcactgttggaaagcgattcccatcttaaaatatctgcacgagttttgaagtcaccttcgggacccaacaactggcgcacagcttccttgtcgctcgacagatggatcaagtagtagtcaatagccattgcctctgtaagcgtccactcgtcatgcggtccaacaaaagttgggtacttacgcaagggaaactccctttcgtaaagttgctgagcgtcacttggatcagcaagcttaacgtccagcttcaaggaacgcactaaacctcttggcacaatggtcctaatcaactttctctccttcaaatcagtaaacagtgttccgtcagacatttgtagttttctacacaaagatgccgaaatcaatgatgagcaagtatcgagttcgcttcgcactgctacatctaggcttttataaggggtggtatcgtttaaaggtgcggctattaaaagggatgaatacgtgggaaacggttgcattacaggaaaaacagctttttatcttattatatctttaaatatgtacatacgcttgtttatacgtggaggcgacaaaaagggttggttgaagggagagagaaagagacgcacagagattggaggaggggctcagttcgctgattgtttcttcttctgtgttaggttttccaaagttaacctgtcgttgtcgtcgtcatcttcactgggaggcgttgagttagtgtttgaatctgaatctgaatttgtattcgtgttgttagaatttgtgtcttcatcatcttcctgactgaaaagatttccattgtcatccggtgatttagcggtagagttttcgcccgtaaattcgttggcaaactctgtagccggagaggcctccctgattagcttcctagtaaacggatcatccaaaaaattctgttttctttgtcgttgattttgtttctttaattcattgcctattaacttggagtagagttttttgcccaacgttttctttagcaagatttcacggacttcgaagtacaagtctctggaggcgttattcaaatttgtctggtttttcttgaaatatgacctgaattcattgatgtgttttttgaactccagttcgtttttcttcaaccaagaaacgttcagctcctgtctggtagcaccccttgcaaagtttctcatcaaatatttgtcataatctctgatgatctttgtgataatatcacttgtagagacaccattggttctttgggtagtcaagaattttcccatctcctttattggcttgtagatatcgtcgctgtcggcgctaacgtaaggaatatcgtcatgtgccacgtagtcaatcttgtgttctagtagaaattctggggtgacacaccagggagcgttgggcacgacttcgtcaacccatctgcagtgcgttaaagtttcacaacgctgcttatcggtcagcacagtcaaaccttttagtttgtgagtgattttgtcgctaggcacaccaactatcagtgttacattggggaaagccttcttacactgttccagttgcttcatgtggccaagatggaaaagatcaaaaacaccatctgcatatatcctgatgggtctatccgttggaggcaaattgaatctgaaacctttaggacgatacttgcgcagttccttgggcaactcgttggtgtaacgagcctccttctcttcaaactccttcgtcaaccggcgacgcttgcggggagtgagctgtgtgtccttattttcatcctggttcttactctcatccttatcctcattgtcctgctcttccgtttcctcacgctgtcttttatttttattttttttaaataggtttgatagcgatgagttagaaagcttagccctaatcgaggacttccctgttgttgggtttgccatttttctttgtgtctgctgtgctttgtactaccaagagagaatagcaagagtgaaatttgaaagttaaacaatacaataaagaaaagtgactggcgtatgcaagaaaggggaatgggtataaaaaatacaagaacggcagaaaaaataaaagaaacaggagaaacaaacaatggtaactgtactaaaaccaataccagatatatatttcatacttattaaaaagcgttaagaaacgaagcgtaaaaacgtaagaaaaagaatgactatataacggtaggtcttcgactcatttttttcttcctacatgcaaacgacaaatacgggtaatgcacatttcgcttattgggttcttccctttccttttttccatttttttctttctggctgtcgctagcctttctacttcctccgcacatacagttttcagcacagtatagatagctgtgcagccagatagaagcaaaagagaagtcaattgcaaaaaaaatatggactcgtactcaataacaaacgtaaaatacctggatccgactgaattgcatcgttggatgcaagaaggacacactactacgctgagggagcctttccaggtagtggatgtgcgaggctcagattatatggggggccatatcaaggacggatggcactacgcctattcgcgccttaagcaggatccggagtacttacgtgagctaaagcacagattgttggaaaagcaagcggacggccgcggagcgctgaacgtgattttccattgtatgttatcgcagcagcgcggaccgtctgcagcgatgctgctgcttcggtcgcttgacacggcggaactttctcgctgtcgtctatgggtgttgcgtggggggttctcgcgctggcaatccgtatacggtgacgacgagagcgttacggcgggttacctacccgatctgtggcgttgacaggtttacacaatcgcacgtgatcatatatttgccatgactcctcccagtgacaattttgttcttttttcctctttatcgctttcgtactatggtcagtcattcattcattatatacgcgctctccataacccgtaactttttattatatatagactcgtttacaatacaacgatagcgataccattcaattgaagttgtgagaccaggtaacgagacgaacacaactttacaagtcaaataagaaatcatggctggtcaagtgttggacggcaaagcatgcgctcagcagtttagaagcaatattgctaatgaaatcaaaagcattcaaggtcacgtgcctgggtttgcacctaaccttgccatcattcaagtaggcaacagaccagactcagccacatatgtacgcatgaagcgtaaggcagctgaagaggccggcattgttgctaatttcattcatttagatgaatccgctactgaatttgaagttctgcgttacgtggaccagctgaatgaggacccacatacacacggtattatcgtgcaactaccattacccgctcatttggacgaggatagaatcacctcgagagtgttggcagaaaaggacgtggacgggttcgggcccaccaacattggcgaattgaataagaagaacggacacccattctttttgccctgcacgcccaaggggatcattgagctgcttcacaaggccaacgtcacgattgaaggttcccggtccgttgtgatcggaagatctgacattgttggctctcctgttgcagaattgttaaaatctctaaactccaccgtcaccatcactcattctaaaacccgtgatatcgcatcatacttacacgacgcggacatcgtagtcgttgccatcggccaaccagaatttgtgaagggtgaatggttcaaaccaagagacggcacttccagtgataagaaaaccgtggtaattgatgttggcaccaactacgttgctgatccttccaaaaagtccggtttcaaatgtgttggtgacgttgagttcaatgaagcaatcaaatacgtccatctaatcactccagtgcccggtggtgtgggccccatgacggtggctatgttaatgcaaaataccttgattgctgccaaacgccaaatggaagaatcctcgaagcctttgcagattcctcccttgccattgaagttgctaacacctgttccttccgatatagacatctccagagcacaacagccaaagcttatcaaccagcttgctcaagaattgggtatttactctcatgagttggagctgtacggacattacaaggccaaaatttctcctaaagtcatcgaaaggctgcagacgcgccaaaatggtaagtacatcttggtgtctggtatcacaccaacaccactgggagagggtaaatccactacaacaatgggtcttgtccaggcactaacggctcacttgggcaagccagccattgcgaacgtcagacaaccctccctaggacccactttaggtgtcaaaggtggtgctgcgggtggtggttattcccaagtcatcccaatggacgaattcaacttacatttgactggtgacattcacgccattggtgcggctaacaacctacttgctgccgctattgacactagaatgttccatgagaccactcaaaagaacgacgctaccttctacaacagactagtgcctagaaagaacggaaagagaaagtttactccctccatgcaaagaagattgaacagactgggtattcaaaagaccaaccccgatgatctaacacccgaagagatcaacaaattcgccagattgaacattgacccggacactattactatcaagagggtggtcgatatcaacgacagaatgttaagacaaatcaccattggtcaagcccctaccgagaagaaccacacaagagttactggattcgatatcaccgttgcttctgaattgatggctattcttgctctttcaaaggacttgagggacatgaaggaacgtattggaagagtcgttgttgctgctgacgtaaacaggtctccagtcactgttgaagatgtgggttgtaccggtgccttaaccgctttattaagagacgctatcaagcccaacttgatgcaaactttagaaggtactcctgtcttggtccatgccggcccatttgccaacatctctatcggtgcctcttctgttattgctgatcgcgtggctttgaaattggttggtaccgagccagaggcaaaaacagaagctggttatgtggttactgaagcagggttcgatttcactatgggtggtgaaagattcttcaacatcaagtgccgttcctctggattgacacctaatgctgtggtcttggttgctactgttagggcattgaagtcacacggtggtgctccagatgtcaaacctggccaacctttaccttccgcatacactgaagagaatatcgagtttgtcgaaaaaggtgccgctaacatgtgtaaacaaattgccaacattaagcaatttggcgtccccgtcgttgtcgcaattaacaagtttgaaactgacactgaaggtgaaatagccgccattagaaaagccgctttggaagctggtgcatttgaagccgtaacctctaaccattgggccgaaggtggtaaaggtgctatcgacttggccaaggccgtcatcgaagcttccaaccaaccagtggacttccatttcctatatgacgttaactcctccgttgaagacaaattaactactatcgttcaaaagatgtacggtggtgccgcaatcgatatcttgcctgaagcacaacgcaagattgacatgtacaaggaacaaggtttcggtaacttgccaatttgtatcgccaagacacaatactctttatcccacgatgcaactttgaaaggtgttccaaccgggttcactttccccatcagagacgtcagattgtctaatggtgctggatacttatacgctcttgccgccgaaatacaaaccattcctggtttggctacctatgctggttacatggccgtggaagtcgatgatgacggtgagatcgatggcctgttctaagacaacttaattatatagaatttaataaagacaaatgcaaaagtttttttaaagtatggatgtataataataataacgataatacgaacactattgggactaataatgatttatagttttttttacacaggggatttaacgttccgcgaccctttttcctttaatttaaccccagttccttaacgtcgaaaatttccgattccgttaaggaggagaaaacctaattaccaaacgaagcggggagacgcattaatgagaacaataaatgtatgaaacttttagcaatctaaatgatactataccaagacaagcgaacactggctagcacaatatttgggcggaacgaaataaaataacgaagatatacataagacacaaaggaaaaagcgttccattgcatctctgaagtgaataatataaaaagtagtaaagctagaaatgtgtgataagtcaaaaacggtattggactacacgatagaattcttggataaatatatacctgaatggtttgagacgggaaataaatgccccttgttcattttcttctcgggcccacaaggctcaggcaaaagttttacaagtatccaaatctataaccatttgatggaaaaatatgggggtgaaaaatctatcggttacgcctcaattgatgatttttatttaactcacgaggaccaattgaaactcaatgagcaattcaagaacaataagctgttacaaggacgtggtttaccaggtactcatgatatgaaattgttgcaagaggtattgaacaccatcttcaataataatgaacatccggatcaagatactgtcgtactacccaagtacgataaatcccaatttaaaggagaaggggaccgttgccccactggtcaaaaaatcaagctaccagtcgatatttttatcttagaaggttggttcctcgggttcaaccccattttgcaaggaattgagaataatgatcttcttactggggacatggttgatgtcaatgccaagctcttcttctatagcgacttgttgtggcgcaacccagaaatcaaatctttagggatagtattcaccaccgataacattaacaatgtttatggctggagactacaacaggagcatgaactaatatcaaaggtcggaaaggggatgaccgacgaacaagtgcatgcttttgtggatagatacatgccctcctataaactttatttgaacgactttgtccggagtgaaagtttaggttccattgctacattgacgttaggaatcgactccaacaggaatgtatattctacgaaaacgagatgtattgaatagtgatgttatgacctttttttttacgccttttttttttttttttttttttttaatttatctcacttttcccttctattttatgtactaacagataattttataatgatttcatgtatttttggttcagaattttgacaaggcaactcttgaataattgtcgtatgcaaaaaaaattgtttatctgttacatatccatcataaaacttttatagagcttttattgtccttcttatacaaataccgttcagaggctgtccgagatttaagcggttttggaaaaattactgctattaattaagattaaaaaggaaaggaaaatagcaatgggagcttatcgcataaaaaaatgaacaataatgttgaagaactcctacggcgtattcccctctacaacaaatatggtaaggattttccacaagaaacagtgactaggtttcagatgcctgaatttaagttaccagcgctacaaccaacaagggacttattatgcccttggtacgaagaatgtgacaatatcaccaaagtctgtcagttacatgattcttctaataagaaattcgatcagtggtacaaggagcaatatctgagtaaaaaaccaccgggaattgttggaaacacactattatctccatcaagaaaggataattcctagttaaattgcatttcgatatctatgtacacatatacagcaatttttttttataaaccttagtaatattatcagttttcattttatgtcatttgacctttgttgcatttaaatggccttaacttcttttaacttttcaatcaattcatccacagaattcaatttcacaccaggtgacttagtctttggctcttccatcgacactatctttaactgaggttcaatattaatttcaggaaaatcttttgctatatccaatttttcaataggctttttcttcgccttcattagtttgggcagtcctacgtaacgcggagtgttcaatctcaaatctgtagtaataaccattggtaaggaagcttcaattacttcttctccatcgtcaatttctcttgttacctgaactctaccattatcaaggaattccacctttgccgcatttgttgcctgtggccaatttaataaacctgccaacatctgaccggtgttgttacagtcatcatcaatggcttgctttcccatcaaaaccagattagaacccttcttttcaacaacagcttttaagattttagcaattgctaagggctctatgttttctttacccacagagtcaattaaactacaggtgtctattcccttagcaaggcaatttcttagaatatcctgagctttggcggagccaatagaaactgcatgcgtagattctactaaactcttgttcttttctttaattctgatggcttcttcgacagcaatatcatcgaaagggttgatactgaatttgattccactggtttcaatcccagttaaggtcttatttactctaggcttgatctggaaatcaactacccttttcaccggaactaatatacgtagttgctgttttgcagacatttttattactctttctgatacttgattatcggggttattgatcctagtgtgtcttgacaacgtttctcgaatcaggattattttacaccgagaaagaaagagtcaatactaataatctcgaaagatcttcaagtgaaaaataaaaaaaaatgataaataaaaaatagaaactatgaaactatgtaaaaaaaaaacaaatagacatatccaagcaagtccaatagcatagacattaagcacgacagctgtaaaaaatgtcaaagtttgttatcacctgcatagctcatggagaaaatctcccaaaagaaaccatcgaccagattgcgaaagaaattactgaaagctcggcgaaagatgtatcaatcaatggtaccaagaaactatcggccagagctaccgatatattcattgaagtcgcaggatcgattgttcaaaaagacctcaagaataagctgacgaacgtcattgacagtcataatgatgttgatgttattgtttctgtcgacaatgaatatcgtcaagccaaaaagctctttgtctttgacatggattcaacattaatctaccaagaggtcatcgaattgattgccgcttatgctggtgttgaagaacaagtgcacgagatcacagaaagagccatgaacaatgaacttgatttcaaagagtctttaagagaacgcgttaaattattgcaaggcctccaagtcgatacactatatgatgaaataaaacaaaagctagaggtcaccaagggtgtgccagaactatgcaagttccttcacaaaaaaaattgcaagctcgctgttttaagcggtggttttattcagtttgccggttttatcaaggatcagttaggtttagatttttgtaaggcaaacttgttggaagttgacactgatggaaaattaaccggtaaaacactgggtcctatcgtagacggacagtgcaagagtgaaacccttctgcaactatgtaatgactacaatgttccagttgaagcaagttgtatggtgggtgacggtggtaacgacctgccagccatggctaccgccgggtttgggatcgcatggaacgccaagccaaaggtgcagaaagctgcaccttgtaagttgaataccaagagcatgactgacattttatacattcttggttacaccgatgatgaaatatacaatagacaatgaagaaaataatgatagatagatgtaatagagtttctttttaaaattgtttatttaaactggtaaacatgatgtactttacgtagcgttaatataccggcaactatacgttggaagcaatagcttgcttgatagcagctgggttggcaccgacgactctggtaacctccttaccgcccttgtagaagattagggtaggcatggaagaaacttcagctttttgagcaacatctgagacttcatcaacatccaacttgtaaaaagcagcgtcagaatattgttctgcaaacttttcaatcattggtgcaatcattttacatggcccacaccatgtggcaaaaaagtcaacaacgactaacttgtcgccagatgctaaagcactgtcgtattcagaagcggattttaattgagtgaccattattgatgtgttatttaaagatatcgtagactctcgtgtatgtgtgcgtgtataattcttgctagacaacaaataaaaactggtcctcgttattctcttgtcagcttttcatcccccgaatggctttcttatatactgatatccctctttcggctggctggaaactgaacgcgcttagtaagaaaagagccaccttgtagggagcatcctttactaagagtataaacaattacacatatactttgatgattacttaatattcactggcactcaagttatgctgatcttggagcgatcttgaagccgagtatgtcattcttaccgggctcaacaagactttcttcactgactctcacgccgccaacggtttcaatgcttgcaatggtgacctcgccacccatgatatacctggcaactttgccaacaggggttcctcgcttgaccaaaaaacaatctctaaatacgttggttccgttgccacccgtaaaagtctggatgttcttcacagtgtacaccggtattagaccaaggatgtccgttgctgcttgcagaacctgaacaacacccgtagatccgaatctatacaggaccaaatctctgatattttcaattctgttaaggatcttgtcgtccagtggctttagtttgtctggctcgtcctcaaatgtgtcaacaaattccgtgccctcctcgtataatataaaaccttgctttttcaatttcctcaaaaaaacttccgtcactgcactggtcagtacagctttggtgtcaggatactttagcatgattttagaaacatttttatcggcgtcagggtggtcaatcttgttgagtgccaacacagttggaaatttctccatcataaaggacttgaccactcgagtgatccattcgtcatcccatttttccaaaggtggtagtcccttcaacctgtccagggctttttggatcatgggcgcatgtgaaccgtacccaccgaattgcgcttgaagtgtgtccactatgctagatttcgttgctgtatgtttacgcacaatagacccccatcttttcttcaggttcccctcaacccaaagcctgatttcgtcttgcagccattctatatcgttcaatggatcatatcctcttgtgttcttcccctctgcatctgtggttccactaacgtccaccacatgaataagagcatctgcgtgtcttaaatcatccaagaatttatttccaagccctctgccggaatgcgctccaggcacaagccctgccacatccaacagtttgatggggatatgcctcttacccttgctacaccacccgtagttaggtttacaaagatcttccttgccaaatctggagcaagcacactcaacttgcaagtagccggttgcctgatttggctcgatcgtggtaaagggaaatgctcctaccgccgcacctgcgtccgtcaaagaatttaatgtggtggatttccctgaagatggcttacccacaataccaatcaatggatccctgggcatactggctctatttccgttttattcttacagacagcttatactacaagttagttggacaaaagctaaaagacggaaaacgaaaacgcaaaatgaaaataaaaccaactctcattacaattcatcctagaacacttacacatctgttttgcactgcatagcattacatttcttgcatatctatctattcgagaaaaaaaaaaaaaggcatcgagtgaatttttcaccttgataaaaaagcccttactaaccctacaataaattgtgccgaaaccctctggagttttctagaatattctagccccatcagggctagaatatcctaaaagtttatagttgacgaaaatttttcagcgatgagatgcacatttataatgctatgatgttcaacgcaaaggaaatcatagcgttatcgggtaggttcgcatcgttagcaatagctagtcgcatatatacacagagatacatattatacctataccgttaagaaataggatagaaaataatgagcgaacaaaaggaagatttgtttaaaccagtaggagaagctgctgcagaggtcgaagatgaaagcatagccgaacagaacaaagctaatgacggcgtcaagttaaccggcgcacaggacgccatgggccatccagtgcaagagatagagtctctttgtatgaattgtggaaagaacggtacaaccagacttcttctgacttccatcccttatttcagagaaataattattatgtcattcgactgtcctcactgtgggtttaagaactgtgagatccaacccgcttctcaaattcaagagaagggctctcgttacgttttgaaagtggagtgccgtgaagattttaacaggcaagttattaagtcagaaactgccacttgtaagtttgtcgagctagacattgagattcctgctaagagaggtcaattgacgacagttgaaggtttgttatccgagatgatcgacgatctgtcgcaagaccaggaaatgagaaaatctatagacgaagctctttacaagaagatcgatgacttcatacagaaagttaaatcctacatcaattgtgaacccaacactattccgattacatttattttggatgatcctgcgggaaattcctggatcgaatacaaacccggtgaacctcaacacaaatggtctcatacccagtacgtgagaaccgacgaacaaaacgttcaagttggcattattactagagaccagttggagcaacgtcgccaagaacaattaaaacaattggccaaccgtgaaagaaatccttctgaatctgtcaaagttggctcagcaaacccacagtttttgtcagacgccaccgacatcgaaaactttaacaacgaggtgcaaacattcagagcttcttgtccatcgtgtacccaagagtgtgaaactcatatgaagccagtaaatatcccacactttaaagaagtcattatcatgtcgacggtctgcgatcattgtggttataagtctaatgaggtgaagaccggtggtgccatccctgacaaaggaagaaggattactttatactgtgacgatgcagctgacttgtcccgtgatattttgaaatctgagacctgtagtatggtaattcctgaattacatcttgatattcaagaaggtacattgggtggtagattcaccactttggaaggtttactaagacaagtctacgaagaactagaatcccgtattttcactcaaacttcggattccatggacgaagcaacgaaagcccgctgggtagaattttttgccaagctaaaggaggccatcgctgggaaagtcaagttcacagtcattatggaagatccattggccgggtcgtacatacaaaatgtctacgccccagatccggatccaaacatgactatcgaagattatgaaagaactaaagagcaaaatgaagacctgggattgtccgatatcaaggttgagtaacgatcgttggcctcggtatcacctccccctttcctcttcctctttacatatatcctaaccacacaagcactcatttgatatgataatacttattcgtttttattcaaatagatagcgcagtcttgaagatttacctatatttttaaacttttgtataatagttgaaatagataatacagcattttttggctcctgcttcatatctttttttttaggtttttgctttatattctttcttttaactcaacttgtgcggagcagaggtaaagaggacaactataaatgctgtcaaaacgaacaatctacagatatttttacgaaaaggaaaaagcgcaagaatgaatcttaaactttctgctattgaaagttactttttccatagaagcagactaaatttgcattcatgtttttatgtcggaatcaaactcaacgaattgcccaaaaaaagtcaactgatagcggctcttaagtatactgtaatccaacatgaacgtttgacttgtaatgtattctatgatgaattgaaaaaggaaaacttcctacaaaacattcttgagccactgaaattttgcgatctagtagaataccgccacgattgggaccagttaggggaaaccgaaattaaccacatctttcaaaggtataacttttcatacaacgagaataaacctttatggaaaattctgatcctccctaatcaaaatcaaatgctattgctgacagatcatgttctcatggatgggatgtccgctattcatgtgtgggaaacgtttatggaaggcctacagatgcaacagccggttgaaattgatgaaacaatatattcaccatcattaaattcatcaactgaaaaaataatgtcagccccactatacggagattggcccataccttggaattggcatatagtgcgacaattggtcagtagactacattattggtttccacaaacagtcgtaaaaaacaatagaaatttaatccaatttgccaactactcatttccaaaagacctgctggatgataaaccgagcgatggaactcaaaaatacaaagttaaaaacacgaaccatcaatgggagtttcgattatcgccgacccatctcaacgacattttacaagaatgcaaggccaataatacttcgttgacttcccttttaggtgccctggtctgcaccagtttcgaaaaaatagctgcacatgagtataccggatcatttttgaaaattgaattaccaatgaatattagaaagccttttgaacgagtcttgaaattaccttcagatgataagctcgccgtgggaaattttattgcggtcatagaattcaaccataaactacatcaaaaccgtggaatatgggatatcgcttctcaaattcaaagggccataagaagcagttccgaggataaaataatagataaagtaaacgaagtaaagttattggaggttatttcttctcaacaatacatagaagataaaattagcttgaataacggaccttcttccacatttgaagtaacaaacttaggatttcaaacatttaaagatgcatgcaacaccagtttaccgttttatatagtggatgctacattcaacgagccgcaaggaatatcttcaattttctcactaagcgtaatctctactcctggtaacggactacattgttgtatcagttatccaaatactctcactaaagtgctagaaccccactggcaatatatgaaagattacttaaatttatactagcagcacttcactagctcaaatacagaataaaaccacatttcccacatgtaaatatagaaagcagtttattcgctctttgaagcgagatcttcttcgatagacgtcacctcaacgtcaggatagtcggtgccgtcaaatcttgctgattgttgcgcttgaatagactcttcatgtattctaaaaatgttaattagtgggaacgccacaataaaaattaatacgagtaaaaacattggtaaaccatcaaaaatataaagataccactcgtgcgaggcaatttctccgtcataaccctgaataaattcaacagctctgacgatcgacctaattaaaatcaggaaactgttcaccaataaagcaatgtttaggtatttccaactaccataccttaccgatacattggttggttttttgctcatcttgaaaatgaacaaaacctcatttataatgaagagaccaaaaaaagcaatttgaatgaacaaaccagctgtaacgagatgagaaccagaagatgcacttgtcactttagacatcatagcaccaccaattgcttgtaatagaagactgcctacatcgccaatcacaaatattgtagtattgaatctagcgggcatgatcattaagttttctgcgaacagcagagtagccattctaccaaaaatcatgtaaatactggcagcatataatgttggagacaccagcaagaaaaccgtttgaataatataggggtttagtagtgtggtgtctttgcttgatttacatctaaacgcaaagcccacacactcaacaaaacacccaaatataaagggaatgtacgctcctgctaagtttaccgtaccgtaataccgcaatacgggttgggacttcataagagagccaactctccttttacttttcacagaataatggaatagtaaaattacaaatgctacccctgatactgcaaaaagtaccgtaaaaagtatactcgcacctaattccggagtgtatctatataactcgaagccgtcttttgccatgttcgaagtggtgaaaagtgctgactgtctattacatacttttacagggtttattattatagaatgaaacaggcaaggtatcttatccctttattatgaaaactatatatacgcataagtcttttgctgcatgataagccccttcccaagaatatgacaacctcttattgttcttttcaccaaagatccacggaactcatctttagcaagtgaggcttgaaatatcacagatatcattgtgaataccgcattgagcagattgttgacagcgggcatcttactaacaggcgcaatctaaagaagccgcgaaaaaaaaaagaacacgctaaacgattcacccatgccagccaagtgtagatttgtttgtagaggaaaacagttgatgagcaatttacagtgtttttttatcttagtaatattcatcaaaattcataggaaatagtcaatgatgcatgtctgaaaacaaaacgacctatataccttattgtggcttgtaaagtttaaacttaaaaataaactttctttttgaatgatagatatttccgcttttggatgcgcttcacaagaatagaagcaaaaagtccggttaaaattgaaatatgataaaaacccaaacatattaaaaaacccagacataaagaaaaaaactttgaaaaaaaaagtattatgccgctgagcgcgccacgttaaaagctcgaattcttcgcattggtagtagcgcaaagtccaatgagcgcacctcaagtgagaaacgcaggcccagagattctccaggcaggaaggaattgggacagatcctgcctggagggatggaggaatttacttcgtaggctggaacaggctcatctcagccaacgattgtaaatgtgcagggccatcgttacaatcctgcgcaccctaccatggataccagaatcccgtcgtgttcccaattgtgagtagtacagtggcctgctgccgggcagatagtagcagggcaggacacttgccagatcccgtagcaaggatgcttataatatatcgaaatgtagcattgttagtttacttcgtaaactgcccttgtagagtgaggtatagcttagaaaatagcaaactaaatagagagcgaaatgtccttaccagctacttttgacttgactccagaagatgcccaacttttgttggctgctaacactcacttaggtgctagaaacgttcaagtatgttatactcattcccgattatataatagagtaatgtgtgattgaaaacagttcgagtgaaagaatagccacaaccaggtttcccgccaaccaaacggaatgctgggatagcatttttcaggctgaataagaagagaaatatatgaacaatcattaaaacagtttgaaactccagctaattatcagcgaatattttgccaatagactttctaattgtattatgttattaaattttaaatcgctaatgaaaaaaaaaaacaaacctttggtattaaacctctttcaatgaaatcaattaattccggtacctattcttccgacgctgttagccaactataaatgccattttttcatagtacattaatttgaatcagttgatcattcacagcatataccaagtgtacgtttttgaatcttttatactaactttttcttctttaattttgtttcaggttcaccaagaaccatatgttttcaacgcaagaccagatggtgtccacgttatcaacgttggtaagacctgggaaaaattggttttggctgccagaatcatcgctgccattccaaacccagaagacgttgttgccatctcttccagaactttcggtcaaagggctgttttgaagttcgctgcccacaccggtgctaccccaatcgccggtagattcactccaggttctttcaccaattatatcacccgttctttcaaggaaccaagattagttattgtcaccgacccaagatcagatgctcaagccatcaaggaagcttcttacgttaacatccctgtcattgctctaactgatcttgactctccatcagaattcgtcgatgtcgctatcccatgtaacaacagaggtaagcactccattggtttaatctggtacttattggctagagaagttttgagactaagaggtgctttagttgacagaactcaaccatggtccatcatgccagatttgtacttctacagagaccctgaagaagttgaacaacaagttgctgaagaagctaccaccgaagaagctggtgaagaagaagccaaggaagaggttaccgaagagcaagctgaagctactgaatgggctgaagaaaatgctgacaacgtcgagtggtaagtaaggtgatatttacaaatagtatattaataattatagtataatgttttattagaataacagatttctttatcaatttagcggctaaataaaaatcaagaaaaaagaaatacattcattgtgtcatcttgtcacacatttagccatgtactttatttgctgagaagtttaatcaattgagagtagttagctattgtagtaaaaatgtgcaaatgaagtcttatcaacacgtagcgtatatagtgatctaaaacagttagaaatataataagcgaacttctaaaccattttagagcacatagccatggagaataggtacttgttttgacccgctcgacgaagtggtacgtagtgattgcgtggattagtttatcataagactttcaatgaacgtaccaaaggcgagactcctaaaagtagcagagttatctgcgaagatatttgatcaaaatttcaacccatcaggtataagaaccggttctaagattctaaatgagcgattaaagggcccttctgtggcaagctactacggcaatccggatatcctgaagttcagacatttgaaaacattatatcctgatattgaatttgtagaccttgaggagcaatatcgattatctatggtagaagcaaagaaacgtcgtggtaaaggtgctcctaagaagatgaagaaggatgcagctgcaactgcaaaggggaaggggaagaaaaaaaaatgattggagcacccttactaaaaaaaatattcattatgtagaaactcatttcatgtacatacaaaatcaaaaataaaacaacaaatagctgaagcaagaaaacgctactttacttataaaagaaaacgttatgcctgaatagtcagccttttgtataaatcctttacactcaatggcttactaggcagtgaagaataaagaacatagtacagcttatttctattgaccattatagactcccctcggacaatctttcgtacagtagcaaacgagaaataatttgtcctcatttgcgacaacaatagattgtatggtctgaacatactcttgaatttaataggattgttttgaagttctaaggttgtatgcttgttagaaaccgtggttttgagctcaattgaaatgccaccgggtagacgtttaggatcttttaacctaagtaataatgcgaacaatggaaaatggttaatgagtgcaatgacagcttccgagaatatttcgatagttattgttagcattctcaaaactgtgtatgacatatagaatgccatcactgtgggagtcaagaacactagaataataaataataatgttcccaatagcaattgatctagttgaaaatagttatggtcaatcctatttcgtaaaacgttcctctttttaccgcagaacaggttaaaaagactagccataatattcaactgacaatggtacagtttactgctgatacgataaaaaacatatattggaaaacttaaaattgcaaaaaaatcaatcgctagggaaacagcaaaagaaaagccaacgagaaacatcatatatatcgttaacgtgagcaaagatgatagggttttcggatcaatgagtctttttatgaatgtggtataagaaaattctatcacccaaagaaataattcgctcaaaaagttcgcaagttctgcatttaatttgatgccaagggggttatttgctaacgtttcagttattgtttttaatgaatcatataaaaaaaacttcaatactctatgggatgccgacaccaagaaatctcgattctcaataagtatggcccccaatattaaaccaaatgaaatgtcattaataataagccaaattgtattatacaataaaatataatcgggatagaatttagaaggcatatatgaatgtgagaattgactattagaattatctttttccaccatagagccaacattctgtatgttatccttcttattaatacgctcatactgtactgggaaatagcaaatttgttgacaacgaagatcgatttgctggacaaatgccgagtaatttaccaactgaaagtgcgaataatttaataacgaggatacgagactagcaatagagcagatcacaaaagtcaaataaaaaccaatttttgcgaccattttataaatacaagtagatgaacaccaagctgcgacactattaagcatagtacccctcaaattttcctgtgatgtttgaataaacgggtaaagctcatttaatgctttacaatatgcggggaatagattaatgatgttcaaagtttcactcaatttcttattatctctcttgtatcttggatgttgctctaatttagaatagttcagagtttcacccacactactatgaagaccaacttctttttctggtatgatgagcgagatgggatcagaagaatagaattgcataaatttcagcttgggtattctaaaatggacattacagggatcagcaactttgtagttccaaccctccgctccattgttcttagtagctaccactgaataagggggccgtatgcttacttcttctaaatactgaggttcgcaaacacctaagacaacaaaatgcgtcttctcaaatgaaattgccaaagctacctgaggtccttgagctgcggaattctcgaacaaggattcgtatggccagaaaatgtaatttggcatgtcatttaactgtataaaccgccctgaattcgaaggttcctgttcacagaggaattttcattctttttggtattatgttctggtaggtttttttcatattctacatttcggcattctcactgaaaataaatatagatgagatagaagatcatgaatcaatggttggtgacaagctaacataaggaaaatcaaaatacacggcattactaaatagaatatattgttagtactatgcaggggagaaaaaggacgcttacggaaccatttgagccaaataccaatccatttggggacaatgcagcagtaatgacggaaaatgttgaggataacagcgaaacagatggtaaccgtctagaatcaaaaccacaagctttggtcccaccagctttaaatatcgtgccaccagagagcagcatccacagtactgaagaaaaaaaaggtgacgagtacaatggaaatgataaagatagctccttaatctccaacatatttcgtactcgtgtcggaaggagtagtcatgaaaacttgagcaggcctaaactctcacttaaaacagcatcatttggtgccgctgaatcttcccggcgtaatgtttcaccctctacaaaatctgccaagtctagttcgcagtatattgatttaaatgatgaaaggctacgcaggcgtagcttcagtagttatagccgatcatctagtaggcgtgtttctaattcaccaagctcaacggataggcctccacggtcggcaaaggttttatcgctaattgccgctgatgatatggatgattttgaagatttgcaaaagggatttaaaagtgcaatagacgaagagggcctgacatggctaccccaattaaaatcagaaaaaagccgtcctgtatcagacgttggagaagatagaggagaaggagaacaagaatctatacctgacgttcatacacccaatgtaggagcaagcgctactccaggatcaattcatctaacacccgaacccgcgcagaatggttcggtatctgagggtctagaaggctctattaataattcaagaaagaaacccagtccaaagttttttcatcatttatcaccgcaaaaagaagataaagaccaaacagaagttattgagtatgctgaagacattctagattttgaaacccttcaaagaaaactggaatcaaggccctttgtgctttatggacattctcttggggttttctcgcctacgaatccgctaagaataaaaattgctcgttttttgttgcataggcggtattcgttactttacaacactttgttaacattttatgccattctcctggcgataaggacatataaccctcacaatgtggtttttttataccgtttctctaactggaccgactatttcatttttattttatcagcttgctttacaggcaatgatattgctaaaataattgcgtttggattttgggacgattctgaaatgtttaaagcctatggacgtgagtataaatcaatcttacagagatctggaattatgaaactatacatatatctgagagaaaagtatggtagaaagctaatagatttcattattccatttaggatcatatcgccgggagaagagacaaaatatcaacgaagttcgttgagtacttccctgacgaaaccttatggggcaaaggaaaatcagaggccttttggcaccccaagagcctttgcgagatcatcgtggaatagaatagatctggtatcttctgtcagtttttggctaggtatgtttttatccataaaaagttatgatacaaaaacaggcataagaatattcaagccccttgctatattaaggattcttcgacttgtaaacgtggatactggtatgccctcaattctaaggggattgaaatatggtatcccacagttggtaaatgttagttcaatgctagtttacttttggattttctttgggattttgggagtacagatttttcagggctcttttcgaagacaatgtgtatggtttaaccctgaagatcctaccgatacttaccagtacgatatgcaattctgtggtggttacctagatccagtaacaaaacgaaaacaaaattatatctatgaagacggatcagaaggttctgtttcaaaaggctttctttgcccacaatattcgaaatgtgtttccaatgccaacccctacaacggcagaattagttttgataatattgttaattccatggagctcgtttttgtcattatgagtgcgaatacttttactgacttaatgtactatacgatggattcggatgaaatggctgcctgtttgttttttattgtttgcatctttgttttaactatctggctgctaaatctactcattgcagtgttggtatcatcttttgaaatagccaatgaggagtacaaaaagaaaaagttcatatatggttctagaaagacaggttatgttgctcgcatagtaacaggctactggaaatattttaagcttaaggcgaatcagacaaaattcccaaattggtcccaaaaaggactagctatttattcccacgttgagtttatctttgtcatacttattatttgcgatataggtatgcgcgcctctgttaaagtatcgacttcggcaaactgtaacaatatccttctaaaaactgacaggggaatttcgattgttctcttcatcgaatcactggcaaggttagtattatatctgcccaatatgtggaagtttttaacaaaacctagttacgtttacgattttattatatcaattattactctggttattagttgcctggctgttgaaggggttctaggacatatgtatgcctggctatccatattccacatatccagattttacagggtgattatttctttcaatttaacaaaaaaactatggaaacaaatattgagtaatggtgttatgatttggaacttatcgtctttttacttttttttcacctttttggttgctataatcatggctgtgtatttcgaaggcgtgattcctccagaagaaatggcagaccagccatttggaatgtattcactaccgaattcatttctttctttgtttataataggttcaactgaaaattggacggatatcctatatgccctccaaaaacactcaccaaacatctcctcaacttttttttgctcagtattttttattatatggtttctactatccaactcagtgatcttgaacattttcattgccctaatatcagaaagcatggaagtgaaagaagaagaaaaacgaccacagcaaattaagcattatcttaagttcgtctatcctcagaaaatacaagaatatacacacgctagtttggttgcgagaattcgtaaaaaattctttggaggtcataggaacgaagatacaagagattttaagcaatttcttatgagaggaaccgcgataatgaacatagcgcagaatatgggggagttggccgatgaattcaaagagccaccttcagaaaacctatttaaaaagggcttatcaaagctcacaattggggttccgtcactaaaaaggctgagaatgtttgctaataatccattttataaaaatagtgacgttgtgtttacagaaacgaacgatataaatgggaggacgtatatcttggagttgaatgagtacgaggatgagaagctagattatttaaaaaagtaccctttattcaattactcatattatttcttttctcctcagcatagatttcgaaggttctgtcaacgcttggtaccaccaagcactggaaaaaggactgatggatcacgatttttcgaggatagcactgatctatacaataaaaggagctattttcatcatattgaaagagatgtatttgtattcattttcgcacttgccaccattttactaattgtttgctcatgttatgttacgcctctatatcgtatgcatcacaagatgggaacttggaattggtcctcggcgttagattgcgccttcattggtgccttctcaattgaatttatcgtgaaaacagtagctgacggatttatatattctccaaatgcttacctgaggaatccatggaactttattgatttttgtgtcctaatctcaatgtggattaatttaattgcatacctaaaaaacaatggaaatttgtctaggattttcaagggattgacagccctgagggccctcagatgcctcacgatcagtaacacagctcgtcaaacatttaacctagttatgtttgatggtttaaataaaatttttgaagctgggttgatttcactcagtttgctatttccatttacagtttggggcttaagcatttttaaaggccgtttaggtacttgcaatgacggaagtttgggccgtgcagattgttacaatgaatattcaaattccgtttttcaatgggatatcatgtctccaagggtttaccagcaaccatatcttcatttggactctttcgcaagcgcttttagttcattataccaaatcatttctttggaaggatgggttgatttgttggaaaatatgatgaatagttcaggaataggtacacccgctacggtaatgggttcagcagggaatgctttattcctcgttctgtttaattttttaagtatggttttcatcctgaacttgtttgtttcattcattgttaacaaccaagcaaggacaacaggaagcgcttactttaccattgaggaaaaggcgtggctggaatcccagaaacttttatctcaggccaagccaaaagctatcccaaatttaattgagttatcaagagttaggcaatttttctatcaacttgcagtggagaaaaaaaatttctactacgcatcgtttcttcaggtagtactttatttgcacataatcatgctcctgagtcgaagctacaatccaggaaacttgataggttatcaaggtgtttattttatgttttccactagtgtttttttaattcaagaggcacttcacatgtgcggtgaaggaccaagattatattttaggcaaaaatggaacagcatacgactcagtatcataattatagcctttattatgaacgctgtagcattccacgttccagcctctcactattggttccacaatataaaggggtttttcctgttagtgatatttttgtttattattcctcaaaatgacacactaactgaactattagaaaccgcaatggcaagcttaccgcctattctatcattgacctacacttggggggttttatttttagtatatgctattgctttgaatcaaatcttcggcctaacaaggttagggagtaatacgaccgataacataaattttagaactgtaatcaaatccatgattgttctgtttagatgtagttttggtgagggctggaattatatcatggccgacctaactgtgtcagaaccttattgctcctctgatgataattcaacctatacggactgtggatcagagacatatgcctatttgttattaatgtcgtggaatattatttccatgtatatttttgtgaatatgtttgtttcgttgattattggtaatttcagttatgtttaccgtagcggtggatctcgctctggcatcaacagatcggagataaaaaaatacattgaagcttggtccaaatttgatactgatggaactggcgagcttgagctgtcctacctcccaagaataatgcattcatttgacggtcctctttcatttaaaatttgggaaggtagattgacaataaaaagtctagtcgagaactacatggaggttaacccagatgatccatatgacgtcaaaatagacctgatcggactgaacaaagagctgaatacgattgataaagcaaagatcatacagaggaagttacagtacagaagatttgtacaaagcattcactatacgaatgcttataatggatgtatcagattctcggatttgttattacaaatacctctctatacagcttattctgcaagggaatgtctaggtattgatcaatatgtccatcatctatatatcctgggtaaagtggacaagtacttagaaaatcaaagaaacttcgatgtattggagatggtggtaacaagatggaaatttcattgcaggatgaaacgtaccattgaacccgaatgggatgttaaagatcccacagtatcgtctcacatttcgaatataaacgtaaatctggaacctgctccaggaattttagaaagagaacctattgcgacacctagaatggactacggtgttaacaattttatgtggtctccgagaatgaatcaagactctacgatggagcccccggaagaaccaatagataataatgacgatagcgcaaatgatctaattgatagataaattatataagggcatatttaagaggctttatagatgtaaaaatgaacaataagaataatttaaatttgttttattgagaggtgattttctagagcatgtcaaactttactattcagggaaaaaagaaaagaaaaaaatgcgcaagcccggaatcgaaccgggggcccaacgatggcaacgttggattttaccactaaaccacttgcgcttactgattatatcttaatggttgaagagatctgaataagttttatcttcctctgggcaaagaatactatacattgcaagagtacccattagaagggaattaatttatgcactctaaatcttttttgattattccggatattatttttgttgataattagaggtaaaaaatagtattaatgaagaaataagtattgatcttcttatactaaataagagaggtatataaaacacacgccgattggtcatattaatcatgaccaatataatagtgattccggtagttactatacattgatgtgacgactcatattcctcatatatgtacctaccatatcatgttcaactaatagattttaagcacagcttcagtattgtctcagcttctcgtttaacattccttctgcaataggtgcaatcacacttaaacgtatacgaggtgtacattaatatacgatgtaagcattatattgttaccatagcaactcatgtcactattaattactctcgttccaacaattttgtatttgaagctttaacgggtgttaaatgcacagccgatacggctcatccgaaaagtaacgccaattatattaacagcttttccatttatttagaatggcgatacaacggaaacatacgaatatgatagtactcaattgttgtgttggaataaaaatccactatcgtctatcaactaatagttatattatcaatatattatcatatacggtgttaagatgatgacataagttatgagaagctgtcatcgatgttagaggaagctgaagtgcaaggattgataatataataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcatcatttacccatttctcatgttgtgtacacattatatacctcccagttactgtcaatcctctcctcttatatcgtttcaatacaaataatatattatgaagggcaatattacatcattacccggagatatatactatttggaatgatctttctttataagaaaaaaaaagaatttcgcagatttccctggctttccttattcttcctacgttagcattattatgaattatcgctaatagcaaaggcaaaaaagattatcaactgcaggatattcggtcacaactttgacatagatcttgagaacctcaacactattcatttctctggcctgattattttaagtaaagtcaatcattgttaagttttcttttgttcttttctatcattctcgctctttcaattacttacacctacaataatagacgttgacctgtgaaaggcaagaaacttaactaatagtataattaagaagaagttaacattttactctacattattgaaaccgctcactgacttcaaaaataggataaaaacataatatggaaggaattttggatttttctaacgacttagatatcgctctattagatcaggtggtatctacattctatcaaggttcaggtgttcagcaaaagcaagcccaagagattttgactaaatttcaagataatccagacgcttggcaaaaagctgaccaaattcttcaattctcaactaaccctcaatcaaaatttattgccctttccatccttgataaattaattactagaaaatggaaattgttgccgaatgatcatagaattggaattaggaacttcgttgttggtatgattatctccatgtgccaagacgatgaagtatttaaaacacaaaagaacctgatcaataagtcggacttgactttggtccaaattttaaagcaggaatggcctcagaattggcctgaatttatcccagaactaatcggcagttcaagttcctctgttaatgtttgtgaaaataacatgatcgttttgaaactgctatccgaagaagtcttcgatttctctgcggaacaaatgacacaagctaaagctttacatttgaaaaattccatgtcaaaagaatttgaacagatttttaaattatgttttcaagttttggaacaaggttcttcaagctctctaatagtggcaaccttagaatctttactgagatatttacattggattccttatcgttatatttatgaaaccaatattttggaattattaagcaccaaattcatgacatcgcctgatacaagagccatcacattgaaatgtttgactgaggtttcaaatctaaaaattccacaagataatgatttgataaaaagacaaactgtactttttttccaaaatactctacaacaaattgccacaagtgtgatgcccgtgactgccgatctgaaagccacttatgcaaatgctaacggtaatgatcaatctttcttacaagatttagcaatgtttctaactacatatctcgctcgtaatagggcccttctagagagtgatgaatcgttaagagagttgttgttgaatgcgcaccaatacttaattcaattatccaaaatcgaagaaagagaactatttaagacgacattggattactggcataatttagtagcagatttgttttatgaggttcagcgtttgcctgctaccgaaatgagcccattgatacagttatcagtcggttcacaagctatctcaactggatctggcgccctaaatccggaatatatgaaaagatttccattaaaaaaacatatttacgaagaaatttgttcacagttgagattggtcattattgaaaatatggttagaccagaagaagtccttgtggttgaaaatgatgaaggagaaattgttagagagttcgttaaagaatcagacactatccaattatacaaatcagaaagagaggttcttgtatatttgacccatttgaatgttatcgatacagaagaaatcatgatcagtaaattggcaaggcaaatcgatggttccgaatggtcatggcataatatcaacactttatcttgggctattggttccatatctggtacaatgagcgaagatactgaaaaaaggtttgtagttactgttattaaagatttactagatttaacggtcaagaaaaggggtaaagataataaagctgttgttgcatcggatattatgtacgtcgtgggccaatatcctagatttttgaaggctcactggaattttctaagaacagttattttgaaactttttgaatttatgcatgaaactcatgagggtgttcaggatatggcatgtgacacattcattaagattgttcaaaaatgtaaatatcattttgttattcaacaaccccgtgagtctgagcctttcatccaaacaataattagggatattcaaaagacaactgctgacctacagccgcaacaggtccatacattttacaaggcttgtggtattattatttctgaagaaagaagcgtagcggagagaaatagattattaagtgatttgatgcaactgccaaatatggcttgggacactatagtggaacaatccactgctaacccaacattgttgttagattctgaaactgtcaaaattattgcgaatattataaaaaccaatgtagctgtctgcacctcaatgggagcagatttctatccacagttgggtcacatctattacaatatgcttcagctatacagagctgtttcttcgatgatttctgctcaagttgccgcagaaggtctaattgctacgaagacaccaaaggttcgtggtttgagaaccatcaaaaaagagattctgaagcttgttgagacctatatatccaaggcgagaaatttggatgatgtcgttaaagtgttagttgagccattattgaacgctgtacttgaagactatatgaacaacgttcctgatgcaagggacgccgaagtgctaaattgtatgacaacagtagtagaaaaggttggtcatatgatcccacaaggtgttattttaattttacagagtgtatttgaatgcactttggacatgattaacaaagacttcacagaatatccagagcatcgtgtagaattttacaagttattgaaggtcatcaatgagaaatcatttgctgcatttttggaactacctccggctgcctttaaattgtttgttgacgctatttgttgggcgttcaaacataacaatagagatgtcgaagttaatggtctacagattgcattagacctagtgaaaaacattgaaagaatgggaaatgtcccatttgcaaatgagttccacaagaattattttttcatttttgtcagtgaaacgttttttgttttaaccgattccgaccacaaatccggtttttctaagcaagctttgttactaatgaagttgatttctttggtttatgataacaagatttcggtaccattatatcaagaagctgaggtaccacaaggaacttcaaatcaagtctacttaagccaatatttggctaatatgttaagtaatgcattcccccatttaacatccgaacaaatcgcaagttttctctctgcattaactaaacaatacaaagacttagtggtcttcaaaggcactttgagggactttttggtgcaaatcaaagaagtcggaggtgatccaacagattatttgtttgctgaagataaagagaatgcattaatggaacagaatagactagagagggaaaaagctgccaagattggtgggttattaaaaccttccgaacttgatgattagaggcggtggcgtatcattctttaaatttccaatattttttcccttttattaactagtctctaatttataaccacggggttttcatttctttttcacttcatattgtatgtaaattggttcttcaaagttccaatactctaatatagtactaaatactatttagccaacttcatggaaaagtaaagaatattatttgaagattcttaagtgattacccattttattgttattattgatgtatgtacatgattgtagtaaaatacttatacgccttatgctcaagtttttttgattgcatcttgaattttaacgaaactgtttttgggcccagccacagagcctttaacccaaataacattattttcatcgtcgactttcaaaactttaacattttggatagtaacatgctcgtttcccatatgaccaggcatctttcttcctggcagtaccctacctgggtcttggttttgaccataagaaccaccgtgtctatgcataatagatgtaccatgagatgctctcaaacccttgaatccataccttttcatcacaccagtaaaacctttgcctttgctgactgatctgacgtcaacatattggccttctttgaaaaaagagggtttcaataatgtgccaggtggtattaatcccttttcatctttaactcggaattcggccacatgctcttttgggttaacaactttagaagcgaaatgaccaagcatttgtctgctaactttagacaaatgccttgatccgtaccctacttgacacgcgaagtacccattgacctccgaagttctatgcattattacttcaacattattaacttctaatatagtagcggcgcttctttcaccagtagatttatcaaaataaggcatcattcccttcttacgagtaattaaaccgcatctttttggtagccattttctcgcatttgccagttcaggtgagtgattaatcgctggagcctcggttgttatactgttagcaatactaggagccactagaaaaggccgagtagaagaatatctaacatgaagttttgatatgctaaatattgatccctgtaggaacttcgacatggctatatttgttctctcttgctttcaaagagttgccctttctcgtcccagttgtcaatttatcgtccatatatttttcaataaagttcgtttgacaagggattacccgaaaacaaatatctcgcgactgtaataggagaaatggcattagcatttcaattaaggaaagaagaggatcatcgagaaacgaatttatggtgcttatttactgttacaacatttcatgattttgaattttatttatacatgtacattctcgtacggtgttatttcgtaattatgggatgtgcccagttgcttccttaagtcttccgtagaagctttaaaaggtaagatttcccccacactaggaggctgcaagatgtcagtgtcatccaataacccactaacacggaaatttattgcatttgacaacgttgacggcggttgtgataaagaagatgatgttgtagtggatgagttaccagggagatattgggcctttattaaatttcttaaagatcctgcaggcttatagcgaggtttcatagaaagttctgatgggttggtcataacaacactttgtctaagctgatatggaaggggcgtacaaaattgctttgtcaaagatgttgacggtattttcgtaggcgaactgtaaaacatttcaggatgatccattggattcaacgctgtcccattaagcctagctgtaggtacatgttttagtgtttttggaggtttaggccttcctttgaatgacgtcaaggaatgcgaagaggtggaataaatgaattgggtaggcgtgggcaaatctccgatgttctcataattttgaggatgttctaacgggaggggataattatagtagtaattgtcatcattgctctggttgcagtgatctataaaatatgtagaatattgctgagcagaagtaagatttgactgacccgaaccctccgaaagggcccgtacgggagcctttgcagagtgaatatggtccttagcgaccgtgtcagaatatattgatgaggtaattctcgttgaaagaccattcggtggtgggaatgtaagagatagagacgattcgggaatcactttttctctggttgctacttctgaatatactgacgatgcaatgtttttattctcttgtggtgccggcacttgcagataatcagttgcatcttcatattcctcattggcgctggaactggaatcaatttcttggacagttgtacttccgaagtgactctgttcaattaatgtagtatcatttggattgtcttgagagctcatatttacactttttcttgtagcgatgtttaatttagagtcacgccgtatcgaagaagttacagaggatcgtatcgtgctattacttttctcaaaataaatgttataaatgcttcttattctgtcaatattttcttcctcctctctcgaacactgaggctcgagcccgctacgactcgtataattcgatttaagtcgattatcgttgttatggctggacttttcatttacatcaggatttgacgtactatcacatctttgatcacagtcttgcccagtatttgagtgttgtggtgaaacaatcagctcagaattctctaacgattcgaaagaaatcttattcgaaaggtcaatgtgcttggaggggaccgataacttgctgttattctgcgaagccagtgaagcaatattataagcggagggtgcatgctcattgatacgcctcacataatctttgaaagattgtgagttttcgattgacggttgcaaaaaatcgtcataaccaccataaataaacctcttttctgtggcattgctgtctgagtttgcagaattcatagaagtaatccatcttcggtaaatagtataaatcgccctcaaaatttgggtcaaaatcctgcatagaaggttctttttgcatctcctatatactactattaaaacgacggatagtactataataatagcaccaatgggaacagcaacggccactgcaacagtgacgttagatgaatcggttcttttctgaagaaatgtcagtgatacgcgagatttgtctggtatagcctctcttttttggcaagaattttctttatagcggtagtgactaaacatggacgctttatagcatctaaagtaggggaagcactatttctcacttgcagttactatgaagtatatttcgatcgcacaagttgctttactatgctattgcagcctaagataaaggcaacaaccgatgaaacaagagtaaagggtatactcttttatgcaaatgctcctttacgcgactggtcattattgaacatcgaacactttcgaatagtttagtctcaaatgtatcgaacgcgaaactttaaaagcgcattcttgttcttttttcgcgacttgctcctgtgatcgtcttatttctgctccatattatctattctttacttaaagcttcctaaaaatgcagtcaggataaaagcaaatgcttcaatggagttaatatatataccgaaacaagaaaatgagttctatatatttgttccatggactcatgaatcaaatttgtagaaaaataaaatagaaaagataaacgccctccttactcattgagaaaaagggcagaaaagttccaaaaaatatggcaagcccacagtaacggacagctttacctgtttctatggagacaacacccggatggttctggtaaaaggcaagaaccatgttcgttataagttctataggcaataaaaggcccacagttcttgatgttgacctccctccgccattgatctgtaaagctgcttgcaggttttaaaacaaaaagaaagaaaagtattttaaaatatataggaggaaagaaacatttaacaaaaagtcttactatgcgctttttatactgagcactccgtttctacaaaattttcaattttttttttcatattcgttaatcgtgatgagaatactaacaccacgaactcaaataggaagttaacaatttagggtaggagtgccagactctacccattatccctttgtcatcgatgtaaagcagatatgaaggcttctagtaaagctattaaattagtactggaccatctgaagtccacgggaagagttcttggctccgtagagtcaggaaattcagcaacaataagtgagaaaacggcatctgttaataagcagcagcagttgcaggaaaagaaaccttctgtcctacaatatagaagctacaatccatatttagttaaggaggatttcctgtcaattctgccagaaaatttgtataaaaagaggggacaatttacaaatgagcttgactttcagttgatgaaagtcagggaccctaaatacttccagttcaaggatcagtattacttgttttttaatgattataactcgcttactgagtatatcaaattaacaaaacactcgcgaataaacaagatcagggtgaaaatgacgccattggcgcaacccttgccaaccctgttaacaaaattacaaagatattcaaaaaatctatataacgcattccgatcatctgagcaatattttgagggactaaacgaaaaagtcgatgttagtggagagttcactaccaatcagttacggagtatccttgattcggtggaagaaatagaaaataagtccgtattagtctggaatatacccactaaattacggtcgcacgatatattgaattatttttggttttacaacataaggtctagcttcaagatatactgggatgatgaaatgaaaagaaatctacgatttatatctttcgaaaactcgcatgacgcctaccgctttaaaagaaactatcatggattattggctaaagagctattgaccctgtcagaaaagggagatgcagctgactattcgctcgaaatggacgattccaaaatattaattgaacatcttagtgaatgaataacttgaatcttgtacgtaaatgcacactttctctatacatatatatatatttatattcatgttaaagctctctccatgattctctcaccaactcccatctggtgggctcacccgctgatttcgtatcttcgttcctcaagctttcattcaatgaataatgcgttttcgatgaatcttgttgttccttctccaaaataacaaatttctcccatatcccagaattttgccacaccagaaccaacgaatcgtcttgttctctattattagagtcttgacaccagccaattctacatctgtctttatagaactcgttatcgtgagttacatcaccactgttgtcatttctgtgagcgtcaaagattgggttctttaagtgagcattgcatatcgaccacacagagtccaaatacttgggcctccataggcccttcggtatataatttttcaagggatggctcgaaccattggcacgagagtggtctggtgtattcgtttctgtattggttgtttcaaaaatttggaaaatatgcaatgtttgcttatttgacaatacggccaacttactaccattggggctgaaactcatctcgtaaatatccgccttgtccacccctcttctaaattctttgattaaagtaccgttatgcgtactgaagattcttataagtgtaccctggacggaacatgttgctaccatggtgccttgacggttcagtctaaccagtttgatgggatttttatgtgctttaatgatggaagtgggcaaaagcgctgattccttcgggttttgtgaattatattttatttgtgataggtcggctacttgaatttggcctacgcatttattcgatgggaatgcaatgatttctaagattttagactgtgactgcgatgcttgcgactggagatgtttgctgctacaaacgacatagtccactgatccattgggagggatatccaaaataggacaaattctttgaggattggtttgaaattggaagatctctattgtgttctccaggactaccacaatatgaatcctagataaaaacacgtctttaatggaagacataaacttcaaagtaatcgtttccttttgcaaaagatcatcccagatgatcagtttatttagagcatgccttggtcgtttaccacctccgactagtgcgatgtaattcgtacgataaagcatcctggtatagccaatcccagtgcccctggattggttggtcgcagactctttaaatgttttcgatagcttactagtcaatggatctgtattgaaaatacgaaatccattctctaacgccacgctgaaacacgaatcatcttggttaaacgaaacgctcaaaaattttggtttcctcctgttgttgactgcctcccttataggtcgacgaacatccatctgctagttatgtatgcttatagttgtcctctaataatcgctgcctttccagatcttctggtttctcttccctttaacaatagcccccgcagtacgtattactaaggtaaataaatataaccggctttacaagccagaaagccgtgatcacgtgattatcaatttctttatttcatttcgctcagatactgccaaaagcccctgatcttgaacacaaaggtaaacaacgttaatatgaacctggctatcatcattaggataggctcattttctctttttaactcaggcccctttcttgcactgttaccataggatcttaccaatttgcattatttccgccaactagcggatatccgctgtatttccgcgcttctatatgctatggctggaaatacaataaaaagtgtcaagcagaaccactacattaatttaaagaaaaatgtcttatatcaaagaatcggcactgtatcaattgattatatataatgctagagtttccgtaccctcttgcaacgtcctttaaatcttgtatcttttcttctacaattgtagtaacaccacgtctacattagtatctaaattgcagcccaatgaaaggcgaacctaagacttacagcatgagcgacctctcatactacggtgagaaagcacaacaacagaacgagaaacagcaaaaacaatatgttgtgagacgaaattctacgcagtcaacatcaaaacaaaacgtgagcgtggtgctcgaggacaacgccagcgaaagtaatgaactacctaaagggtttatcttgtacgcatctttgatagcattggctttgtcgctgtttctggcagccttggatatcatgatagtttctacaatcattgaagaagtagctaaacagtttggatcgtactctgagatcgggtggttatttaccgggtatagcttaccaaacgctctgttggcgttgatatggggaagaattgccacacctatcggattcaaggagaccatgctatttgctattgtcatttttgaaatcgggtcgctgatctctgctttagcaaattcaatgagtatgctcattggtggtagagttattgctggagtcggcggttgtggtattcaaagtttatcgttcgtcattggttcaaccctggtagaggagtcgcagagaggcatactaattgctgttttgagttgttcgtttgctattgcatctgttgttgggcctttccttggaggagttttcacctccagcgtcacatggagatggtgcttctatgttaatttaccgatcggtggcctagcatttttcttattcctgttcttttataacccaggtttaagtacatttcaagagacaatggataacatccgcaaatttccatcacagtttatcgaaattgttcggaatgtagcatatcatttattgaaaatcaaagggtttagcaaacttaatgggtggagaaagccgttcatggaattgattttcatgtatgatattatcgagtttgtgttttgttcagctggattcacatgtattctattggctttcacatttggcggtaaccggtatgcttggaactctgcatccatcattattcttttcatcatcggtatagtcctggtagtgttagcaggtatctatgatttccttgtcttccccaaatttaatatagtgaaagcaacaccacattaccaaccattaatgtcatggacaaatatcaagaaaccaggtattttcacggttaatatagccttgtttctcacttgtgcaggatatatcagtcagtttacgtatattgtgcaatacttccaattaatttacaatgattccgcctggagagccgctgtacacctggttgcttgcattatttctacagtcgttacagcaatactttgcggtgctatcaccgacaaaacccgccaaatcaaaccgattattgttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataagttaagcacgatttagaaggtggcgagcctcaaagtgtaaagctgcagaaaaaataaacatgacttttagtaattggctgtttagcttgctgaattgtgtaccacaactaacgataacagtaagagggtaatccgagacagtatgagtacagctattaaatagttaatttagatttttatactggtatgataaacgacgttcatatagcaagagcgtcaatgcctctatgtcaccttcaatagaagtttccctttttatttcgacttttgtttttgtatttttcggcgtctgccttgttccatttttaaggcgccaaaaataaaataaaatgatgaacgattagtactcaaagaacactttaatccttggaaacaaaaaaataaaaaatcaaaagttgaaggaaggtcaaattttcttcctccaacgataataatacttgcttatataactcttttaaagttttacaaaactttggatcagaaaaaaagaaaaaaatatggctactccccatttatatcacagatataactccaaaagctctaacaaaaatatcaattcgagcggaaattctacagaggttgaccgtttcattccaaaatcagtttcgagaaatgcttataagtctattccaatgttaaatgggtttgacataagttactcagaactttgcgagaaatctccttcacctgagcggctatcatcccctgaattctttaacgaactgcgaaacaccgggcattacgaatcaatcagtacaacaaatgagttttccatgtcaagtatctctagctcttctgagagtcaagttaccagaagtggaagtgcaagagcttcaagaaacgattattcaaaattaactaaagagcaaaaggaccatagaaagaatattgcacattctcttggttttcaattgcccgaccgtgtctttacgtttgagaccacaagtgctgaaattctggaaaagaataaagccatcaaaaattgctttggaccaggaagttgcgccgaaataagatcaacctttgactttagtacactctcgcccgatgttgcccgttattatatcgctaattctaacgcaagatcagcttccccacaaagacaaatccaaagacctgctaaacgagtaaagtcacatattccataccgtgtattggatgcaccttgcctgagaaatgatttttattcgaacttaatttcttggtcaagaaccacaaacaacgttttggtgggactgggttgctccgtatacatctggtctgagaaagaaggagcggtatctatattggaccatcaatacttaagtgaaaagagggatttagtgacatgcgtctcattctgtccttacaatacttattttattgttggtacaaaatttggccgtattcttctttatgatcaaaaagaattttttcattccagcaacacaaacgaaaaggaaccagtatttgttttccaaactgaatccttcaaaggaatatgttgcctagaatggttcaaaccaggtgaaatttgcaaattttatgttggagaggaaaatggcaatgtgagcctctttgaaataaagagtttgcatttccccataaaaaactggagtaaaagacaaaaactcgaagatgaaaatttaataggattgaaacttcattccacttatcaagctcaggcacagcaagtctgtggtacgttattaagagcttatgctttcacatacccttttctggtatagcgcttattttttcattatgaaaaatactaacaaatattttctacaggtatttctctgaatgaacatgcaaacctgcttgcagtcggcggcaatgataattcttgtagcttatgggatatttccgacttggataaacctattaaaaagtttgttcttccacataaagcggctgtgaaggccattgccttttgtccttggtcgaagtctttgttggctacgggtggtggaagcaaagacagatgtattaagttttggcatacatcgacaggcacattgttggatgagatttgcacctcgggacaggtgacgtctttgatatggtcgttgagacataaacagattgttgctacttttggattcggtgataccaagaatcctgtattaataacactatactcatatccaaaattatcaaaactactcgaagttaggtcgcccaaccctttgcgtgtactgagcgcagtaatctctccaagttccatggcaatttgcgttgccactaacgatgaaacgataagatttatgaactgtggaacgataaggaggaaataattaatgaaattcaagagagtgggatttatggatctaatattatagaatatatggagggtatcgaaacaacacataacaaaagaataaggtaatataaaaaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcagttgattgcaccaggtatagcgagaaacttaacacaagaagtcattaccggtatcttctgtaatgtagtaatatatcctcttcttctaatatattttgtcttaactttccgttacatgactacaaatattgtaccttatgaatttatagatgaaaagtttcacgttggccaaactttgacctatttaaaaggtaaatggactcaatgggaccctaaaataacaaccccccctggaatctatattttgggtttaattaattattattgtataaagcccatattcaagtcgtggagcacactaaccatactaagattagttaatttacttggagggattatcgttttccccattttagtactcaggccaatattcctttttaatgccttaggtttttggcccgtttcattaatgagcttcccattgatgacaacttattattacttattttacaccgatgtgtggtctacaattctgatattgcaatcactcagctgcgtgttaacattaccgtttggccccgtgaagagtatatggttgagtgctttttttgctggtgtaagctgtctcttcagacaaacgaatatcatttggacgggatttataatgattcttgctgttgaacgcccagccattttacaaaaacagttcaacacgcatacgttcaataactatttgaaattattcattcatgctattgacgatttctccaaccttgttctgccctatatgaaaaattttgttttgttcttcatttatctgatttggaacagatccataacactaggtgataagtccagccactcagcaggcctgcatatagtacaaatattctattgtttcacattcatcaccgttttcagtttacctatatggatatctcgtaattttatgaagttgtacaaattaagaataaaacggaagccagtacaaactttttttgaatttattggtattatgctaatcataagatactttacaaaagttcacccatttttgttagcagataatagacactacacgttctacctcttcagaagattgataggcaacaaaagtagactaatcaagtacttttttatgacaccaatctatcatttctccactttcgcataccttgaagtgatgagacccaaccagctcacctttcaccccatcactccactccccatcaaagaacctgtacatttacccatacaactgacacatgtatcgtggacggccttaataacgtgcaccatggtaactatcgttccatcacccttattcgaacctcgttactatatattgccctatttcttttggagaatatttattacctgcagctgcgaacctttgataaaggatttaaaacctgctaaagaaggcgaaaacccaattaccataagcagtacgaaaagactgttcatggaatttttatggttcatgctcttcaatgtcgttactttagttatcttttccaaggtctcatttccttggaccactgagccctatttgcaaagaataatatggtgaacagaattgattatagttgcaaaaagacgttctataaatgtttactagtagtatttattttctttttttatttccatcttttagtggccaaccgttttgtatatattgatttttcttcgtagtggcctcaaaccgtttgagccacttaatggcaaatgatagcgaactttctcctgcttttaggaatactcttatagacataatgcattgatttccacgaacgttcatggttggtaaacgtaagggaattgtgctatatatatatatatatatatatgataatattgtataaatttcttaaggttgaaacctacctagaacagtttaatagaaataaatattgtccaaatttctttttggttgtagaatgttaattgtgatatttcataaagctatattttcaaattcttctctcgcttcttccactttagcatcatcacttcttatttcattttcttcctttttgttcatttcttctgtttgcttatttacatcatcgtctttttttgctgattctgtgacatgttcgttttcaacgtgttctttttcttcaacctttggttgcttttcgtcttctttcctctcgctttcttgtttaatgtctacattatcagctttgatttcatgctctgcttgtccaaggctttctgtatttacagttgtagtctccgcttcgctaggttctgttttcacaattttgacagattcgtgatcttgaacagattgtacatctgcactaccactatcttcgccctttatggattctgcgttgagggtagaaggctgttcagctgccactttcttttgcgaggcaggcacgtatttctgctcctgcaaggatgtgtcaggttgagatttttgctgttgtgatctcaagttttcttgatacttgatccacgttcttctttttaaaacttcgaaataatcttgtataggaccattagatttcttatccctgaagaccaattcaccatcaccgctaaagtagtcgtcattgtcatctactaaataccaattaccagcttccaaatcgttggcaaacgataacagaaattcaccccaattttcagcaatgacaaatttcgtatcgaagtccctcccaaatgttataatttgagcatatttaccatttggaccaggcgccaagtcaacaccgatatggttaccggcattgtccgttattaaaggaatccaagcaggatgtgcatataccggttgcactgcatttggaggaatagatttttgatctgggatatttggcagtttgaacttgttaccatttagtctttccatagatgaagaagagccagtagatgtaacatgggataaaccttgttgagatcttttgtttaggttctttgcgacgtttctccaggcctgagtcatagctacaacctgatctagtgtcattagttggaagccataaaacaagccagaagtaccggtcatcgattctaaatcttcttggccatcatgaattttgaaagacgcttttactgggttgggaaagctaacttccaagtcttcctctgcgtgagtgatatcgttttgggtgcaaggatcactcaaagttgcatttaaatctggattatgttcactggtccaaaaatcgatgtgtctccaagctaagagggtttcagagacaccatcgtttgactccgtggacgtaaattcatcaatatttatgtcttcattagatggcacgccattttgaaatcccatgctcatttcctcatctacactattcaaatgcatttgagagggatttacctgaccattgttgctgtttaaacgtttacccatgttaaaagtaggcgtttcatcggggttatactctgcataatggtcgtcagtgctgagggagtatacccattctttaacttttcttttgaatagatccattttatactaaaaaattctgccaagttgtcgcctatagaacgaatgtgcgtttattttgtattttctttgcgtattgatagtatagctagtccttgtatattttcaatttttcgataactttagtcgaacacgaaaaaaaataattagcggatttaattttgtacctttattttcaacaggcttgattcttgaatggcgtatttgcaaatatttcaatattgagagaagctaaaatttctaagaatggacttgcgtttgaagattgcgtagcagcgcaaagaattgattaaaatgtaatttactctggaaagaaaacacaaccttttcagttgcggtgcaaaaacattcttttgatctcgaagtaggaaaactgacattagaaaaagaaaaaaaaaacaatctgcgaattatgcatttctttttttcgcttttttattttcttttttctttttttcgacctccaatagggctttggaagccctatatgtaatctagggtaatgacatatgtcacgtgctttagggcttggtgcctttatttttatgattatgtgacaaggatctaagggggttttccagatacgggaaaaaataaatagtagactatcctaaaaaggaatgtaattaacttatgatgtacaaacggtggtgcaatgcatgttaagccctgcaggtaaatggatcagtgcggagtacgcatcttttgcgatgttcccatgtagattggagcctctctgcttcgttctaactctcctccgttgtcataaaggcctgcgattagtaaggtggaaggtatctgaagttaatgctaggatttcaaatgtatacctttttattctcttgaacaaataacgaaatcctctacaaaaggtttctattgaaagttcccaataagcagcaaattcttcttcctctacttatctgtgatttttttttaaaaaaagttaatcagaggctactacatcattgcgctaaaaaaaagtaacagatttgcgatgtcatacggcggatcggcatcccaagatatagtgacaaaattgattagaaaaatccaaaatacgtctgtgtcttgcaccaggagggatgaaaatctagattcttttaatcaacacttgaaaatgagtcttaaagttgcgcataacacgaagacatttgcaaagcattgccttcatcgacaagtattcaagaatacgtatcggaaaagaaaagcagtggaagatcaaaggaaaaacttgaacacgcaacttaggcaaaaatttgcgtcgccgtcagacaatttgctttcaccatgctctagaaaactgaatgatcacaagtcaaaacttttctcagccaaatcgcaacccaaaacactggagtttgtgcggggcaaacagaatataccacgcaagccgaatgtagacatttaatttaacggatgatgatcataaattggcctatttttttgctgtatgtgttacatattatactatatacgttctccaacaatacaagatgatacggggtaatactccttattcttattctagaagacatacaaatatttatgttttacgcatcgctttctttccctttattttgtattcacaagtatatggcatcttaacattgttactcaattcttaaagataatatctagccttcgctatttatttgaccccttccatcgattcttgcatccactacggtatttagcaacaatgcttcattatccaagatgactctatttggagagctagccaagatctttgcaatgtccctggctgtatctaatcttttcaattccacgtagtctcttgatttcttgatggcttcaccaatcagttcggcggatttggcttcaccttgtgccctcactaccataccttgtttttcttgtctggctttatcaactacaaatgcagccctttgagcatcttgttgggcaatttgctttgcttctacagcgttcgtaaactctggcgaaaaagtcatgtacgtaatagaaacatcatccagtaggatattgaatttgcttgcacgacgaaccaaattctcgcgaatcaacctggaaactttttctctttgagtgattaattgtgacgcattaaattgggccactacagcctttaaaacttcattaacaatggaaggcaacactctttcatcgtaatcctgacctaaggttctgtatatggtgggcaattgcaccacatccggtcttgaaagtactctacaggtgatattcaccatttgtaagtctttggtacctgttaaagaagcaacattacgaggttttgctctcacatcataaataattggtgtgtcaagccaagggaaaatgaagtgagtaccttcattaaatatcctagaggaaacaccatgtattctggaataaacaatggctctatgaccaccatctacattgaacagtgcattattaatgaacagtgcaccacctccgagtaaaagcaaacctcccaagcctgcaaatgccccccttggtgaaggcacttgacctctgcctccggtttgctgtaccttggacaattgtttttggaacgcctttgcgtacctttggaactcaccaggtgatctattcatcagcactaaattatattcttttctagcagccgcttgcttttatttcgtgagctactaaaatacaacctcccctgtaaaactcttctgatgtcctttatggtttatgaattgcccttttttgctattatttcccttagatgccaaaatgagcgatacaagaaaagtttgccactctatgtcgttgatagtgattatgcaacacaattacatgcaagctattaaaatatcgactaaacggatacggccacatcgcagtattactcatagcaatagaggaagtagaaagtatttaaatggggccactcaaattgcacactgctttatgtaatctgatttcatttctatacaaagaatatctctcttacccggctgtcaagtatgatcgaagggcccttcataaaagggttctttaaagaacgatcagctgaagctgtgataataaatgctacataaatgcatgcccttaaaactgtataaccatgtctaattatcctttgcatcaagcctgcatggaaaatgagtttttcaaggtacaagagctgctacactccaaaccttccttgttgctacagaaggaccaggatggcagaatccctttacactggtcagtttctttccaagcacatgaaattaccagttttttgctttctaaaatggaaaatgttaacttagatgattatccagatgattctggatggacacctttccatattgcttgttcagtggggaatttggaggtggtaaagtctctttacgacagacctctaaagcctgatctaaataagataaccaatcaaggagttacatgcttgcacttggcagttggtaagaaatggtttgaagtatcccaatttttaattgaaaatggtgcgtccgtaagaattaaagataaatttaatcaaattccattgcatagagctgcgtcggtgggttctttgaaattaattgaactattatgcggtttgggcaaaagcgctgtaaattggcaggataagcagggttggaccccactatttcatgctttggctgaagggcacggtgacgcagctgtattgttggtggaaaagtatggtgcagaatatgatcttgtagataataaaggcgctaaggcagaagatgttgcccttaatgaacaggttaaaaagtttttcctaaataatgtataagatttcaaaactacatattacagaactttacatatcaatattattctcaaaaagcaactcacaagcgtagtagatcccgctgtaacctccatcagctggtatttggtcattttccccgaccgatgcaatcaacagtagtccgttttgtttgatgatcctagccaacgacgggcatatcttcagtacttcatatggaagcgttacacctaacaaattattgttcatagcaaattgaaccattgtatgtatgtttattagttccgtgtttaaatacgacattttttgaggatttacggccagttcctttaaacaattaggagtatcacctacaaatttgcctgtggttgaatctctgagtagatttttcatttgcaacaaaaccggaaaattgggttgtttccagttaaggatcgagcaagcttcccaattgcatgaactgaaaactatttggcgcatactcccacttccgctgtgacgcaaaaaacgttcatgctcgaaaatgattagtaaaagcttatcaatgaattgattgatatttataaatggcgatattttgatgggaattgtgtcaatttccttatctgtaggaaaatatacacgaattaccagctgggctgacccgggaataacttctagtaggcttctgagaggcaccactctcgaagataagtattgtttcaatgttacttcatcgaagcttccatcaattttaccgaagtcataatccactaccttttccaattgttctttcgttaaatcatttaacagaatcttcgtgcctttgaattcaacgtatggttttggcgcagccactatggtttcatcattcagagcgcaaactaatacactaataaaactgccattcaacgatgaagaagtaacaaaattaccgtctttactagaggtcattaaatcacttcctgtagatttccaatacggctcataatttatgattttcagtggatttcccggataaggaaaaataatttggtaatccaaagtgagagatccaatattatttagtcttgtgtcgaataagggtaaattcatggttgcaatactatttattgccaccttcttgaaaaggaatggcattgccgttgttttggcaattatccttgtgccaaatgaaggaaatatctcgaaatccattgaaaaatcgtcgattgaatctacttggaaaattatctctccatcatcatgatcttcactaatttcatcatcatcttcttcatcatttgtttcactgatatccttacaaaagttattaatttcgccagatctaacaggtaaaataacatttcgcggtattatttcaggtaagtttgaggataaagtaattctgcctggtgatgatgacataataatgccgttatcctgagtcaacttgatagactcgagacctggcctcaactttaatttgatgaaaatttttttctccaaaaaattatgaccatatttccttagtggaatgattggcggtggtaaagcaaaatccggaatgctatcttgaatgtctaaatcaaatttgtcatcatttggggttaaatctattgtattaaggcgttgcgtactagactgcgaatttatttcattcaggggtgcagatggcaaatttaatggtctttgtaaaagtgcattcaaaacatcaacgtggctctcccataaggcgtaaaaaagtggcgaatggccgttgtcatcttcaatatccagacgtgcattatgtttcaatagttcagtaataacttcagaatgacctgaacgaacagcgtaaaaaatgggcgtccatttattaaacccatcaatttcgttgggatccgccccataacgtatcaatagttgaattaattgtggatcgccgccaatttttgccactatatgaagagtgcataaacctgttgagttctttttgaaaagcggttgacacaagtgttgtgaacttttgttcttggcattatcagcattttgcttactccgaatttctaaaagtaacttggcggcgtcatgattattaaatttacaagcaacatttaaaggatcgaactggactttagtagagctgattacattcttactataatccagaattggcttttcaatgggtgatgcgttcgcaccaccaatagtcagcagatccctaacaacatctatgtggttgttagtgatagccaaaaccaagggtgtcttagaatcactatcaatgggatcaacgtcctctaaaagattggtgattagcaacgagtgaacaaattccagttttcctagctctgcagcataatgtagcggcacccgcgaatgtatatcttgggcattcagtagtttttgtactgtttctttagataactttgatgttgttaaagcctcatctagaataaataagcgtgatttttctggacaacttgcagcctcgtgaaatacgttttttcgtgaaaatacttgatcatcttcgtcacaatatgacagatcaatatgatcctgattgcttttatagaaaatatgcagagagttatcgtccaaaggactagccaccagtaataaaaacagcgtcgttaagcactccttcaacaaagaaaagacatttttatgaaaagattctgaggaattttgtagcagatatgtgaatatcttggtttctctgaagtttcttagtagtgcatgctttctttgaacatctttcaccgtggctatattcaaaatttccttataccagttttcgatttccatctccatgtccaaggaggaggaagatgcttgaaaaagatgttcaagttggttttccgaaatctttgatgttgttaattcataattattgtgtaatatgttattattattgttgttgttgttgttgttattattattgttattattattattgtgtttattattgttgctggtattattgtcgtcatcatcgtcattagtaaacgtactggattgtatgtctgcccttctattgttgttgtcaatatcattcagctctaagagaatatgtaaagtttcatcgtttaattttagtggcccatctctggtaaaaattggttgaatggaaacaacagtagcaaggtaaaaatctttatcgtgagattgagatctcttgtcccatttcttcagagcttttgaaaatcccgttttatttaactcaacatactgctccaaatttctaagatccttttgaaactttttgaaagccgcatataagtttttaaatgaggtagcttggtttgagtttagcttaccatttatcttataatctttatattttgagtgtaatatattgaattttattcttaaatcggactctctcgccaaataataaccatttactttttccagctccctctctagtttaaaaaaaaaggcagctttattttcttgcagtctctgatgtataattttttcgtcgatgtcatctaatgttaaatgcaaatctaaatctgaactagcctttagcgtgggaatggccaattgtttgataagtttctttagagccttataatcaataaaatggctgttgtactccgccagttccaactgcctggcttccaaatacttgccgaatttcattgcacgtttatctatctatgttgcctccaaagggttattctctcaaaaagctcaatcactgtggaaccgaaaaataatgttatgaagattttttgagcagtatgtcttgtcaaaagctcaactagtgcagctgatgttgcttaaaaaaataaaaaccaaatttttctactttgctcttgtacgttgcacaaagaagattatgtaacaaacttgaagggactctcaaaaacttgctataaattgtacaaaagcctcaatatcacctagtagtggttctatacctgtctcgagccatcgccaaatagttgataaatttgattaatttctgcccttattcgcacgtgccataacacctgtacctctcacgctaaagacctttataatcaaggaaacttgttgctgcagaggaaataggaggtaatgaattgtgataaggcacatcacatcaatttttcttgcattcttgcatagaaagataggctgatgcaattagcgcgtttcaatcgcgtgccaaagacgtatatactaagcaatataaccgaattgattaagtagttggttaattgtatattttgtgataaagatggttaactgacttaggcggacataatagtagaaaatctatataatttttcccatgcagttgttattacaaaatgcaattcttgagatagcacaagcaagaataatagggcacggtacgttcattccacgtagcgttagctagtgctgccacaaggtaaacgtacgattatattcatttttgaaacggaagttctttgtaaccctcatgctcgtttgatagtcacttaactacaagatattctcgttcagtgattgcttgcttataaatcaggaaacttcatttttattccttacattttcgaaaagcccgcaaggttttcttcgccacgctcaagcattcatcgttgaaaagcaaaactgtgcacactgtaccttaggcgactcttctccgaacaagctcatggctcatttttaaaatcacaagcttcgtataattgccaagacataatctaattgagaaggtcagacggcaaaacaaatgaccgaaatcttcgtttattggttcgcctgcgttgccaactggtacattttcccagagtaccagcaaaggaaggcatccttgatgcctactctgatactgtggaggatttaaactgaaaatgatagtctgcgcggcaaatctttctatttctactaaagttggatcctccggccgatataacgtattctttttatccaataatgtcaattttaaatgctcgattactaatcgttactaaaatagcggacgcgcttatgcgtcttcgacggatagttttcagatcatccctctcagaaagcaatgcaggaaccgcctgtaaaactatcttttgctggcactcacacattatggtattgatgccacctgaaaatacggaaattaaccattccttgtacggagatctaagagcaactattattgaattgttgccgttaaagtttcatttcagttccgtgtgtggtcaagtacaagactactgatgaaatatgttgtacacacacggaaatatatatatatatatatatataacaatattgtgggttgaggtggagacttgatttttcttatacagtatattcttgttcattttttaccattttcaacaaaccacacaaagactttattcattatgctagccgaaaaaacccgttccataatcaaagcaaccgttcctgttttggaacagcagggcactgtcatcacgcgtacattctacaaaaatatgcttactgaacacaccgaattacttaatatttttaacagaactaatcaaaaggttggcgcacaaccaaatgccttggccactactgttttggcagcggctaagaacattgacgatttgtctgtgcttatggaccatgtcaagcaaattggccacaagcatcgtgccttgcaaattaaacctgagcattatccaatcgttggtgagtacttgttaaaagcaatcaaggaagttttaggcgatgctgcgactccagagataattaatgcatggggcgaggcttaccaagcaattgctgacatcttcatcactgttgaaaaaaaaatgtacgaagaagctttatggccaggttggaaaccatttgacattactgccaaagagtacgttgcttcagatattgttgaatttactgttaagccaaagttcggttctggtattgaattggaaagcttgccaatcactccaggtcagtatattacggtaaacactcacccaattagacaggaaaaccaatacgacgctttaagacactactctctttgttctgcttcaactaaaaatggtttacgatttgcagtaaagatggaagctgccagagaaaattttcctgcaggattagtctctgaatatttacacaaggacgctaaagttggtgatgaaattaagcttagtgctccggctggtgatttcgcaataaataaagagttgatacaccaaaacgaagttccattggtgttactatcgtctggtgttggtgttacaccacttttagctatgttagaagaacaagtcaaatgcaacccaaataggccaatttactggattcaatcttcctatgatgaaaagactcaagcattcaaaaaacatgtagatgaactattagctgaatgtgcgaatgtcgacaaaataattgttcatactgatactgaaccactgattaatgctgcattcttgaaggaaaagtcacctgcgcatgccgatgtctacacttgcggctctttagcttttatgcaagctatgattggtcatctaaaagaactagagcatcgtgatgatatgattcactatgaaccatttggtccaaagatgtcaaccgtgcaagtttaggcgttaagcctcggaaacttcaattttattactgattcatttgataatttcacttgttcgatttcacagtttgagaagttatattacgaaataagaaaaatttttaaaacatgagaccattgctaatcttttgttgttatactgtgttagaaatcctcgtgaaatccttgtgaaatcctatgtggaatatttagatagtaagtaaagattgtgtatgtatttataagatgaataagcgccaggtgctaaacagagttcacttcacgttaacgccagtccaatttttgattgcattccctgttttttctacatctttgttcaaccattttttggcatcatagtagtattgcacagacgcggtacttaatctctttgtttctttccaaacacgatcttgtctttcggtaaagtgtggaaaggtgttcatttctagattatggatgagacccatggtgttcctgaaggttgttggcattgcatacgcaaaacaacaagaccccagtataatgggcatggttgcacgaagaagccatgttcttcttcttgccaaaacggaacctgtcatggaagcaaccaaaatggacaacaaccccggtattaggcgctcgtttggatcggtatgtaaactagcaattgttgatgtaaagctctcttcacgggcataatatctgcctgcgatatcatctattttatttgtcaccttgtcccatttagcggaaaattgttttcttctttcgttgaaaaacctcttcaagtagtcaggatcacgtactgaaataccgtctaccagctcattttctccaatatatttcataaccctttgcgaaagaacaccttgcttggcttccttctcattaacagtagcctctttggcctccgaagaaattactatagcgttttctggtggaacaatcttctcctcaacgggatctagctgacggtaaaaatcttttgtcattgtttccgtgctatatcaaatacagtagttatttttgtatatccttgagcgctatagtcggttgcaaacgcaacttcttttcaagtttagtattatagggcagtagcttattcgcctttccattagattaaaaataaaagaagtaacggttacccgcgctttagtatgtaaagggaactcaccaatgatttgcaatgaatcccctcatcaatcatttatgctagttgaatatttactaacagtaacaataatagcagtgcattagaggctttattgcgtcataaaataaatatcagttcaattaatgtataaaagaaaatgcttatatatgtattgattaataaccttctcaatgatgggaggggccttatgtaaaatcacaatccccttccccgtttgtcgtactatgattaaatgcgaaaacaaaatgcaaagaacataaatgcagggaaccaagtacaaattcccttacatgattgaagaggaacatcaaatacgttacttcatcatcatccatcatctcttgtaaactcttacccttcgtcatagctgctctctgttctgtacccataacagacgccttagttgtgtctacgccgttgatgttgtctaagctatgtgcaggaaccgtatagcctctcctcatgtatgcggtcggtaccacagcagcgcccaccagccctaacataatatatctaaactttggagttctcacaactctttgtgcctctgagtatattcctgaatctaacttcatttcagtaaactttgtttgaattttatgcgctaaatatttgtattgattgtatttattgattctgatccttcagtaacacacattccaaactatcctggataatgtgaaagagatttggcagttcaatttatatgaagaagaccctcacgtcgcgaagcattttttaacagtgttatcccagtatcccgtaattcttctcttcatccaatgctggccattactccatttattggggtgatgtaggcttcttatcccttttaaagggtaccttattgatctcccttttcggtgcggctgatgaaatctatagagcaaaccgaagtaaaacaaaattacgaaaagaaatataacattatatctttatcaaaatgtatgtatggaggagtaacagctgaaaacccccgttgtgagtggtttatgattgttttcacgcttattttgtcttctatatctttgctgattttacttgtattaatccggttcatccgaaaacttttttgaagatcgagccaaatttactttttttcttcttttcagaccttttaaattgatggtcgtttgttgaggatgaggaactgtcctttttgctgttgcctgatttggtgctttcggtagttttcgtccttgaaacgtggttgtggtgatggtggtggtgatgcgcttttctctgtcctgaagaagatgaagtggaggatgttctgggtgatagccctgcggattttgtttttctcattggatgtgaagtgaacttcattttcggatcctcattgtcccattttagtgctgtcttgatatgaggcgtagaggcagtttcgtggttgtaaatgtcatcaaccatggactttactttataaatgccgttattgttgaattgtattcttgaactccgctttgagctgcgcctcgaatttctcgattctataggagttagctttcggccagaactgtcgtacttcataagagtgttatcatccaatagtacttgtctcgacggttttggtctaacatatcccatcttatcgaagaattccatttcttcctttttttcaggtgagattgggaagtactcatttacagaggttactgactcatcactatcgctttcttcatcatccgaatcaaccactttatgttttgtgaaagggttttccaaagttctcctgattaatgcacttagccattgcaatcgttccttttttctcacttccgttttcaaatcatcgctgttgtcctgttcatctttatccactctaggttttattaaaagctcaggcttgatgaattcgaatgggacaacaaatgctggcattgcaaagtgtttcattaaaaaaaatggtagtttcacttttccatttctaaacttgatttgaatgttggcactaacggtgctgattacttgcaaacttggcctatacagagaggtcgcagatattatggctgatcttgttgaattttcttttaccatctcaatactaatcctaactattttagttgccaatcttctcgcgtagtaatttaaaatatcgctacaagtttgcttagcctcattatgaatagcttctattcttattcccgttgataaaggactagagagatccgggcctataaggctatgtgacgcggtagtcatgctttcactagtattgctagtcatcctttctaagcggtgccttcttttctccttatatgctagagtatcaatctttgcttcaaactcaggaattgtagtaattatgactaaatgatcaccatttcttgtcaaattttcaacataccagtccacagatgaccaagtatatctcctacctgatatataacacgaaacaactcttaaatctacatcgtcatctttgtctttgcaattgagcttttcttttgtattggaaatataattttcatagtctggatgatcaattgtcattgaaattgcattgtgaacaattgtaggccttgatggataaattgctgctaaagggtccgtcacgttgcttgaatccgtttttgactctgttgtgttcaaatagactggaacttgctcaccaaaatcaaattgatctattttagtcttgttcgatcttcctttacttatataaaattcctctaatttggctaattcttcgtctgtcatcccggcaaacgacttggaccttttctttgagctctccatattttcgctttcggataaatctaccattgacttggtctcaattctatcttcaacttcattaagattggcaaatgcagcttgcgtatagcctttccttgatccagaatttttttgagtgtttctttcggtcattttggtcatttttctttccagctcaaaatccaaatcaccaatatcaatatcatcaatagggccctgttcatcagcagcttttcgagatttttttagcacggatacttttggagggggaggcaacctcactgaagtccttcttcttgacctgaacattggagactcacttctacttctttcaacgctgggcgatctcaaatagcttttggagggatcatgtgctgcaggagaaaatacctgagtatagaagtgaggaactccagatgttgtagacgttggagttcctagttgtagtggcgaagaagcttcttcgtcttcgggtgagtccaagctttcgtcagtggcaaggtcattagagccatggctaccggtcaaagtatttttgtaaacaggattaaattgtggaggtatatgtaaaaaatgattattcaagccaacatggtgactgtcatttttaataatggtagcttggtcatcaattaaggaaggtgccagatcatcaaacgagatatgcttagtaaatgtctttgcagatgacatcttctattatttttattagatattagcagtttgccagggattacagcttctcccttatgtacagtgcgacaatattctttttttcaatgtgtctttttattcattcttctgaacagtttcgcttcgttaagggtccttctggctttctagaggcatgctcacctaaaatccccctagaaaagcgggctctttacccggcgaataataataaccgcggctactaattttgcaccattgaatattaacctcaaaaggcttagttggcaattatattctccttctattaatacttaatgtttacaatgtccttataggtgtttaaatatatttttatatactttgtacatattgacttcccagtgcgtaacaacgtcttccaatgactattttttttgttcgagagtatatagttttttttttaaagctagcagttcgtccttgagggaatctctattttctttcgacatatacagttccgctttcagattgttgattttcattctgtggaacgcatcaaaatttccatgagtgatggcgccacgctgttcctgcttgtcatcctgttcagcttgttcagttttaattctatcaatctccttctgtaaatcgtcgttgtttttacgatatttttcgagctcggattgtgataggtgaatagccttctttgttaggtccatagacttcgagcttccatcagagagttttcttagcgcatccaacttgttgttattgtcgagtaaattagcccgcaaagaatctctttcatcattaagcttctgagtttcaaggtgcaatttctctttagcacgcacggtttcgtgcatttcatttattactttttctattttgttcagcgaatctttctcatatatttgattatctttctcacttgaaggtggccgtgcactggtaggatagctttttaataatttacccagatagcaggacgattcgttcaaataggtatgaagttcgggggttattttttgcatattatttacaagtatttcgttctggcgcttcaaaacatcacatttattctcaagatcgatgatatcccttttaatagtgacatgttcggagcatgttttaagtccattattttgaatcgtaatttggtcacagagtttacttgcctgagataatttgaccatcaataaattttttaaatcattaattctagattctaaaaaggttttctgaatttctagatttttaagccgtgctgtttgaaaatttgaatcttttgaagcttcttttattaccatgagtctctggacttccttttctaattgtgaaatatgtctagcagtttcaagttccttttgttgagcttcgagacgtaatgtttgtaggttcaggtttaaatcatcaaaaagatttttgggaattcctttttgacatgatgtgtccttatatgaagaagagccatactcttctgaatccactgttagtcctcgtagaacagggaaattttttttagatactttgataccagttcccggactttccttattgatgcttgaatcaactttggaagattggggtttcttttcctccctatctgattttcgttcaaatgccttatcatccaaagcgctggagtaacttccagccccttcatcaatatcattataactcaaaactttgctatcaggcaatcttggtgtaagaatgtttattatctcttgattttcactttcggtagacttagagggtgtaaagcccccggaaagactattagaaaaactttctcctgcatgtagtgattcacacattattcctgggcatagctcattcaaagatgataaatctaaggtatacagtaaagttccttcgccttggtcagtttctgaagtttgtagatcgtgaatatttgggctggcatagtcagttttgtcgccacccatgataagaagcttctcattcttcattaaggttaaagaatgtccagagcgttcttgaggtatgccctccttcatacggggaagcttataccattttagcgataataagtttaaaaaatagacatcgttggaatatgcgttatgggtatccttaccgcctaacacacacattaaatgtttatacaccacactagcatgctcttgtattggcggaggcttttctcctgtggttttaactttagaccactcactttgtgctggatcgtagcggtatgtatcattgcttattgtcttgggagtttccccgccgaatacccataatttgttgtcatatgccaccattgtatgatttgttaaaggaggaggcaggtcgccgacaggctctaaaaattcccaatgagaattcggcctacggaatgatgataaatcaaagacgaccagatcgttaaaataagtttcatctacttgtccgccaaaaagatatagtttagtttgcatagggttgctagcaattatagaaattttatggccgtacctgcccaacggcctacggccgataggttgtggtatggtccacttataagaattaatattgaaaagataaagatcatcatccaacagtccgttcttattcagcttgtgtgtgtcgccaccaaacacaacataggcattaccgcatatagtagaggcatgtcccactcttgggggaggtgtattttgatcaatatcgattctcttggaagtaaagctcgtaccatccgcgttagcggctatttgccagacatccccatataccgattgatcgtgaagtccaccggtcacaaaaatcctgttatcattcgtaacaataaatgaggaagagtgtcgataacggggaaacggagagttttttagtttgaccctattccaaatatacttccctgtattcttactctctggagaccagggaagagcagtcgacgcgcctgatatgcctctatgctggtttggaggtagcgtaggtgttactattcgcgtattgtttcgattatccataaaaactattggtctgggtacactttgcgctgaaatcagagaaggtcccgtgtccgtaggtaccttatttgtcagcttgaaaggtaccatagctacttaaggggttgcctgcctcatccaaatcattttttttttttgttacaacctatgctaaaattcacgtgtacgcatttcaaaattgaaaaaaaaaagagcaagcaacaccaaaaccaaacttcataataaattagtatcccaaaagaccctttcacaaggtaattacttccttcgagactaattcgggttttgcgaagcttttttttttttcttcacagtttctcccaagagaagaaaaaattcacaagcgtgtcatttcgtgcagcttacatcagcacaatccatgcacaaaaaaggtgtagtaagttttaaacgagagagatgggcatgacagtaggtagggcatgcatctgcaggagtgaagctgcgatactcctcagcgcagagaacacataagggcacatattcatgattttgatattcttagctatctgtaaacatatatcaacgtatgtagtagttacaagaggtacaattgtagaaactgcctatatcaatcaagtatgtctttgtgaatttcgtccttgacgaaaatgtgcctgtttccgaccagttccccgttgttggatgagaataactcgcttgcggaatttccatctgcatttttctttaaagtcacgtcaccgctactaatgtttctcattaactgaataaacttcgactcagatagttttgattcgacagaggaggaaagagtagaagaggaggatgcagacgaaggcggtggagtacagcattttactatatctgtggcaatcctttgcagttccgactgatcttggtcgaaccatttctcgtcccgacgtgttatgggctcgtaccgctctttttgaatttctctctccaaaacttggaactccgcgtcgaattgaaacgcatccgttgggttgtcccggtttccttggcgttgctgtcgaagcgtcttttgaggtgggtaagtgcaacttgtcttccttatcatacaattcttaaaaggtaagtgttgtctgcttgaattcaggcgctgctgtgactcgtaattggaatacaaccttttatattctgagctaaactctagtgaatcgtcaatcttcatagacgagaactgcggaacccaatcactggaatctacagtgttgtttggagtaatgaaggttaatggagagggttgattttgataccttacattgtcaatgccgtcaaaattactaccattatgcaaaaagtgtttttccacatgcgagtcttcagtggcatagtgtgctgttaattccgtatgggccagcttggtgcgttttgacggtattaaggaatcattctgtatgcgatgcccttgttggataatcttttctatcgggcttgtatggcagacactgggcatggtattctagtttggtctttataatttttcacctgtttctttttgaaacaaaaccaaagtatgcggcgtcaaccttgactatattctcttaaatatatatctgccgttctatcagaggtttgaacattgccaatgccttaaagaaatatttagtcatcccatctccgattatcggcactagtttccatttttccagcggaaagataaaaagaaacggaaagaaaaaaggccgacaaataaaccaaacggtattcgtagaccgatgacaatacgactacaattaaggtagcgcgcctcactatgatgtggatcagcctcacattcagagcaatttgtagtacagcaaagttgccgatgtcgtcttcgtgaaccattgtcaacgcagattaagcacaccctaaaacttgaataatgcaaattccatagcttagtttaatcaaggcgccattattcctcagttgaaaagtatatctaatggttaggattagaaatatgttcattgctcattgttatgtgtatcatatcgtacaaaaattatataaagaaataataatgaaaaagagtaaaacaaagacaaatagacaaaaatagaggatagaaaaagaaaaacaacagatacataaataagtcttatgacaaaaaaacgattgtataaaaattaaagtgcatgccatttttacctccttttgcttaacttaaacttttcattgcaatcattcatttgttttcagcggctaaagcggctacctcagctctcaactttaatctaccggacaggatgtcaccaatcttgttgtattcagcccagtgaacttcaaaaccctttcttaattcaacgttggtttcgttttcccaaaggttagcaattggcttgaaggaaacgtgagaaccattaacacagataacagcagcagagtcatcttcgtgctcaacagttggtaccttttcaccgtgagtatcgaacttgaatctcaaaaccttagcgtcagtgtttggagaagcttcatttttcttgttccattgttcgataaacttgatacatttgacagcaaatctggaagcggtgacacggtctttagaagatggaacaccaccttgttgaacatggcctgggatagcagttctaacaccaaacttacccttgcttgcttcagagatgatgtcagccaacaattgagtgctatatacgctagaagcttgttcgtttctaaccaatagcttaccgtttctgttttcacctttgtcgtgacgaaagttctcttttaatagagttatatcttctctgatagaagctaagtcgatcttcttttctggagtgtacactgaaacagcaccagtgattaaaccagtgaaagaagcgatgtaaccagagtgaccaccttggacttcacagacgaagactcttcttcttgtcgcagaagcactctgtttgatgtcatcagtgtaattgactaatgcgttcaaacaggtatcaacaccaagtgagtattcagtacctggaacgttgttagaaacagtggctggaatcaaacacattggaatgttaaagattgggtgttgggttctaccgtcacgcaattgcttcaaggacctgaaaccttcaaaaccaccaagaataatcaaaccgtctagcttgttcttttggaagtagtaagcaatggtacccaaatcttctgaagcaacagatctgttcgtaccgatttcggaaccacccaagttatgccagttttcgacatcaatccatgatagttccttcacttcaccggtttgaatcaatccactgaaaccattcatgatagcgtatggtttatggccgtgagacaaacagtatagagttgcggcacgggtggcagcgttcaaagcagcagatggggcaccaacatggacaataccaatgtttagtctgtcagatactggcaataattcggaaccatcatctttaacggtagtggataagaagttttcgtaaagttcaataaattctgtgtctcttaaagaaattgccttatcgaaatctttgttttcaatggcagtggcaacagatttagtcaacttcacagattcaaccaatggcattctaattatcttgttttctaaaataccaattaatggagaaggagtttcaggggtaaattccagaacggccttaacagcatcgacaccttgtagagtagctaaccatctgtcatgagcaacagctgtaccacctctttgaacgtgacctagaatggttaccttggtgtctagacccaattcaatcaaagcatctttgacgtcattggcagtaacagggtttaattgatcatctaaagcaccttcagcgacaataattgtgttatttcttctacccttacttctgtgtctttggcacacttccttcaattcgtcctgccattttccgtgaggaacagctctttctggaataaaaatgtaatcggcaccggtagcaataccagccatcaaggccaaccaaccacaatgtctacccataacttcaacaacaaaggcacgggagtgggatttagcggtggcatcaatgtagtcaaccatttcacagattctttccaaagcagaataagcaccaatggtagagtcagtaccagacatatcattatcgatggaaccgacaagaccaacaatggacaaattcttgtatggggcgacttcttctttagtgaatctaccttctgcaaccaattcatcaaccaaagatggccattcgtgtctgaaaagatcagcaccggttaaagaaccatcaccaccacaaacaaccaaagcgtcaataccttgcgaaattaaattgcctgcagcttgtctacgaccctcacgctttctgaattccatagaacgagcagtaccaatcaaagtaccaccttcacttaaccaacctctgacatcttcccaagccattttctttaaatatttaccgcctcttagtaaaccttcgtaaccttcgtaaacagcaaaaacatcacagccgaaatgtatacctgtacgaacaacggcacgaacagcggcattcatacctggagaatcaccaccagaagtcatgacagcaatcttcttcttcttttgagaagagcccaatgtttgtcttagtaagtcagaagcatcggaagaagctctagagatgatttcgtcttcggaggtagcttctaagaaagcatctttggaagttggagcggaatcggttgcattagctaagcctgagaaggtgatgttgttgcccattggatctttcaaaaacactaaggtatcggacaatttttcggcttgttttgggaatttctcgacaatcttgttcaaatcagtagagaaataagtgattgtggcggtttcgttggtgtcgaaagtttcatcgattggagcagacatcactaaacgaatctttaatagagcaccttgactttgagccttgttagtagcttcttgttgtggtatacggaacccagaagcatcaacctcactcaacttgaaagattctaaccaaacttctctcaaggaatcttgggaagtccctgaagatagtaagctattttcaccatgtttgaatttgttgaaatctttcacagttgcaaatcctagagtgtgataaaagtgaatggtcttcttgaataaagcttcatcatttgtgatgatagatctgaatgcaacaccgtagcatgaatcttgagattgcatctttgatatgattttgtttcagattttttatataaaagctttcccaaatagtgctaaagtgaacttagattttttggtacctgtttcgaaattaaaaatagaaaaatttctctccctatattgttattcttacttcaaatttgtttatcgtttatttactaggcgagacttgagtagacgacaatccaaatagaattaacagattttattggtagaaagcaataatattctttagatggttgagaataaagaagtaaaaaaaccagtaaagagaaaaagaaaaggaagaaaattaaagaaaaaggatgattacacaagaagataataaaaaaactcctttattaagagcggaagaatttaataatgaagatgggaataagcaaaacaaaaacaaagaagggaaaaaaaataaaaaatcgtatttatttatttaaaaaatcatgttgatgacgacaatggaaaaaaaaaaccgatttcactttctcatccttatatttttcaaaggttgatgcaagtcgatctcaaatcggataacgctgccaactgggaaattccgcaattccgcaagaaaaaaaaaaatgtgaaaacgtgattgcattttttacaggtcctaaaggatttagcccacatatcaagagggtggcagtaattgcactgattaagcattcgtcagcattaggcgaatgtgtgcatgaatattgccagtgtgctcgatattagagagtacattgaagaatattgtaccggattatgtacaataactttgttaatgagatattaattttcttttttactagccgctatcccatgcacgatgctaaatttcaagaagaaactgagatttaaaaaattagtggaagctgataaaacggactataatggtgtatggattgaggaatctcgacatgtttttccatcgttttcaacgatgactgtaacccgtagattgaaccaggcatgccaaagttagttagatcagggtaaaaattatagatgaggttatatgtatggtacgtaaaatttacatgtttggatagtatcataaaatatagaaaggtggaagggattacctaaaaatcagagtttataatatgcaaggacggcctgttgagaacaaaaaactgtagtatctatcgctcactatatatctattaagttaggattttcttgctgatgctgctgttgttgctgttgttgattgatggggacaaacgcagtgggaaccataacataccctgtttgctgaccctgcatcatttgtggttgctgctgcgcaccagtagaggcatactgaagttgaccggccacgggattcgtcatgtatgtgcccattggtgatgtcaccacgttttgagcctgaaatggattacctgtttgactatgagcaagaatcggggtggtttgtgcttgttggagggtaaaaggatttggggagttttggaaattttgttgttgctgttctctggcaatattttctagcgaaaatgggttgttagaccccgtttttgttggatctaaagtgccggtcataattgcattgttctcggtggtcgtgtatccgccgaaccctgagccggtgaaatttggggtgtattgaaggttagaagcatacatcccagtttgttgattattcaaatttggagtaatctgtatctcacttggttgtggcattgtagacgcagatgtcaactgtaaagcctgttgctgttgttgcggtatcaagaaggggttagcagttggttgagggacttgagcggtcatttgtggctgggttggttcgaatgaaaaggtgtcattatttaaatcttgctgttgtgatccaaatgggttgtaagcatcttgtgggaccgtgggggaaatgagcaactgttggttttgtaattgttgctccagcagtcttttttgttcccttatctgttccagtttcttctgcgctatagacttattcttgtcattgctgttgttattgtgactactggtagagctaatggccgtagatggttttctatcttgctgcggttcagaaggttcacctctttgtctttttgtttcctctctcaaatgctcctcaagggagttaattaactttgtagtaatatgtttgataacggggattttcaaaccgacagcttttcctatttttaggtatctaacaacatattctgtcatatccacgaaatccttatagagatccagtgttctttttgcgtgctcaatggacaattcgaagaatgattctaaaagtgtaatgacaccttcattaagagcattgtacagacctagtaaatcttgtactaacaattggaatgcatacaataacaaatggttttctaaatctgaaacagagtatttattccttatcaaggcattaatttgaatttccaatgattcaacatgatctagctcttcatccattgaaagctggttcttactgcccagctttagcgaggagtaattgtctcgtaggtgatccatacctagcctgccatactcttcacaacgtgtttttaggtattcgtcgtatctctgcaaagccctcatatcattggaagaccacttagtagtatgcgaaatctttctcaattggaaaacatccaaattatgggaatagtgccttagcgtgacatctttttcgccttgttgtatcatcagatgcaacacaatcaatgccttataaacaatggtccaggctgtatcagacaaccttatatccaatgcgtgggtaatctcttgcaatcctcttgcgctcgaagtgcccgagagaatagggtccacatatttttgctttggaggggccatctttattttggtcgcccctttaaccaacttagtatataatgaagacattgtttcacaaacacgcctctatatctattataggggtagccgagacagtcgcgcttgtatgcttgatattgttactctcgtagatgttagcaagcgtagcaaattggtactcctgctacagatttattttttctccttctaaaattataactcaagcaagaagccctaataacaagttaaccagactaataagtcgactttttcctcgaatgtagaaaagaaacttttctacgcagctgcaaacttaatctatccctccaccaaagcaaaatgaaaacaaagccatactgggaaaaatctgaaaaaaaaaatggtaggagtaaaagaaaagaaaaaataaaggttaccctgcagtttggatagtcgggtaacatttggcccttttcctccttgattggatattattaccccgattacccctcatcttgggagtgccccgcttttatttctcccgccaatcggctattaacggctttacgtcattccgtgggcgggtcaagcgagccgctccctggtttggtcacgcaaaaccgaaaggctcaaacaaaactaaggccatcatatatatatatgcggctgcgtgcgtgtattctcccggataatatggtgcgttgcaattggagtattggagaaaattttcttttccctttcattacggcggaaatacttcatataaaaaaaaagaatacaatcagtctttaagactatacgcataagcattcaagacacatagaaacacaaacctatatttttaatgtcagcatcagcttttaattttgcctttagaagattttggaatagtgaaacaggccctaaaacagtacacttctgggccccaactttgaagtgggggctggtcttcgcagggctaaatgatattaagaggcctgttgagaaggtatcaggagcacaaaatttatctttattagcgacggcactgatttggacgcgttggtcgtttgtcatcaagcccaagaactatctgttagcttccgtcaattttttcctgggttgcactgcaggctaccatctaacaagaattgctaactttaggatacggaacggtgattcttttaaacaggttattcactacataataaaaggggagactcctgcagccgtcgcagcaaagcaaactgcatccacatcgatgaacaaaggtgtgatcggtactaatccgccaataacgcactgattacgtaaacgataatatgttcctgaactcgcatttttttaatgattttttatgacctcttatatattctttcattatataacctctatattacatcaaaagatggaaaaatataaaaaaattaaaaaaaaaaaaaagaaattttttccaaaagagtatatttatatgtatgtatacatgtagggaaaataagaaactttattaatagtaaaaaagcatatatactttattattaactcttttgtttttctcgagaagcttaattttgggtcaattcaacgacctttttagcagcaggatctaattcatcaaacgaataaatcttcacgcctgacttattgataatgtcgcggccttcttctactttggtaccttgcaaacgtgccacaatggggaccctaacttctagttctctggcggcttctaccagccccagggcaacatagtcacatcttacgataccgccgaaaatattgacgaaaattgcatctacgttcttattggataagatcaattcgaaaccttgtttgatggtctcaggggtggcaccaccaccacaatccaaaaagttcgcaggatcgcctccatttaatttgatgacatccatagtagccatagccaaaccagcaccattgactaaacatccaatgttacccttcaacttaacaaaattcaaatcatacttctttgccttaacttcatcaggatcttcttgtgataagtccctccaggaatatatcttttcctgtctgaatgatgcgttatcatcaaacccaaatttggcgtctgtacacatgattttgtgggttggatcatgttcaatttcactcaaagggttaatctccacttgtgtagcatccctttccatgaatattttatacaaattggaaacagcttttgctgcctcgtcttgtgcatcgggactgaaaccgagactcttggcaacatccttggccatttgtgggctcaatccctttgaagtttcaattgaaaatttctttatagcatctggggttctctcagccacctcttcaatattcataccaccttgactggacgcaatgatcatcggtttcttggtttgtctgtccattagaatagataaataagcttcatgctttgtatctactcttttcactatatatacagcagatactggcttccccgctattcccgtctgtttagtaatcaggttatgattgagcatttcttttgcaacatcctctgcctgctgaggactttcgatcatgtgaacaccgcttttgtaaccggtgtcgaagtgacctttacctctacctccggtcaatgcctgcgccttgatgaccagtttgttagtgtttaatttcttggctgcttcgaaagcctcttcgggagtgaacgctggaaatccttctggagtaccaataccgtattccctcaataactgagctgacctgtattcatgaattgacaagtgtctccttgcttgtaaagcagcttgcgcgtttagcctgcttaattgcccacactttgaaattagggataaggattttcttgagtacattttgttcagttgcaatgcttcagtatttttttcgattgtattgactcaatccttattaatcctaactacctaaaagtcagttacaaaaaaactggactatcgctctatagtcactgttatttttcgagagaaaacgtcaaagtgctgataaggaaaacgtcgatcttatataaaacctcaaagatgttgactacgcggcaattgaaaggccaaccaacttttagaatactcactccgccgctgcggggaaaagccgagaattcccgatgaacacataatcgataccagttggagcatttttctctgtaccaagacataaaaagagttttttttagtatctacctggctttggtgttccattcaaggtagagaagtcctcatacagttggagagatgaatgtatctgtgtatatgtatgtatatattaatatggctacgatgtcgtctaataccccttcttcttttgtttggtgatgtgtgcacgtaacactttttgcttgtctcgtagtgacattttttgtttacctctaacagatctcttgtgaatagacataacaaagttcttccttctttctttttctctgttggtagtagaacgcatgttgtcacgcttaccgcgtctactaccaaatttgtctctaccttcacgaccttccaacaccttttgtaatctttcctcacgagactgtttgtatttgatagggcctgttagtgtacttgcatcaactaactcttcacgcttgtcttgtttgtggatacccattattttagcaacgctttcctcattacgcaattcttgtagtttagcgaaatctgccggagttaaaatacgtgtagaagcaatttcacggaaggcagcttcgggatctatatctgcatcttcttgctcatccttcacttctttttcatcgtcatcatcgcttagttccaaatcggaatctgattccttgcccttagcattgtctttttcatcgtcactatcttccatatcaacgtcatattctttatcactatccatggtgacccactcaccgtcgacatcgtcttcttcgctatcgacatctacttcccagttggcatcagcgtcttcattttcactctcttcaccatgttctttcttccatttggctaacagttcgataccagcaatcccttgaacactgttgtcggcaccaaattgcggtctttttgaatctttacctcctttcttggcttcttgtacttccatggcggcattcttaccacgatccttcttctttagcatttctggtgccacgtctctatacaacgctatcaatgacttggcagccatattgacacctttagctttagaccccttatattctaccagatcctgtagtagaatctcatcgatagccaaaggtgcacgagagcatatttctctaatggtattaatgcctgcagcagcgacttcattggcaacaccgtctgatacaaactcgtctgcaatctttctcaccatgacatttataacttcaggagggacaagatcatgacatgcttgggcacatgcggacataattcttgtaacatctctttgtttcggagttaagtactttaaaaaaaaagtataaattcctaaaacaattaacttatgggtaccaatcaaccttgataacagctgcatcaaagatattttttgttccatgtcaaatttgtttttcgttttgcctgaaagatgttccttaaacaatttttcggcaaatccttgtggatctctcaaaaggtggatagcactgaagtttaaatacccttgaggagcacccggtccgttcttcttcttcttcttcacagtttttatggcattctccagcttcttaccacgtctacccgtttttttattgacttgcatcttatgccttaatgcatctaaatcaaacccatcctcatcctcggaattttcttcaaaattttcttcacgttctctgtcagcatccaaaaaaaacatcacaccagacatgacaatcttaacatcctgatgtaatgctgcttgggtcataatttctactgttcttgaatcatcccaaataccacgtctccaaagttctctggttaattttgtggcccagattccctgggaatctggttgatctaacaaattaaagcaaacggcctgcgtagatttgttcaatttttgatttttaccattagtattacaactttttaataaagaaattaaatttgtataaatgattttcctcaattccttggcgtgtgaattaacgccgagtgaattaccatgggaagagtaagcaaccaataaaggaaataagctttgaattaattcctcagcagtaatgacgtccttattccttaacatcgtcaaacaacttaagattttttctttcaattcaaatggcaaggacttatggtgttccagcaaaagctgctttaattcagacgggaagtttgcagtttcacgaggaaaacatgagcagacttgagatacgaagccaaccaattcaataagttgcgaagttgaagtgctcatggtggtaccgttagtacctgccattgtagaagatccatttcctacatcgagcccattagtggcagctgcagaatcacctccagcaagcccatttaacataaaaatgtcccttagcgattcataatgtgcatattgttgaagaaactcctcttgataggactctgggtcacgctttaccaaattctgtaaaagaatgatatttgttgggagcatagctgctctacttcttctacccattgttgatgcccttgattggtatattcagtgcgtcttgtgcttcctccttaactattattacttattcaaaaaagtgacgtttgatatgtttttttagtggtagaacgttctatctgttaagcgtgttatggttatctgcgatgagatgagtttaaaattttcattttttagccgatcaagcaaaagaaaagaaaaaaaaaaaaaactgaaatttccaccttacccgtttttttaatggaacagtgattgttacgacattgagattttagatttatataatcacatacatattaaatagttaatgcacctttaattcttttgcacttcatgttctatatattttagccaaaaccaaatgtattgcgtctttatttccgttccctttttccttcctagggttgattacctaaacgttacctaaacaaaccgtcaatggcgtcgtaattaatcttcttggagaaacttgccttctgcaacatgttcttgacactatcagcagttgtgaaatcaccactttcctcagctgccttcaatgcagcgtgtaaaccagacttatcttgtaagtctgacatcaatccgatagctgctgctgcatccacagtttttgtaggttcgtcacttctagtattattcctacgtctcgtacgtttttttttcactgatgtgttacctgtggcaatatctgcctcctgtttcaaacgtttactctcttgttcaagtaagaaatctgcgttcagaccaatccaaattctttccttcaatttagaagcttcctcgtttaataggtgcgcgtttaactcctcatcatcaacatcttctaaattatctgggtcgtcactaactttcgaaaggtatgtgtccgttgtgggtaacaagtgtaaattgcgaggacaatatgggtctgtttctagagagtaaccatcaatggcatcttgaaaatgcccagattcgttctctttcttttcttctgatgtttttgtctttaccttcttgactttttcctcagtcccttccgtctctttgtcttccccttcaacatgctcgttctggatagaaacttcagaaagtttgcgtttccttgtttcgttttcagaaccttcatggtatatattttcaccatctataccattagtagccttaatcctctccacaacacgggcccttctttctgaaaattgttttaagtaaaacaggacttccttggaagacagttcttgttctcctaatacttgcgtcaaaattggatttttattcaatgcttcttcacttgtttgaaacatctcttctttgtctaaagagtcctttatttttctttctttctttctgttcttcacaaaggagggaggcctagcctcaccgtcttccacatcattttctctaaatttttgaactgaaagtttagcagcctttgtatttttgaattcgttcaaccgttgctgtaaagtttcctcggcgacatgtgaaactgcgacgatctctgtatgagttcttctcaaattattcatcctgcaagctagtagaatacatgcgccggcaatacctgcaggtctacgtccttcaaacatccagtccttggacattctttgagccaattttacggcatcttttaccactttgatcttcttgtcagcaagatccaatttttcggcaaaatgttgaatgaataaggaaggatccgctaacggcaattctgtgatatgtaatttctttaccattttcaaaaatgtggctcctatggaatacacactcacctgtaaccttgaagagaagtcgatcagcatatgatgcgtcttttcctttctacatgcaacgtaaagacatgaagcgataacattttgggacctacgaccttgtacaaagttattagccaatgcaagcttataccattggaaagcagcatctgtgatatattccgggatatgtaatgcgtaagaaacggcgcgtaatttccttcttgcattgttcaatgtggcttctctagattctagagcactagaaccaccaaatgcagcatgactttgtcctgcaccgataaaagaaccttgtactacagcagcacctgcacttgtttcaccgaatgtaacttcagagacgataggattatcttctgagacaacaccacaagctttacaaactaaatcgttgttagcattggaaagatctctctcaaattcggttccgtgacagttcttacacactggcattggtatatgactatggactcttttttattaccgtttttaccattgggattgttcttgatgcgatcaaaaatatgattttttttatcatacctgatacttcgcgaaaaccttagaatagcaaataaggccatcgcaacattaatagacaaaaattagagtcacttcacttcgttgatttttgatagcgacggccgtgaccattgcaagatttctaatgaggggaagaacaacttttcttgtagattacctccactttaatcggatgtctttttttacgtccaagagtattcaatgtcatcaagatagaagcaaatttttctaacactaaatgttatattgcatctgtatcagtatatatgtgtatgtgggaagccatagttcactacttcacaactttaaaaacaatctattttcctttgttcactaagtgattttgtaggcgtgatcaagtgcttaccggggggtttttattttttttaggttagatccgatggagaagcgatgcaggtgaagtttaataagaacccaattcgtaagcaggggcacaaacaatcaagaagttatcaaagtcacttttgagataccaagaatctaatcagattattttatcattttattttaccatcaattgtaattattctagtttgggaattcgcgatacttcaatttgctaatatcagtaaccacagaaaaatggcaatagcattatggtattgtccaccacaaggatcagttgcttacgagacattacagatgcttatattttcgtttcaaacgttgttcccagattcaccagtttttgaacctcatgtgacggtaacgtcccatttggtgtgcaatagtaaagatgatgtcaacaaaatcttgacctcctgtgttgctgccatccaatcgataaggtcacaccaaacagcaaagaaaggacgtaagggacaggtatcccatgctgttgcagctcctttggtatctttcaatggatgcagtgtaggtaaacaatatttcaagaaaattgtgctcgagtgtaacaagaacaaaatactttatggggtcgcacaagtcatgagagagatgtacgtagagatcgatcctgagacgcgaagtagccgtgccgccacttgggtgcacgaggaattccatcctcacgtctcattgctttattcggatattcatccggtaagtcaggcgtcattgcgagtagttcaacaaagaattgaagatgctctagacgtgcaactagttccaagagagaaacgtaagggttccggaaacgctgatgggtccaatgaagtgcaaatgagatgggattttgacgtatcttcatcgctatcttggaatatcccaggaacgtttaaagtggtcaactgtgtggggcccgttcaagaatgggaggtattgggacgggtggacgtttaagcatacatttatgtgcactgtaagtaattatatagaattttttttttttttttttttttcatatctgtcaatacttgaaaatgttctagttagagatttacgtatactgatcgcttgccttcgcaagggatggaaatcccttgaaaattaaaaaaatccccccctaagcagcgaaaattgtaagatccataatatttaagaaatgacgaagaacgtagtcttatcgcagcagttttccaaacaaagaatgccattcatcaaataatccacaaccacctcaagaaaaatggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaattacactcgtctttatacgaaactggctccgttaatcacgacagacaaccttaattacattacataataataaataaatgacaactgtcttctttacagcgtatgttggagcttactcccgaagcataaacccagttcttctagaagaattgacagcagaaaggaaaggggtaccgaaggcaaactcaaccttaaaagttccgtaagcaaccgagcctccgcgaaggttgcataacttaaaagaaaaacatagctcacccggtgataccgttacaacgcgttaatcttaatgctatgactcggaaccacctgcaaaacagcgctaacggaaatttccatggaaatagaataagggacgcagcagggtttttttttttggcgagcacacgaaatataaaattgcttcgggccagctgcatggaagggttaatttcgcccctttatcgcaagctacgcagttctcctggctcgagaatgaatctggcccgccgcagacgtttcctggccccagattaggaagcagcggcggcggaacggaaggtgctctaagcaaaataaggaatattagccacgccggtaattcccctcctttggtctgcccctggtctgcccctttcgttttttatttttttttgggtgaacggaatactccgtgggcggcacaaggagagcctgcgtaggaatctgtgcgtctcagtcgggcgggccgatttagcaccgatggttcgctttggcttgggcttacggtgactgcgagatttgcagattagtgcatatccgcgcctttgtatgacgtgaagcgatccgccctgaacaacttgttacgtatatgatgttgactctgcgcccccgtctctctggttgctgccttctgcgctgatttggtgcaatctttcttttttgtctttgaaagatttaagctttttttcgagaagaaaaaggaggaaccgaaaaaataatctttcagttgttgacccgtagagcagaaaatggaaggcagtagatatccatatcgaaggaaaagcacaaacttatcacgtttagggtattcattaacgttgaagtaatcaggtagtgaatagctcgaagttttccatgctttcctttcggttgcatctttcttcctttggggttttatcttgatacgtcgttacttacctttttttccaatatatatatattggtagtagctgatcattgcagaagatctagatctcctttacacgctttaaggttaggcagctgtaacccctatattgaattttcacccacgccataaaatacaatagctcagagaaccggtggccacatgcaacctaaaactttcgtccaccaacttcatgcaattcttctggaaccggaagtaaataaatggatatactggtctccgactgataacacggtattttttttgaagccatatgaccctaattttagtacacatgttctgaagcgttatttcaaacatggaaatgtcaatagttttgttcgtcaactacacatgtacgggtttcataaactatctcatccttccccagaccaatcttctgccaacaatggtaacgttaaagaacttgttgaatggaaatttacccacccatctggattcttcttcaaagaggccaacgccggtatcttgaataaaatccaaagaaagagcactggtgtgggaaaagatggtaaaagaaagaatatactgtcaccaatatctgtcagttacgttgatgcttcgaggttaaatgttctctctcagcaatccggaccagtttctgcaagagaaccatcaaacatgtttatgggcagtcccgtccattactcaacatcccaaagtcctccacatatcagtataccgcaacagcaacaaagtagtggaccttacctaatatcttcactgccccctcaacaacccacggtgaacatgatgcgaaggcaaagcatctcggcgaggatgatgaattcttatgactatcccaatcaattttccacccaagatagcatagtccagcctcagcagccgcaacaagtactttctccacaagcattatctggacctccgatgaagaaatcaggaacactatcttcgacagatgatctgaaaacaacttccttgccaattgttaattacccaatgccgtatcatcctggagcttttgcccagcagcagcagcagcagcagcaaccgctccctacagtcccgccatatagcagttactccactccatttccctcaatgatgaactctctttcgaactctgcttctaactcacctgctttaggagtttgtaataataatgtaacactacccaaaaaaagcaatataagtgaaaggcaagctttggataaccatatacaaactttaaagaactctctatcaacaatcactgatttgatagaaaaacatattaacagcgcatcgcaagatgaaaataaaactctaactaatgatgccatgaacaaagaccttcgaacaagcttatccctattacagaattccaaggaggaaatcattcaacttgaaagtaaatggatgtctatgcaatctgttaaaacaactgccctaccccttcaagagactacgaatacatcatcgaccttaacttctctgacgtccagcataattcccaagagtatacctataatcacgaaaggtgaagtcgccactaaaccagcatcttactgaattattttcaacagaacacatcgcatccaactgaacaaactgttaccgctgttgataccaaggaacattcagtgaacgtagggaagaacgaacattctccatatttttgcatactagatacaagggggaagaatgcaattatttcacaaaccgaaagaaaaagaatcacaagctatgtttgctattatcaatttttcttatgattaatttaacataaattatggcctttttcattccggctgcgcttgttctccaattttttttttttttttgagaaaactttaaaaatttcaaatgtaagaaagtagagcagatcttttagcaaggatccgcttaacattccaacaaaaaaggaaaaataaaacaataatttcgttccccatctatccttcgcctctccttcgctctgtaattttttttactcgcgcgcttccgacttttgaaagaaggagcaataaagttaaataaatgtaattaaattatgcttttttaggcaagttcgggactttgttgccacgtattgctcttctatgcaagcacttcactccttttctttcatctctgttttcttccactggctggaagcttgagggttgcctcttgattctttatcgcctgcaaccattgccttgttccgtcctctcaaggcgttccttccgtgctttttaaatactagaatcattcgagacgtatttatgagcatgttacttcttgatgtttatctaagagggttgtttaggttatccgcattatttttaaagttttaaggttacatcatttattcagacgcgttcggaggagagtgcattcaccaagatgtaaatttcttcagttttccggattaggattggaaaaatgaagaaaaatagctgcagaagagccgaaaataggtcagaaaaaaaaaaagacaggcaaaataggtgtaagcgttaaatgcctattgcctgctgtactagctagctaaagtaattgtagcagttgttattaaggagttctttaaatcatattgcttgcttgtatcagaccattggaaacttcaatgtttaaactctagaaaggttgatctgctcaaatattttcatatttacggcatgtcctaacttgaacatttgtagaagagagacatatttcttagtgtaggcaagatatttgaatgacattgtctgccgaaatatactcgacttgcagtggaactgcaagtcgaaaaggatatcgctttagccaaacaaaaatttgttgtgctattcagtgagcatgcattggctatagaggccgcacctaaattgtatcttttgatttatgtaactgccacactttctctagcacagtcatgatacggctttttttcatttagccaccaaatactgtaaatatcgttttagaacgttatgaaaaaatgctcatccacttaaaaacctctccgtattctgaaagttggtataatcttgcactttaagtgtatatctttttatgcaatctttttgaataatgagtgtttttcaaaattttgacattcatgtgaattgtttatctatcctttgcatagtaaaaaaatagatgcagaatttactcacctcaaggaggggcaaagtaataagaaaagttaccataggctagttgaatgtccaagatcgtaaagaatgaagaaaaaaggagtaaaaagtatgaataagataaatgaaaatataaaaataaaaaccaactaatacatgaagaaaaaaaagcagacaaaaacattttatggacctgatgcaatctagtagtccatagaataatcaccactagaaaattcttcctcttcattactaccgtttgccattataggaatatgatttgctgcaggattctgcggaggtattatatagggcactggcggcacctgtggaataaacccaaatgatgggaacattggcatcatccagttagcgttattttggtttgcacttattaagttgtaactgttcacgggctttgtgttggtattagggtactgcagtggtatgaaataattttccctcgagacttgctgttgcgattggttctgagtcatcaaggcattgataaatttcttattatactttgttggataagccttatgataatcattatgtggctgaaaattttggaactttgatgagttatcagtttgggattgatcatcatcatcacttgaagataaattaccacgtttctgagcgaaagaaacagataacacttgatctttgctcacttgatacccgtctgtattcaaaattgccttagcagcatctaatgggctttcaaaagaaacaaaaccataacctcttgatgatcccactggcagatcattatctgatgagctatcattcgattgttgacgatacttgttcttactacccccaacagtaatgaccttaacgctgattatttcaccgaaagatttgtagaaatcatataaatcttcatctgtccaagaaagagggatgtgcttgacatataggtttgattcttgctgattactcattggtataggtaagctgtaagaagttgatgggtactggtacatgtcaaacttgttgcccatgaatctaggcacacgttgaccacgaccttcactgaaagattccctttgaggatagaacagatccattttctctgccacaggggttgatcttacagaatcaaaataccgtacattggaggtatcgttgctgttcccgtttttattattgttgaagtaatatctatcatatgtataattattgtaatcatacattgggttatttgcaaattccaaaacctccatatcattgtggttactgatggaagggtgcctgtcatggctattgtggttgttgtaaactttatgttgaaccgccttattaacaacgagcctgtttccatgccacatgaacccattgaaggtctcgatggctgctagtgcttgttcatggttgataagcttgatgaaaccataacccttcaacatatcttcatcttgggcatttccattagtattattggaagatttgtttgattctactgacccctcctcattgaaacttactgaactactgcttcttgtattacttctcttcggaaagtaatatgaaatgatatcaaagtccggaaacttttttgataactccttcttgattacttctatgacttctttaggtgtaatcaaagtctctactttttcaggattgtgataaggcaagttgcctataaagagacacctgaaattatcatcattgttgttttctttgacatggtcccaatggattctttctctctcctttcgctcaacgtgatagttgataaatagtgtggagccatttaccgtccttccattaagttccttgatgcaaagtgaagcttgagaacccaaggggtaggagatgaacccgtatccgttaggttcgcctttcgttttatcatatatcaatttcattgataaaattggtccatattttgaaaataagaaacttagttcaccaatagaaaggctctttgctattcccccgacaaaaatatttccaggataggttagtgcatgcttgttcacaccgatagaccatttatcaatatgctgaccaataggttcgctcttgagtaattccgagatatctgtacatgcattttctaatgacttggggtacttgaattgtgcttgcaaaacggtatcgtatctccaatcatcttcctcttcgttatctttgtaagatttctcatactcttgacttccatgctcgtaaagatagatgtctttattttgttcgagaacctgtaacctccttgtatccggaagaaattcatatgtttctgtatcagagttgttaacggagatacctttgtagtgctgtattgtgtccattatttgatcggttattctagagttgcagtgatcatcttcttcttcttgtaactgccattttattcttatggttaataaatttgtgttggccaattgttccagttgaagaccagtggaagttttcctttcaatttttattgattggtctccagcttctgcgctcgctgatgtctgctggctgcagatatctgtatcctcggggccactagatattacttcatctgatggttcttctgcaatattcatcctcgaaacttctgatgcggtttgtctttcacgtataatgtttttagtaaaataaaacttatggtttatttttggatttttaatcagggtgccttgtaatttgggatgtgtgctatgctttacttgttcacactttttttgagaccgttgaacgaactaaaattaagaacactctaatccttcgaacaaaaggcacttttcaactattatttacttattcaatatttaagggaagtttctttattgtgcttgacatatatatatgtatttatttatatagcgcagtggccaagaaaatgttaacgtgaaataacgactaacgggcaggcgttatgcacggaaagagatctactaaattccgcccaatagggaatctccgactgaatttttttgccctttggtcaactattcccgggaagggcataaattgaatcaagcgccaattttacgtcttcggctagtaatcggatcagcgggagaaacatcgtacgtacacaagagaataccgagagtgtcgattaatcaaccacgctccatgaggcttatccgcattctacttgcatgttagccgggaaaagacataaatcatctcaattctctagaatactctagagattatgtaaaagcgtagccccgtagatgattaaataattttcggtttcttaccccgtaaccacgagttgcggtgtttttgcttctatcggggcaataagcgggcgctgcttctcgggaatgtaaaaactgtgcttcctaccatgaagtagttggatcttgaaatgggttgggccggaacaatatgcaagtactacaatccttgtattcccatatgattatattcccctttgcataggctagtgttttttttttcgttcttttgtttcttccgctaggaatagtagtggcgatctgcagaaagacgctctaaggaaaaagagagaatttcgatcagtcccgtacacattactcttgggaagttcaattccttcggacgtaatccacatacgaacttggctctcatctgttgtcttcaagctgttgcggccctcctctttctctctgttgtacacattttttgactttcaaaaatatgccgctaaggaaacataacccttgtgtatgtgagcttgtagcatatgatatagtgctcattggcatgtgacaagaattgcgtatgtaattgaagtttgtagtgtaatttacgaaaatagccgcccttcttcttcattaacgattattgagcgtaatgatataagatacaacggtttatttagggctgcatccatgaaaatactttgtaatagtgagtcgtcgccttgtttgtttattcaatacaatgcagtgtctctatagtctcctcctttagtttcactatcttttctaaccgccgaagatatacgagtgttctgaacgaaaaacgaccttttcaaacatagaatataattgtatatatacatatacatatatgatacgcagccacattcgtagtatctttaagacactgcctttcaaaaaagctttggtattttgaaagaagatcgaagccaaggaaccaggactacaatgaattagacgctacaaagtttcttaattggaaaacaaggagggacaaggaggagacttttacagtaaaccagaatgctccttcactgttcagttatgtaatgttattgtttggaagatctgaagagaggcatttcctacaacctcttgaataaaatagtggaaggcatttacacaaagaagccgtgccactttggtccggattttttttacctaaaatcgtcttaaattggcctgttcgatagctgtcatttgttttagatatttatttcctaacgtcagctttagttacagtatgtatgtatcaaccttttagtaagacaataatgattgcatgtttgatcctgctttaaaggcattggaagtaaccgtagtggccgctgtttcttcttgacggcctgtaattgacctgcgacgcgggcaatttctagcgatgagattggaaaaactaacgcataaaaaagatttcaagatttataagatgttgaaacaaatcctcttctcacatctacagttgatacagtataccgtattatctttcctcggtagtgttcagaatgagtagggccaaagaattacaagagaagctcaacttgcaagcgaaactccagtctactttcagtaacaatactgctgcagttttggactggctgaaagaatcagatgaaaccggcattagcaatgatacagagcgtaacaaacagttaaaagatcacaaggagttggaggatggtaagaaggcatttttcaagcttcccgttttgcagattggatcgggcctacacttccgcacacaagatgacgcttccgccaaagaagatatacatacgattggtgagtttattgagggtgataaaaaggtaagttcgttggcaaagaaaaagaaaagaagtgacccagggttgcaacgaaataatatgtacaggatcactaaagatgatacgaaagccatgattgcgcttaaaagaaaaatgaggaaaggcgagaaggaaggactaaggaagaaacaagagcatagcaaaagcagcgtttcgaactcatatagtgccagtgatgaagaggatgaagatgcagggacaatgccgcaaaagtccacaaaaaaaaaatttggtttactttttgataaaaaaaagaaggcacgtaaataatcttaaacacttatgggcagcaaaaaatgcgtctttcttccctcgtctgttgttttatgtagggcgtaatgatgtttgcttgtcaacaaatgaatacgtacagaagagaattctagccaaggcaattattgcatactgcaagtactgagtacgttaacgttgctagaataacattaaatgagatgtagcaatgcagatccttcctcagtaggcttaatgctccactagaatttttgaccagccactatttgcttttttcgcaatccttttcaatactcgagagcaaagacaaaaaaaataagacatgtagtgcgctgtatggaaaagaattaattagaactttacaaacgcgtgttaaacaggcatatttaagtgtttggacctaaacaatatatcgactattgaaattcttacgcaagattttttatagttggatattcatatattcttacaactctctctactttcagttttttgaagctatatgtatcattatatacgtttatggatttttcaaacctaaacaattatactgcgtaaatgtttgattaagcaataaataaaaacaaaggattggtaagggaagaccgtgagccgcccaaaagtcttcagttaactcaggttcgtattctacattagatggtcacaaaacatcagattgaagaggatcacttggatggagctacgacggatcccgaagttaaacgggtaaaattagaaaacaacgttgaagaaatacaacctgagcaggctgagaccaataaacaagagggcaccgataaagagaataaaggaaagttcgagaaagaaactgagagaataggaggatctgaagtggttacagatgtggaaaaaggaattgtcaaatttgaatttgatggtgttgaatacacattcaaagagagacccagtgtcgtagaggaaaatgaaggtaaaattgagtttagggtggtgaataatgataatactaaagaaaacatgatggtcctaactggattaaaaaacatttttcaaaagcaattaccaaaaatgcccaaagaatacattgccaggttagtctatgatcgaagtcatctttccatggctgtcattaggaagccattgactgtcgtaggtggcataacatatcgacctttcgataagagagaattcgcagaaattgttttctgtgccatcagttcgacggaacaggtacgcggttatggtgcgcatctaatgaatcacttaaaagactatgttagaaatacctcgaacataaaatattttttgacatatgcagataattacgctattggatactttaaaaagcaaggcttcactaaagaaatcacgttggataaaagtatatggatgggatatattaaagattatgaaggtggtacgctgatgcaatgttctatgttaccaagaatacgatatttggacgcaggtaagattctattattacaagaagcggccctgcgaagaaaaataagaacgatttcgaaatcgcatattgtaaggcctggtttagagcaattcaaagacttaaacaatatcaaaccgattgatccaatgactattcctggcttgaaagaagccggctggactcccgagatggatgcgttggcacaacgtcccaagcgtggtccacacgatgcagcaatacagaatatactcacagagctacaaaatcatgcagcagcttggcccttcttacaacccgttaataaagaggaggtccccgactattatgattttatcaaagagccaatggacttgagcaccatggaaataaaattagagagcaacaaatatcagaagatggaagacttcatatatgatgccagattggtgtttaacaattgccgaatgtacaatggcgagaatacgtcgtattacaagtatgctaataggctagagaaattcttcaataataaagtaaaagaaatacctgaatattctcaccttattgattaatgcgtagaagaagcttttccgctactattcctttcgaagaagaaataaatgtttagtacggcgagacgatgtgatcaattgaggttattttactacttttcctttcatttttgtaaggttttctttctttgttagtgtgacgttggtatttacctttatgtaactatatttatgacatttcaacatccgcttcttctggactttctgcagcttctttctctttcaactcttttatcaattcagcagttttttcgttatcatatattttgaatccgtcttgctttgttatacaactcaattgcgcgttattttcatcaagtttctcttccatcacttgctttaggatttttagaacaagaagctcagcttctttcaaagttaaagaagaatgccattcattcaataattctgcttgtgctccttcagagcctgaaccaatggctttggcattataacggtaaaatgtcccagatggttctgcatggaaaagttgataaccatcatccgcatcatggccagcaattaacaaggcaaccccgaatggtcgagacattagtctttcttcaccagaggcaccttcaccgaaccttagagcaagatcacacaccgattgcgttaaggactcaacattgatgtcttcatcgtagtatagattatgcgttactgcagcagtacgcgcatgttcaatcatggaacgagcatctgctgtaagcccactcattgcacaaccaatatgacgatcaatctccacgattttctcaatagaatcagattctaatagtggtgaggtggcacgtttctccacacctagtacaacaccttctttcgtggcaataccaattgctgtagatcctaatttgatggcctccaaagaatactcaacttggaataacctcccttctggggaaaatgtgcttacaccacgatcatattcacttctagttaagaacatcctttctagttatattagacaattggaatttatgttcttattgacttgtattctatagttatagcgctctcttgtccaatttcctaggttactcttttgccaccggtcttggtttatgataaccccgtataatgaaatttcaaaaatattttcgtgaatagtgatttatttaatttaagcactaaattatcttacggacttgggctacattcatgtttgcaagcttaataaaaaatcggcgtactttcatctatgcttggcttataatatgtttgatagtcaattcatttcagtaaaaagtcttcagcagtagttgcaaaagtgtccttttttactttttgggctacattattcttgaaaaaagttcatgttttgttatttctttctcacatactttataaaaaaagataatttttttaaaaaaaaaaaaaaatacaagtggaacattatcaaataaaaagcattatagcgccacatgcgatgaacctgagcttttatcttcattaatatatagtaattacaacatgttatttgaaatgcacagcacttatccagagttatttgatataaagattatgactcaaattcttctcgacaaacaagaaactttctcacctacaaatgtcttcaacaattctaataattgacacataagtatattgtatatataacatggatataaatggccctatattgaaagctatgtcaaaataggaatccttccttcctcagcgctttttatcaagggccaattgatctgatacacctagtagtgtactataagtgtagaaagcatactatactattcgacacttcctttcaatcctggaattaacagtcacttttaaaaaagacatctaccgtgaaggtgccgtagagtatcgcgttaccatatcgccaaaaactgatatacgccgcggaaaccaggcaaacaattgaaaagaaaaattttgaggaactctctgcatcgaagccgtctagagttaccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaaatggctgtctctaaagtttacgctagatccgtctacgactcccgtggtaacccaaccgtcgaagtcgaattaaccaccgaaaagggtgttttcagatccattgtcccatctggtgcttctaccggtgtccacgaagctttggaaatgagagatggtgacaaatccaagtggatgggtaagggtgttttgcacgctgttaagaacgtcaacgatgtcattgctccagctttcgttaaggctaacattgatgttaaggaccaaaaggccgtcgatgacttcttgatttctttggacggtactgccaacaaatccaagttgggtgctaacgctatcttgggtgtttctttggctgcttccagagctgccgctgctgaaaagaatgtcccattatacaagcacttggctgacttgtctaagtccaagacctctccatacgttttgccagttccattcttgaacgttttgaacggtggttcccacgctggtggtgctttggctttgcaagaatttatgattgctccaactggtgctaagaccttcgctgaagctttgagaattggttccgaagtttaccacaacttgaagtctttgaccaagaagagatacggtgcttctgccggtaacgtcggtgacgaaggtggtgttgctccaaacattcaaactgctgaagaagctttggacttgattgttgacgctatcaaggctgctggtcacgacggtaagatcaagatcggtttggactgtgcttcctctgaattcttcaaggacggtaagtacgacttggacttcaagaatccaaactctgacaaatccaagtggttgactggtcctcaattggctgacttgtaccactccttgatgaagagatacccaattgtctccatcgaagatccatttgctgaagatgactgggaagcttggtctcacttcttcaagaccgctggtattcaaattgttgctgatgacttgactgtcaccaacccaaagagaattgctaccgctatcgaaaagaaggctgccgacgctttgttgttgaaggtcaaccaaatcggtaccttgtctgaatccatcaaggctgctcaagactctttcgctgccggttggggtgttatggtttcccacagatctggtgaaactgaagacactttcattgctgacttggtcgtcggtttgagaactggtcaaatcaagactggtgctccagctagatccgaaagattggctaaattgaaccaattgttgagaatcgaagaagaattaggtgacaacgctgttttcgctggtgaaaacttccaccacggtgacaaattataaagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttccattgccttttctaaagcgtatactaaaccatgaacgtctgtttgccccatgtttaacccctgtccagcgagaggatgtgtcgtatgtgctgcgtccccaacaagggcaactctatcagtgcaataacgatctgcatgtgttaattttaagggaaaacgtgctcttgtcttatctattatactaacaactcttggtgggtaaatttcatcaatatccgactcgtccttcaacgtggcgtatatttcctcagttctgaatttaatatcttctatcaatttatcggtgtccatagagccatcttccaatgtacggtaatagtagttcatgtctgcgtcttccaagacaaaagcagcattgataagtgcagtgaatgattctggaggtaatgacaacaaaagcctcgataaacgttcagatgaactccagactaaagtagcattattttcaggcatgggtaagtgtgcaattggaccagtgggtaagaacctctgccagccccttagtttaaagggaggatactctaacttcatgctggccacaacaccataggcattatacatccagcccctagatgggatctgggaaaatcttctggtaggagaattgaacccgtctgcacccactagcaatctcgtcttgtatacttcaccattggaaagagtgactaaaggccaggacaatggatcattagggtcgctgtgtttaatattgacaacttttgtattatcaataatatcaatggagtccttctttgaatcgtactgagaaattctgttgtataaggaggcctgtatatttataatttcaatcatacaaagcatggagtcccttgccagatccaaagtagccttagaacaaccgtccgtgacatagagtccgtcataactttgaatcctgtcatgcatcaaagttgccccagcgttattctcaagaaaatgaatagatctaggcgtaacactgacaatcctgttcgtaaaataatctgggggtgaattataaaagtccgataatttatcttttaagtccaccatatcgactaaagttgtctttagatcttttaattgcggagaattcttaatcgatgcagctaaagtcaaacctgcaggacccccacctacgattaatacatctgttaactttggagctgaagatttggctgttgccaaacccctcaccaaaatacgccgagtaagcataacttttgaaaagaacatgcctctgtgtcaatcgatacaaggttcactgaaagaccaatttgagttactgaatgaagaaaattatccgccacaattatatttattcctttttaatgtcgtatcacaattccagaagggatatttctcagaaacagtttaagatctgcgtgttccttctgcaagaagaagggaaaaaaagaaaggagaaacaatagcagcataaatcttgttcgataaaacaacatcactttttcttgaaacttcaagggtttgcctccttagcttagtggtagagcgttgcacttgtaatgcaaaggtcgttagttcaattctgacaggtggcagtttcctttttatttgtcagtattaataattgaggcgcccctaattttttttggcaccgctctcgatgaaaaagtagagacgtcagaaattgaacgtttcctctaggagtttattaactaataaccccgaaaaatggctctttaaccacgagtgcccacggaggttatcttcacccctattttcattttaaattttagatcactgctaggagttagctcaaatatatatatatatatatatatggagacaacgttgaagaattcgtaggtgcaggtgagcatattgccggataagtgtagttacgcaactacaattaaaaaaacacgaggaacagaatgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaaggagttaaaggcaaagttttcttttctagagccgttcccacaaataattatacgtatatgcttcttttcgtttactatatatctatatttacaagcctttattcactgatgcaatttgtttccaaatacttttttggagatctcataactagatatcatgatggcgcaacttgggcgtatcttaattactctggctgccaggcccgtgtagagggccgcaagaccttctgtacgccatatagtctctaagaacttgaacatgtttctagacctattgccgcctttcggatcgctattgttcatcatggatatttgccatctcgtcttaccgacatcaaaagggtgtgtgcatatagcagctatcatcccacttatgcaaccactggcaaaactgtttataaaatggacccagtttgcgtccttagatgcaaatcgagtagaatctagccatagtctttccttgcaaagttcataggaactccaatatattgcactaaacggaacgtctctccacagagtgatctccaaacctttgaagagggcccgagaaggacccaccattttcatttcctgcctcgtttcgtttaataaatctttaaccatcatccatgtctttgtggactttgatgatctcggtatactttgcagtttagttttaaccaattctaaaggtgcaatacttgttgctgcaaataccctcgcaattgcaccacaaaagagggggtttaatgttgggtacgtcgaggctataggagaaacgtctcttatatattcataaccactaaaataaaccatgttggcaggaatagccattaatagggtcaaagaaatacccctccacaaacttgtaataccttcgacgctggcaattttcgtgaatgcttctaaagtaccgttgaacttcaacgatgaatttttacagtgcagttcttgaaaacaagcactctcccaaaatatttttgcgttgttcaagttctgtcctccgacgttggtgaatgtcttcattttggagcctgagctaacggcgttgggcacttcggcagccccatcacatgaacagtcaggaatcatctgctgctgttgcagccgtattctcactacatccatcggtgtcaaaatcaaagaagtgagtactgatccagcaccggcacttaacattcgttcttttaaggtcaggctgttacttgtattgcgatcactcatatcgtattatcaacacctcgtttcctttcctacgatactttatggctttggctcatacgattcctgtgaagtgaactggcacaaatatgagggtagtgtgccccaattccagaggagtgatcttcccggaaatatgcaaaaatgacagaatgtgtcttattctctaattgctattctgagatcttcaagatggcgaaaaataacgttgcgcgtgtttgggtgggtgccaaaagtgtcatacctcaccgacgcaaagataccaaaaggaccgtatatatctactattcctggatcggttgactttgttaacatgcagaaacaaaggtaatgtttataaatagtaaatcatacataagtatatgttattacatctttcttttctttagtttacctgttgcggttgaaattctcttacttgtattgagcttcttatcaccagatatgtactcccttggaaaaaattcattaatccttttttgcttccccttctttttgcgtttattaacatctctaattaagggaatgagaatttcatcagacttttcgtgtggccaacctagttgagtcttcatgaatgaacgaagcatatcgagatctggtaccccccaaacaaacggcgtggtatcgtgatcgacttctggtctcatatacgcatcataaaccatgacgctaggaaaatcatcatctaagataatttcgttatttaccagtttttttctcaggtctttttcaaatttattttccgtttcttgcttacgtttatcaaactgcccattattataccagtctttaaaattttttaggtttccaaattctgcaatcacttcaatgcttgaaacgggacccatacccttcaatccattcgtgtaatcgctccctaaaagctgtgccaactcaatcatattctttctatccaagcccaataattttaaaatagattccgcatcataaaattcaacatagttcttttcgtggaacatatttttgtagatctttgtacctccaaataggaaaacatcactgtcatcggtaattataccatcgacaaggtttagttgtaacaattccgcacactgtgcttcagcttccataggcgcagtgatataggggattccaaacctcgatagtaattcttgcacttctttgatcatatccatagttacctcatccgaatctcttttatccttcatctgttgttcgaataattcatcctccacaaaagcgttctcggcaacgtttctttcagcagaagtggacaaagtcgtgtttttaaatgtatcaaactcttcttgttcctttatcatattttctactatgttatcttcttcatcttcggagaagtcatagtcgaatataagaggctttctatgctccttatttatagattcgacttttctactatcgttatcctctgcttcttttgaaatctgagatttagtgggaacgtcctcaaatagttcttctgataaaacttctaagtcatcgtccttgttttcatcattggagctctctttctcgctttctctttctaatatttccgtagcatttaagcctgtcaagagttcatagctactccctttattggtagtttctgctccactttcttgttcatttcttacgtttttatcttccacgaaatttgttgtgttatagggattatacaactgctgggaagcagttgaagaaaaccagctcggcatttcaggaattggagacttttccttcgtggcttcttgggacacattactctcggtattcttttgaaaaagcagggaattttcattgttaaaatcaaactgtggtatcttgtgagaaataaaattcaggttttgctccccctctgttaaaatagcccctttatcctcctgctgagacggtggcctaaactcagaaagaactgtcttgctggtccttttgatgaccgactctgatttgctattcaaatttgtgacatgatacggttgcttactatccggttgtgcgccaagtaatccatactgtactattggtggacgagcctctgtaccttttgacgttaccggcttagcgatttttgatttgtcgtccgcttcaggtttcttttccatcttagaaagttgcactgcctccatcatttcaatttcctcaatttgtttcaggtaatcctcatcgtcgtcttccacgctgattctgctaattctcattgttggagtagtcttggagggcgatgcctgatcatgtcttttgtccaaaaacgatttactgccagcgttgtttagggattggcccatgtaaggcaaccttgcagctttcaaagaaaaatcttccacaaacttgacgttcttgggcttgagttcaacttcttcccactcacattcatcagagtcacatccctcatcttctgaccggttactccttttctgtggagctgtcgtcgcgttagaagactcatgtcgcactatttttaaggaattatcttccaaatcatcccatcggagcacgtccccgtcctcagcattactatctaactgctttaccaaagcgcctgcatctttatcgtctattacgattgctttttgcgcatcagagccatcgtttgcccctagtccaagaatccacccgttattagtcttagtcaacttgtactctttactcttttggccggatatcctattgatcacctcctcgttcagcttagacgctccaccatcctgaaacccagtagtgttgattaacttttgagtaaaaaaattcctccttttcaccatgtctatttgaaatcttgagaaatccatactatttgggaagatggtctccaattgttctttcgagtatcccatcctcagtcttgatttcaacctcaacgacgataatatcaaatactgtgtggcctttggcagctcttcaaattcggccgatgctggatttatagtgtctaaatcaatgtcttccagtccatcaccgtttatcgaattcatcagtttttcaaaagttttattagagttaactcttgcatcttccttatcgtatttgaatcccggtatatcgggcaagtcccactcgtcctgaggtttgaagatctgcacactactgccactactcggtgtagagttttttacgttatcgtttgagccgttttgcaattgtaaagccagcagcttcctagcggtggatttcgcactctctcgttttccctgtcttctttctttcctctgccgtattgtttcccttttcaatacgggcacaccaccatcaaagacgaataccggcctaatgccaaagtataatagcttacaaattcttctaaagaacccagtaatatgagaattcttcactgcattcccctcctgatcacggacagctttcaaaaactgatatatccaaatggaggcatctactgccattctcttatcttccaaggattccagcctgaccggtcttgccgtaggacctgcaatatcccaaaatgaatgcacacccatgtctgaagtttggcgttctcccgaaaatgcttttcttcatggatgacgtgtagaaccttcaatgatttacgtacagtttttcaatccctttaaggtctctatatgtggcggcatcttttctttttcttttctttttttttttttcactctcccttttaatgcctccacggaggttcgaatgggttatactagaaagaaaaaaaaatagtgataattaacaatgaaaaaaaaaaaacagcaacaaaatgtggtattggggtcacaccactcattgactcacatcctctggaaacatcaaaaagctaccaaaaaagaaaaaaaaaaaaattcaagtgcgaagtttccgcatatgcaaaccttacttattgtataatattggtaacagcagctactaagctccctgactctgatttctctctctgtctcttttgaggagtaccttctgcgctactgtgttccaatggtatctgcgccttgaaaatcaatcacaaacgctcttgctatggcctgccttggacacgatacgtcgctgcttatgccgccaggtgtcagtaaatgctctgacgcacccattcaccccgcgcactaatttgcaaaatttgggggcagtttgggaatactccatagaaaaaatcgacttcaaatcaattccgcacaacgtcgccgtgttggctaaagtgaacggaaaatggacgacatggtaaaagaacagatatgtacatatacagaagccgcgatttcacatgccggccattatggcacacaaccaggtcttgtactgtcactatgtgcgttccggaacgcctgtacagtccatggtgaaccatttatttatttattattattattttgtacattattatttatgctatatgttattattattatcactatttaatattattattcgggtccaggtgaaataacaaagtctggcgccagtcacttgtctgggtgcccgtattctctgttacagcggtatccctctggattctgcaatcgtcgccggcttctactaatttttcctttcctttttgtttttttttttttttagttttttattttctagtttcctgctcgtattctgttggtttttccagtgtctctctccttttacaagtcacccattctctgcgaagaagcggtcgcaccaacaaaatagaaaataccaccggacgccggatcgcttattactcgcaatcatagttaccaatcacagccgggcatactcgggatctaccgtagaatcctatgcgtcacacatgaggacaggttacgaaccgtcgaaggcttcgcggcgtgtgtgattagtattgttttgacctcatccatacaccctgaaatatctgtcgcatctccgattacgttaaaaattctggataatatataaaccatgagttttcctttctttgaagtatgttcctactcgagatccttttgttattttattgccattttttttttgtttcatatgtacttcttatctactatttatatttctctatattaactaactctccaagctataagcatacgtccatatttactgtcttagaagtcgtattcacatcacagttttccccctcttcgcctttttcaaactattttcccccgtgagacagcgactgaaaaaaaaacgactgcgcagaaggcttatataaaaaaaaaaagaaatatttcttcactttcgagcattgaactattgtcattacctctagatgagcaacaaatttacaatggagtcacctaagcatttggtggatgatgtgcttttcatatcacccaccaatgatggatcagaagaaaagcctacggaagtcacgttccaggaagatgaaggccatgacgctagcttgcataatcgcagccatgacaagaagtcggaacttgccaccgaacgggaaattatggctactaccacggatgatgacggcatcccctccccttcccatccaatggaaaagcgtgtcttgcgcaaaatggatatatacttgattcctcttatggggatgctatatttcctttctaacctggataaatcgaatattggtaacgcagaagttgcaggtctatccaaggatatccaccttgtaggaacgcaatataacacatgtgtcacagtttttttcgcgacgtatgttcttttcgaccccataggtactaaccttctgaaaattatgggtccgccattaatgatgagtatctgtttgacctgtttcggtgctatttcgctcggaactgcttgggttaagaattatgctcaattgatcgttgtcagactactactgggtgcctttgaaggtatgatttatcccgctattaacatgtacctttcagtctgctatagaagagaacaatatgctctgaggttcgcttttgtcttcagtgcagcctgtttgtcttcatcttttggtgggctgattgcttatggttgttccaaaatcagcggttctctaaaggactggcaatacatttacattgtcgaaggttgtatctctttggggttcgtaccattctatgccttcgggttgagcaaaaatttggaggattcgtggtttttcaataaggaggaaaaagagtacatttccgaaagatacaagactatgaacacttttgacccggacgaaaaatttgaatggttccaagtgtggcaagcagttaaggatgtcaagacttgggctagtgctgtggcattattcggtatcgatttgactacttttggtctaacagtcttcttgccgatcatcattaccagtatggggttcactaatgtcagagctcaattaatgaccgtgcccatctatttccttacagcaattgtgttcttcatttgtgccgtttggtctgatcgtataaagttgagatctccattcatcctgggtgcttgtctgacgacttcgataggcatagctatcgtccttggttctcaagttcatggtgtgagatattttggcgtttacattctttgtatgggtatttacgttaatgctgcctgtaactgtttatggttaagtggtaacactggtaattacttcaagagagccaccgctttaggaattaatctatttttcgggtctggttcagggttggtctctggtcaaatttttgttgccaaagacaagccaagatatatcaaagggctgtcgattagtctggcctttcaagtcttctccatatttatgacggttgtgcaaattttcctatacaagagggaaaacgataaaaagaaagcaataatagatcgctgtaatgaattgggagagcctattccatacgacgaaaggttaagcgacaaaaaccctgagtttaagtacatgtattaggcttgactttcttcaccctccactttttttgcccctcgttatgagtgtgtttgcaatttgtaacttttcttttatatttgtatgtatttttgtactaagcaaattcacatgaaactttgtttaccaacttctcttttgttttcgtcccaaacacgtatattactgggaagatatacatgcctatatctatatctataaatatacatatttatatagtattatctccgagttctaaagctccagatgcgaagaagacgttcccgaagaagacgttcccaaagaagagtcactatactcatcatcgtcactgctctcttccgattcgtcttcatcctcgtcactgctttcttccaccacctttataattttccttggtttactcttcctttctggaatgtcggaaaaaaactcgtccaggctttgcaaacgatatttcttcccgttttgagatgtgaaggtgtttacgttacctttacctgagatgctattgctatcgccgtcattgatcccagtcaattttgcgttggagctagatgtgaaagatcttgctgagttgttggtaataaaagactgcgatgaaaaactttttttgtatttgttatagtctttcaattctgcgccttctctaatatcgttacctgtctcgccaacctcagtaatttcagtattccaaggaagcattctaaaaaattcttttatttctggggtatgtgtttccaatcttgcagaaacgataaaatcgtcacttcttgccgtaggtttaggtgcttgtaatagtagtgacacaatttcatatttccctgaatcaaacaaggatgaaatcatcctggctctatccctaatatcaaattcgtcatcatattttgccaagtaaaggaccgcattgtacatttgagagattcttgaaccactaaaatcatagtatgggggattttggttattttcttcgcttccagtaacttgcgcttgcttaaaattatcaatgtcatatgacaacagttttgctgataacactaagatctgacatcttgtctcaggaccctcatttgaaaaattctggattagcctcctcaaaacgtccggacatatcttaaattcaatcgaggcaatttcaccaaataaccaaacaatacctgcacgagcattatcagccaaactcgtttgaactgttaataaatctgcaagcttgaagattatgcgaagatgttttgtaggatttttttgcaccagcatcctgataacattcacgtatgcatctaggacagaagcagagaggttgtgggattccatatgatcaattaaccacttcattacatgtgattcccaactcgttgacaattggccacatcgagataatgacttaaccgccataataacaacattttctgggaaatgagcactggcaacataatatttcaattctttgaatatttctttaacgtttgattcatttattaacgtggacaaaatttggatcttccaaattgatgccacaataggatctttggggaaaacgtaaaatttcttggtgtagggtaaaaatagtgtctggtctaagatcgataagaagtgaattgcttgtaaaagcatttctttgttaccttggttttctgtcatggttaccgttctaaccaatgcttcaataaatttagtatttttcatctgcaatggtgaagctaactgatatagcgcattgcaacacgataaaatcactgtagggttggaactataaattaagcaattcaaactctgtagaaataaatctaaatcagggtcatttaccacctcgtaagatgggtattcaatctcgttgtatttatctggtaaaggacaactccttggggaaccttctgatgatttatcgaccacagttggttttggtaaatactgcttacagtacttgattagcagctcaattaaatatgattgtgaccacgaatctagttgcttaattattctacaatatctgcgaaaatgtccatgcaatagctccaagtgatccgcataacattctttgtaagctaggacagcacaggatatcaccttaggatctgtatctgccattaattctttcagaatatccaacaattcttcatgatagtcattctttccagccctatataatttgataatggccaaggcgacttcaccacgaaccattgcagatggatctgtaaccaatttcttgacagtatgcaaaattataggtgctaatgatgacattttcatgtcagaaagggcactcaaagcaaagcatctcagttcggaattcgaatcagacaatgatttttgaagagaattaatagataacagggtcaggtttgggtcattttctgcaaatctaagtaaatacaggtgaataagtcttttcactttggtgtcattagtggtgatattctttacaacatcagcaaagtataattgaacgtcaatagagtcatcatcggaagccattatagatattattctcttcattgcatctctaacttctctagagttcctagaatttaacaaggtgactaactgttgaggattgatgttttgagaataataagtataggaggattcacccagcttagaggtggctaccgcggcagcttccctcgttattactttggccgtatccaacgccgatgcaatacggtgaattgaatctaccattgctggttgtccacttttcgattgtttgctgtctttggtttacctttcttttctttatatatttatatatatggttcttcaaaaatgatttgtctgaatttgtcaaaatctcaataactcggacacgctttgatggtaacatacctaaaagttatgtacgttaatataaattatagatacatattatgtgcagcgatatacaggcagtacgctagcatttatattatcctagcatacttctcttacgaccacgcaacctgacctcttcgaatcttttggtaacttctttcagtttcttggcacctttcgcaccttgttcacgatagacctcttcgaacccctccatgatccaagcattgtatttttccgcatgcttcgaatgtgtacttaaaatagctctctctaagacgtataaatcgacgcctttatcttcgaccaggtttgaaactgagcccagaccgaaatcaatcaaatgaggcgtccatctcgcaccatctcgcacgagaacaatgttagaacttgtcaaatcaccatgacagtagtcattccagtgcaacaacccaatttggcgccccactttccgtagtgtagttgctacaagatcactatatggatcttggtcatgcatccaaaggaagttctttaggttactaaaaccgtgccctccgggaagatcttctccaaggaactctaaccaaatgaatccattgtatggatcacacgctatcagttgagggacacatagccctggaatcaagtataatttggccaataaacgcgactcattcaacgtacgatgttttgttagtgcctggtctatttgtggatgtctataacgctttggtggcctatatttgataatatacttttgatgagaatcctttgctcttgggagatatgggtgagtagtcgttgtgaaaacaatggcttctgcaccttgagaaataggtgcaatgtccacatcaggagtcaggtaggaagatactttatcaatgaattcttgcgtcataatgagcaaagcgtataaccttttccgctgtcgtattcatcacttatttgatttcaagtaaggttatctttgtccttcaagttggtgatgcgccggcgattttttcaaccttgttgctgctaaaataatggaaaatcaaaataaatttgtgctgacccaaatatttatgtatataaaaggggttatgtaattgtcattatgacaaattcaggattgcataaactcaagaatgcgagcgatagatggtatgttggtccagcgatccatattacgagagtagtttaatattgggcccgtatgataaccttggtgttcaaccagcacatttttggcggtaaagtggttacatccctcgctagcgtcactcattttctttgccaagatcttgttttgaaagctcaacaactcatcactaccataagtaatcatcacagagcactttttcagaatatcttgccacattttagtttcgaaattcttttcaatattaacaaaagggtcgctggtaaaatcgacgtttgggttgtttcctacaaacattcgcccaaacatcgaatgactcttcaaacatagaccatcccattcttgtgttccttgcatatattccttttctccctcgtggaagaaagtggcattggcccagggacttatggctatgacttttttcgggtatatttctctgtgacactttcttaaatataaaacaatgttcaaaacagcattgccaccagcagaatcccccataatcactacatttttgcaccccatagtcttaacaacgtaatcaaaaatggccacattttgtaaaatttgcagagggtactttttcgactggtcatcggtagctgtaacggtataatctggtacaagaatggccattttaggaaaggcatttcgcatattattcaagaaagaaaacgacgtaggcgtcaatttaagagcataaccacccccatgatagaatactaaaactggatctgtcgtggggtcaaatccttccggcataacatattgataaaactttgtgctaactattttgggtgcgtttaattgatggtcttggaaaatattgttttctggagatttctgatcttctataggaatgttgcatttgacatatgttggactagaaaatgtagaaggatataaacaaacaaataaaggattgagcacgtattgacagatgcgttcatcgaggatccaagaactttgtcttaaaaaacttctgttgacatggtcaaggcaaaacctacgtttgcgttgaaaaatgatcttcatactgtcgaggattataaatacaggcaccactgtgaacaatagagcggcaaatttcaatccatggaacaaatgcaaatggatggtactcaatcgaaagcccgcatcattttgatctgcatcctcacttgatacagcgctaataatttcattctcttgaagccgataatattcaacttttgagtcgagaccagagttggctgccattcttctttgaaaccttttcctttaaaattgatttgtgctgttctcatttcaagcgacgcagggtatttttggttttcagtttctttttccctcaattctatataattatggcgctaacacgttaaacatttgttattataaagcagaagttatttatcagaaatcaaatcatgaatattctcagcttaacactacacaattactcaactaaaagaaagggtataaacgtgttagcgggagaattgttttttaaacttgtttttatatcagagtaaaatctatatattaattgatacacttttatcatgtgaagattgaaagggaaaagagaggaaaaaaaatgcttccgatgaaccttacacttgttgaccaccatatttggctctccattcatcgattttcttttcatcaatacgttggaacaagtattctgccttgtttatattatgtccttctaggattgccaaatggaatctatcatcaatttttaaagctggtgcatttaacatcttgtttattttctcacctatttctggcatatatggtgtgataatagagctaacagcgtaaataatattcaaaccaactgcgacaacagcatctgacttttctggggactgtgaaaacaaggtattgtccaacttattttcttgcaaaaactggttaccacgagcacttaacgacatggcaatttctagaccacgtctttcatgtccaagttccatttccttgacgtaatttgataaaatttcgttgatatctttaactaaaccatcataattggaaaccttcttggggtcgaattttggaacaacaccattatatttggcattaacaaacttaattaatctgttaacaaagttacccaagttagccaacaattcactgttgtttctagcaacaaagtcatcccatgagaaatgagaatcactagattctggtctaacagatgccaggtagtatctccaaacacttggagaaattccagagtcttgagcgttattaccaaaaacaccaacacccctacttttagaaaatttaccgttctcatattgtaagtattctgtagtattcaaatggtgcaacatagtccagttctcttccgtacccaattgagaaccagggaaaacaactgtatggaaaggaacattgtccttacccatgaattgatacaatgaaacatgctctggattattccaccattgtttccattctttggtgtagttggaagtgatggaaacgtagccgattgtagcgtcaaaccaaacgtacaagactttgtctttatatttttctaaaggcactggcgtaccccaaactaaatctcttgtaatacaacgtggcttcaaaccatccttcaaccatgattgcgtaattgtttttgaattttttgaccagttaccttcttcagaggccttttcaacccattcagaaatttggctttctaatttatccagcgataggaaaatatgatcagaatattttggttctggagaagcatcatctaatttacaacgtggattgatcaattcaaatggatctaacagggcaccacatttgtcacattgatccccacgagcatcatcgtagtgacattttggacattcaccttccacgtaacgatcagccagataagaattatgaactggacagtacaattgcttcatagattgttcttctagataaccattcgaatttagctttgtaaaaatatgttgagcaatctccgtttgcttgtccgtcgtagttctaccgaaataatcaaatccaatttggaaccacttgtaaacgtcactgtggattttgtgatatttgtcacataattgtcttggtgtcacaccttcctccaaagctttagtttccgtggcagtaccatattcatcagtaccacaaataaacaaggcattataattacgtcccttacagtaacgagcaaaaatgtctgctgaaagaacactaccgatgatattacccaagtgtggaacgttgttgacataaggtaatgccgaagtgatcaagatgtttctttcgtttggcttaggcaaaatttctgaatcctttggcttaactgttaagtcagcttggattttcactgcgccgatgtttttgaaagaagaagaatcacgtggaacatgctttttagccaatgctacagcgttatgcactttggatggcaattctgggaatttagaatgaactaaagaagaatttagagcataaacgttagcaaacaggatcaaatctgtagtagtcaatggttcttttaattcgaccaagtaattttcaatggccttatttgtcaaaacctcgacatgttgttgaggtaattctttatgatataacaggttttgtaaagatgccaatgcaaattgatacttgtcggaagtttgaccttcaaaatcatccatgacatatcttagaatagcgttagcatcaaacaaaaggaaaggttcctttgtattgcgcaattccatggcagcattatcattgtcaacttcaggctttaaatttttgcttgcatattcaagtgctagggcaatcttcaaattgttcgctaactgcaaatgggcaggatgtttcttcgatttatcaaaggaaatgaggaaagacatgcttgttgtaaatttccgcttttttttcaagttttattcctccacaaagatgcatatcaggaagcaaatcatcattaacattagacatcgaagaaaatttgtcatcgtctttttttttttttcgttttctctttcgataagttgcgtacagaaattttttctgcctccgaaatcattcgtgcctcgtgatattgagaagaagtgactatactcgggcaatgcataaatgatcgtttcggcggctaacaaagataatcatagcaagtcgacagatcgataggatacaccattatcatcacgctacgcgttctcgggaaagctttgactagaatatttttcaaagttgaattatattatgttaatcttttgacttcatgccttttgaattcccctccataggttcccatttttgacttcaacaattcctacttcaaaatccctggttaaagaagcctttcctcagtttgtacaactatgtccgctgtagctaaaaagttagcataattcatgttttatgcctgagacgttttaaactagtacttaatctctatcaataaacttaacccagaaggtctcaagattaaacatgttattttttcgtccttttattgaaaaaagttgaaatagcagcgtcgggtaataccaggaatatatttttatcggcacggctacatagcgaagggtccattagtaaaaatgaaaagaaattccacaaagttagtgaggggaaagtcctacagaaggtcaaaacagttgctaccgggttcaaagtactcaattgaaaataaacactgctacaaaaatgcatgctacaaactggttcgacgattggaacccagaagctctttatagagacgatgtcactggctgcgatgactgttccgaaacttcgccaattccaaagtctggtattatatgtggaccgatattaagactcatcaacatggattttaaggaaaaaacctacgaggggtctattatggtggtagttagaggcgaggaaaactttccgaaaattacctatcagctagggccctctttgccctctgaggatgaagacatcgaagttaacgaggcattcttcgaaggtaaactttttcataaggacattttaaaagatgataatatatggttttacaggtatgagattaagttgcccatgtccaactatgagcagatggtaaaatatgctgttgacggtactatggaaccacattataggttcttcgttccctctttcactcaaaattcgaacgttatctcctattcatgcaacggattttcactgagcgtagatacatcgaaattcaaaggttctctatggtatgatgtccttaaaaagcatcgatacgttcattatcatgccattctcggcggcggagatcaaatttactccgataatattaaactgcatgcgccaaatcttaaagcttggctggagacaaaggacccaattaagaagtataatactcagaccactgaagaaacaaaagagcagattaggcagttttatttagaacactatttaaactggtacggttacggtcactggtatggttctaccccaaaatccaagaccacccaaaaatgctttgtcaagtcactagcttgtattcctgccattaatgtctgggatgaccacgatattattgatggctatggatcgtacaacgattccttcatgaagactgaaaatttcctcacagtgggaagaatggcttaccgatactatatgcttttccagcagcatgtcagtgcttctaaacaagatggcgatgagtatgcttatctcaagagcaaacaatggattctaggtaatgaaaaagggagttcttatatcggtgaaaggtctcactcaatattctcttggttgggtccgaaaatggccatgttagggttggactgtagaactgagaggaaattacacgagattttctcagaaagaagttattccttaatttgggaacgtgtcgaaagggaaataaaaaatttaaaaggtggccacttattgctgatgctcggtatcccgattgcatatccaaggttagtatggttagaatggctttttacctcaaaactactggctccaattaaatatttatctaaaaaagggatatttgctagtggcttcgttaacgaatttaatggagatgtagaactgttggatgatttaaatgatcattggtgcgcgagacatcataaaaaagaaagaaactacttgataatgaaattgcaagacataggtgctaaatatggcgtcagaataaccatattatcaggcgatgtacatttggcatctgttgggagatttagggcaaaaattcatagacaccatctcatcatgtctgaggagaaggaaaaggaaaacaccagaattattgaagaaccaacgaaagacgtaaggctgatttttaatatcattgctagcgccatagtaaataccccaccgccagatgcaatggccacgctattgcaaaaaagatgtcgcttgcatcatttcgatttggaaacggatgaagatgccgtaccaatttttgccaaggaagtggatggagtacataaacgtaaagaatcatgtttcatgaacaagagaaactggtcagatattatacctatagaaaacctgttgaataatccccaattgagtaaagaattaggcgtaaaggttggtgatatagtcattcctggtatcatcacagaacagcaaaagctacagaaattggaaaacgatgaccaaattaactcttatccagtaacttctggtggcttgtttaccaccattcatgttgaaagagatgcaaatcaaacaaactcacaaactgtgagctactgtttacccattccagagttaacagttacctgcgaacggttgtctcacaagggtatcaaacatctgaatatcacatagtttagttttgtgataattacagatttttatttagcagttcaaacttttctattcattactaacggactgtcaagtgcgatgctgtaccggaagtaaatgtatatactgattgttgaaaaaaaaaaaagctcagtcgcgcgtggcctttctctatggagatttctcaaacgatattaatcctgtatatctctattaatttagttaatacatacacgatatatcgtcgcttttatttttttttttcaaatacttcttcttcctaaaagagttaaaaactcttctcttgttttatgagccctaaaccctccaagcatacaagaagttaccgtagaagatcccgttttttgaatgcctcttgaaaccatgcacatatgagaagcttccataacaacggctacacctaatggttttagaatatcacttagggccattgcaatttgctttgtaagtctttcttgaacttggagccttctcgcatacatttctgccaatctggccaacttacttaacccgatgacttttttatttggtatatacccgatatgaaccttgccgaaaaatggcaccaaatgatgttcacataacgagtaaatttcaatatcacgaacaataaccatttcatcatgatcttcttcaaagacagcattcttaatgacatcgtccataatgttcgtttggtaacctttagtgaaataaagcatggctttagcgtatctttgtggagtatctagtagaccttctctgttgacatcttcacccagttcggtcaaaattgtcttgatagcgcctgaaatgcgttgaattcgttccttttcctcctcttcagtttcctctgcacgttgtcttgtacccacacttggccaagaaaacccatctctctcgacaggagggtttaaagtgtatggagaggtaggtctaatgtttaacggggtttcatgtctttctatctcttgcactaattggatgttatgcattttgggatgattgaaagtattggttctaacaaaaaatgagtcacgcacgcacaatcacgattgaggatggagtcgtataatattttatgaacggatgctatatcgatcagacggttggcaccgtaaaaataaatgaaagaagttaaagaagggcaaatcagtcggattatgtgataagtatgtaatagacatgtttgaaaattaggagcattaaaatatgcttttcatcctacagttgttcggtcttttttcttttcggtgagcgacacagcttttctactaaggccgtaccgggtcatccaaatcctaaattttcatgcgctaatagcgttgaggctgggtgataattctgcctacaccatgacaaagaggacatatatcttcgtccaacaggaatctggtgcgtccggaccctctgcattcaccacatagcacgccacccaggcgaggatcccctggttgaacgtacaagggcctattaccctgccatgcgttggtgtacacgggcattgtatagtttgtgtaatatgtcggtgcagaaacaacgttattttgaggtgcaaacctcctccaacacgacttgcaagatcgtccattcttcaacttgtaacccgtatttccacacttggaacagtaaaacctgggagggtatgtccagggcaagctaggattctgttgtggcctcggtggaggccgtggttgggaacttgtaggcgtataagagtgtgagtgagcatatgtttgggatgaggacgttgctggcattgtcgagggcctttggtggggtcttgattggtgcccttgcgccaagttagctgctggtcttggtggtcgtggcggttgagattgcaatctctcctcttccttgattacgtcctcgtagctcggcagttcatcatcatgcgtgtctttagacataacagtatggtttatactcgttttatgggtattttttgggactgcttagttcttgacttgaagcctctttattcccttgatggaagtgtcactattaaagatggaggcggaggctataccgtagaaaatgatatgtttgtatgttctgctctcttccctctattaaaagggggaaagagaaaaataaatggaaaaaagcgattaagccatagggaaaacactcttgtggtggcaaagcatcagataggcaggcaggaggaaatggcagtgaagtgtcaaaccaagcatactttcactggattgatttgaaagttaatgctgagtttgagatgttttaaagaggaactgtggtgatcggttatttctattcgcttttgtgtgcgtcttttcatcgtttgcagctgaacttgttgaggcattagccgctgaggaatttttttctgcctctataaacttgtttattatcactaaaaacgtaccgtctgttattttgtacggccatgtgtgcgaaaaaggacaaagtggtagcgaaagagcaatattgggacgaaaaggagcagaaaaggaactgcgtagggtcttaaataaagcaaaacgtctgaaggatcttgcgtactccttactaacccattgttgttttcgacagtcataaaaagaagttaccacggtctatttctctcttctcgctatttattcacaattggtgcagaaagaacatggcacgaaatttaaggaatagacgcggtagcgacgttgaagatgcaagcaacgcaaaggttgggtatgaaacacagattaaagacgaaaatggcataatccatacaacaactcgctctttgagaaaaataaactacgcagaaattgagaaagtgtttgattttttggaagatgaccaggtcatggacaaagatgagacgcccgttgatgttactagtgatgaacatcataacaacaaccagaaaggcgatgatgaagacgatgatgttgatcttgtatcaccgcacgaaaacgccagaacgaacgaagagcttactaatgaaaggaacttgagaaaaagaaaagcgcatgatccagaagaagatgacgaaagttttcatgaggaagatgtcgacgatgatgaagaggaggaagaagcagacgaatttgaagatgagtatttggatgaagactcgaaggataacaaccgtcggcgcagagcggccgataggaaatttgtagtaccagaccctgatgacgatgaagaatacgatgaggatgacgaagaaggagacagaataagccattcggcttcttctaaacgtttgaaaagggcaaattctcgaagaacaagatcgtcacgtcacccagaaactccaccaccggtaagaagagctttaagaagtaggacaagacattcgcgtacttcaaatgaagaaaatgacgatgagaatgataatagcaggaatgaagcgttaactttagctgatgaaattagagagttacaggaagatagtcctatcagggaaaaaagatttcttcgcgaaagaactaagccggtaaattacaaattaccaccaccactaactgctagcaacgcagaagaatttatagataagaataacaatgcactttcttttcataacccatcacctgcacggcgtggtcgcggtggttggaatgctagtcaaaattctggtcccacaagaaggctttttcccactggtggaccttttggtggcaatgacgtaactacaatatttggtaagaatactaatttttacaaccaagtcccatctgcattcagtgataataacaacaataaattaatactggattcagactcttccgatgatgagatattacctcttggcgtgacaccgaaaacaaagaaagagaacacgcaaaaaaagaagaagaaaaaaccagaaattgcagacctcgatccattaggcgtagacatgaatgtaaattttgacgatataggtggtttagacaactacattgaccaattaaaggaaatggtggccttaccactattatacccagaattgtatcaaaattttaatatcacgcccccaaggggtgttcttttccatggtcctcctggtacgggtaaaacacttatggcaagagcgttagcagcaagttgttcttctgatgaaaggaagatcacattttttatgcgtaaaggtgcagatattttatccaagtgggttggtgaagctgaaagacaactccgtttgttattcgaagaagctaaaaaacatcaaccttccatcattttttttgatgaaatcgacggattagcgcctgtgagaagttccaaacaagaacagatccatgctagtattgtttccacattattagcgctgatggatggtatggacaatagaggccaagtcattgtcatcggagccacaaatcgacccgatgcagtggatcccgcattaagaaggccgggaagatttgatagagaattttattttccattacctgatgttaaagcacgttttaaaattttgcaaattcagaccaggaaatggagttcaccgttgtcaaccaacttcattgataaattggcttttttgaccaaaggatatggtggtgctgatctgaggtccctatgcactgaggctgcactaataagtatacaaagaagctttcctcaaatttataggtcaaatgataaactcttggtggacccttctaagattaaagtcaaagttagcgatttcatgttagctttgaaaaaaattgttccgtcatctgcgagatctactggtagttctcctcagccactacctgaattaatcaaaccattactggcagatcaacttaataatttaaagaacaagctggattatatgctgaacattaaagacacaacttttcagagaaacacatcattgctacaaaatttcatcgattatgaagaatacagtggagaggaagaagagcatgacaaatatggaggaaatgaagatacatccagttttagatcatatgagtttttcgaatcgatggcggaatcacaaatttgtaaacctcggttattaataaatgggcccaagggaaatggtcaacaatatgtcggagccgcaattttaaattatttagaagaattcaacgtccaaaacctggaccttgcctctttggtttcggaaagttctaggactattgaagctgctgtagtgcaaagttttatggaagcaaagaaaagacagccctcagttgtatttattcctaatttagacatttggatcaacactattccagaaaacgttattttagtcttatcaggtttgttcagatctttacaaagcaatgaaaaaattcttctattatgcttagctgaaaatcttgatatatctgaagttaaaaatggtattttatctgattttgcttttgataaaaatatctttcaactgcataaaccatccaaagagaatataacgaggtatttttctaatttaattgaactactgaaaacaaagccaagtgatattcccatgaaaaagagaagagtcaaaccgttacctgaattacaaaaagtaacttcaaacgcagctccaacaaattttgatgaaaatggtgagccactgtctgaaaaagtggtattaagaaggaagttgaaatcttttcaacaccaagatatgagattgaaaaatgtgttaaaaatcaaactctcaggcttgatggatctttttaaaaacagatataaaaggtttagaaaaccacctattgatgatgccttcttggttcatcttttcgaaccagagacaagcaatgatcccaattggcaacctgcatatataaaagatgagaacatgattctggaggtttcaacagggcgaaagttttttaacatggatttggatattgtcgaagagagactttggaatggctattactcagaaccaaaacagtttttaaaagacattgaactgatatacagggatgcaaataccattggggacagagaacgtgtcattaaggcctctgagatgtttgccaacgcgcaaatgggtatcgaagaaatttcaaccccggattttattcaagagtgtaaagctactcgccaaagggatttggaaaggcaggaacttttcttagaagatgaagagaaaagagctgcaatggaattagaagccaaagaacagagtcaagaaaatatactgcaagaacctgatttaaaggataacaaggctaatgagtttggtgtagctgctggtaatcaattgcaagctcagctgcaaacaactatcaatacagcctctatcgttaataacagcgaggtccctcaaccaattgataccaacctgtataaaaaggagattcctgcggcaattccctctgcagtagataaagaaaaagcggtcatccctgaggatagcggtgcaaatgaagaatacacaacggaactgatacaggccacttgcacgtcagagataaccaccgatgatgatgaaagggccagaaaagaaccaaaagagaatgaagactctttgcaaacgcaggttacggaagaaaacttcagcaaaatagacgctaatactaataatataaatcacgtaaaggaaattcaatcggttaacaaaccaaattccctccacgaaacggtagaaaaaagggaacgaagtccgataccaaaagaggttgtggaaccggagcaagggaagaagagcgacaaggagcttattttgacgcccgaacaaataaaaaaagtatctgcatgcttaatcgaacactgtcagaattttacggtttctcaattagaagatgttcattcgtccgttgcaaaaataatatggaaaagtaaatcagcatgggataaaacaggaactgtcgatgaaataataaaatttttatctgaataagcaggagtccataatgtttatataattcttaaatgtagttagttcatatacatgaatgtgcacttttcttgaaaagaaatagatttaaaaccacaccttgtatatatattatgcttttttccactactttattttaacagtcactgttctggcatacgtttcgggtaatgaccgagaatggaatatgtattgaacatattgaaattaaacatgttcataatatcttctaacaccattggaattgtgagaagtagatccgtaccatcaatagccggctcaagatgtcaactgaatactctgctgattcatctaaatcatttatgattgcaatgcaatctatgattgatacttcacaaacctttaatctagatagatcgaaaatctctttaccagattttgatgacgagctaaaaaaagtccaaaaggatgaaccaaatcaaagaactgaactaactgttctctcacaagatagaaatgattgggatgatatatttgaggagtttaaagacatttcatttgctcaactgcaatctataattgattcatacaaaacaaagaatgcagttgcagtatataaaaaaattggaaaactaatcaatgaagctgaaacgacactaagcagcaatgtattattagaaactgtactgcaaatggtttataaacatcaaaagcaagagttagagaaagaattgttggattttttaggaacagggaatatagaccttgtttctctgttacttcagcatagaagaatgatcgttgctacacctatagaaacgacgattctgctaataaaaaatgcggtcaattcaacgccagagttcctgacacagcaagatatcaggaatcaagttttggaaagtgcagaggatgccaagaataggaaattaaatcccgccactaaaataatcaagtacccacacgtcttcagaaaatatgaagcaggatccactacagctatggcctttgccggtcaaaaattcactttgccagtagggactacaaggatgtcgtacaatacccatgaagaaattataattccggcagcagatcaggcatccaacaagaactatctctatacaaaactattgaaaataagtgatttggatcatttttgcaagactgtatttccctatgaaactttaaaccaaatacaatcccttgtttaccccgtagcttataaaacaaatgaaaatatgctaatttgtgcacctactggtgcaggtaaaacagacattgcattactgacaataattaatacaataaaacaattctccgtggtcaacggggaaaatgaaattgatattcaatatgatgattttaaagttatttatgttgcccctttgaaagcactcgctgctgaaatcgtcgacaagtttagtaagaaattggcgccttttaatatacaagtaagggagttaacaggcgatatgcaattgacaaaggcggaaattttagccactcaagtaatagtcacaacccctgagaaatgggacgttgtcacccgtaaagcaaacggcgacaacgatttggtttcaaaggtcaaattactaattattgatgaagttcatttactgcacgaagatagaggtccggttattgaaactttagttgcacgtaccttgagacaggtagaaagctctcaatcaatgattcgtattatcggtctatcagctacattacccaattttatggatgtagcagatttcttaggagtaaatagacagatcggaatgttctattttgatcaatcattccgtccaaagcctctagagcagcaacttttgggctgtagaggtaaggcaggtagtagacaaagtaaagagaatatcgataaagtcgcttacgacaaattgagtgaaatgattcaaagagggtaccaggtaatggtatttgtccactcaagaaaggaaactgttaaaagtgcaagaaactttatcaaactagcagaatctaaccacgaagttgacctttttgcacctgaccctatcgaaaaggataaatattctagaagtttagtgaagaacagagacaaggatatgaaggagatttttcaatttggttttggtatccatcatgctggtatggcccgttcagatagaaatcttactgaaaaaatgtttaaagacggtgctatcaaggtactgtgttgtactgcaacattagcatggggtgttaatttacctgctgattgtgttatcatcaagggtacacaagtatatgattctaaaaagggtggattcatagatctaggtatttcagatgttattcagatttttggcaggggtggtaggccgggcttcggttccgcaaatggtacgggtattttatgtacttccaatgatcgtctggatcattatgtttccttaattactcaacaacaccctatcgaatctagattcggttccaagttggttgataacctgaacgccgaaatttcattggggagcgtgacaaatgtagatgaagcaatcgaatggcttggttacacatacatgtttgttcgtatgagaaaaaatccttttacttacggtattgattgggaggaaattgcaaatgacccgcaattatatgaacggaggagaaaaatgatcgtagtagctgcaaggcgattacatgctctccaaatgattgtgttcgatgaagtgtcaatgcatttcattgcaaaggatttgggcagggtgtcctctgatttttatcttttgaacgaatccgtcgagatattcaatcaaatgtgtgatcccagagccaccgaagctgatgtattgtccatgatcagtatgagcagtgaatttgacggtataaaatttagagaagaagaatccaaggagttgaagagactttctgatgaatctgttgagtgccagattggaagccaacttgacacccctcaaggtaaagcaaacgtgctattacaggcttatatttcccagactagaatttttgactcagcactatcatccgattcgaattatgttgctcagaactctgttagaatttgtagagcattgtttttaataggtgtcaatagaagatggggtaaattttcaaacgtcatgctaaatatttgcaaatctattgaaaagaggctctgggcctttgatcaccctctctgtcagtttgatttgcctgaaaatattatcagacgcatcagagatactaaaccttccatggagcatcttttagaattagaggcagatgagctcggagagctggtgcataataagaaggccgggtctaggttatataaaatattgagccgatttccaaagattaatatagaagctgagattttccccattacaacaaatgtaatgaggatacatattgcattaggtccagactttgtatgggattcccggatacatggtgatgcacagtttttttgggttttcgttgaagaatctgataagtcgcaaatccttcattttgaaaagttcatcttaaacagaaggcagttgaataatcagcatgaaatggacttcatgatcccattgtcagaccctttgcctccgcaggttgtcgtaaaggttgtgtcggatacttggattggctgtgaatcgacccatgccatctcttttcaacatttaatcagaccatttaacgaaactttacagacaaaattgttgaagttacgtcctctacctacatcagccctccagaatcctttaattgagtcaatttatcctttcaagtatttcaatcccatgcaaactatgacattttatacactttacaataccaatgagaatgcgtttgttggctcgcctacaggttctggtaaaacgattgtggctgaattggctatatggcatgccttcaaaacatttcctgggaaaaagattgtttatatcgcaccaatgaaagcattagtacgtgaaagggttgatgactggagaaagaaaataacaccagtgaccggagataaagttgtagagttaaccggtgattctttgccagatcctaaagatgtgcatgatgccaccattgttattacaactccagaaaagtttgatggtatttcccgtaattggcaaactcgtaagtttgttcaagatgtatctttaattatcatggatgaaattcatttgttggctagtgatcgtggtcctatcttagaaatgattgttagtcgtatgaattatatttcctctcaaaccaagcaaccggtcagactgctaggtatgtcaactgctgtttcaaacgcctacgacatggctggctggttgggagttaaggaccacggactgtataacttcccgtcaagcgtccgtccggttccattgaaaatgtacattgatggatttccagataatttggcattctgtcctctgatgaaaacaatgaacaaacctgtgtttatggccattaaacaacattcacctgataaaccagcattaatatttgttgcatcgcgtagacaaactagactaacggctttagacttgatccacttatgtggaatggaagataatccacgtaggtttttgaatatagacgatgaggaggaactgcaatattacttatcacaggtcactgacgacactttaaagttatcactccagttcggtattggattgcatcatgcaggtctagtgcaaaaagatcgttctatttctcatcagttgtttcaaaaaaacaaaattcagattctgatcgctacatcaaccctagcgtggggtgtcaatttgccagctcacttggttatcatcaaaggtacacaattttttgatgcaaaaattgaaggatatagagatatggatttaacagatatcttgcaaatgatggggagagctggtagaccggcttatgacactacaggtactgctatcgtttatacaaaagagtccaaaaaaatgttttataaacatttcctaaacgttggttttcctgtcgagtcctccttgcacaaggtattagatgatcatttaggtgcagaaataacgtcaggtagcataactaataagcaagaagcgttagattttttgagttggacatttttgtttcgtagagcgcatcataacccgacatattatggcattgaagatgatacaagtacagcaggagtcagtgaacatttgagttctttgatagatagcacattagaaaatctgcgagaatcacaatgtgttttattacatggagatgatattgttgctacgccattcttaagtatatcctcatactactatatttcacatttaacgatacgccaattattgaaacagatacatgatcatgcgacttttcaagaggtattacgatggttatcgttggctgttgagtataatgaattgcctgtaagaggtggtgaaattatcatgaatgaagaaatgtcgcagcaatcgaggtactccgttgaaagcacttttaccgatgaattcgaattaccgatgtgggatccacatgtaaaaacatttttattacttcaagctcatttaagccgtgtagatttaccgattgcagattatatccaggataccgtatcagttttggatcaatctctacgtattctacaggcttatattgatgtcgccagtgaattgggttactttcatacggtattgaccatgataaagatgatgcaatgcataaagcaagggtattggtatgaagacgatcctgttagtgtacttccaggattacaactgagaagaatcaaagattacacttttagcgagcaggggttcattgaaatgacgccgcagcaaaagaagaaaaagctgttaaccttggaggaaataggaaggtttggatataagaaattattaaatgtttttgatcaactaacttttggaatgacagaaagcgaagatacgaaaaaacgtttcgtcagtgtctgccaaagattaccggttttagaaggcatgaaatttgaagaacaggaaaataacgaggtgttaacattttatagcaagcacctttctagtaagcataataatgggtttgaagtatattgtgataaattccctaagatacaaaaagaactatggtttttaattggacacaaaggcgatgaactgctgatgattaaaaggtgtcaaccaaaacaaatgaataaagaggtcataatacattgtgatctatttattcccgaagaaattcgtggcgaagaattgcaattttcccttattaatgacgctttaggattacgttatgatatggtccataaactaatctcttagtgagacacaattaaaacaacaattattttgtgaaagataacagtggaaatctatctagtatacatcttcgtatatattttcttacataacgcatttagaatttttttactcaaaaaagtcatccttttcatcttctcccacaacttgatccaattcttttctatcctgtgtaggtgatacttgtgatccatcctcatgatctttatcaggtgataatgttaatccgatggaatcttcatccaatttctttcccttcaatatctcttcgaaagatacgtttaaggtgttcgcatccattctttcagctactaatttaagaaattgttctcttctaagatttgtcaattctacgcctttgggtctgtagatggtgtatcattcggatatagtgcaatatacttttcagttttgggaaaatttatcacgtaacataattcaattttagtggctctcaacttttgttgtaaatctttatcatctgcgccagattcttttattttcttcaataatctgttatattttctcaatgctttttttttttcaaagaatctcaccatatgatattttttagcgttggctttaatcttattcttgagttcattattctgcaattccaaccgtaaagcttgcaaatttctttccttttctattattactgtggatggaagtatatctttcttcttttttaataacctctctaaatctcttattcttcttttaattttgtttgttcctgcatccattatctgggacatctctagagatgacccaagagccttgcttctcttcctctgtaatttagccattgattgattaggtttattgaatgatataagtaaaataactaagtcacgatatttgttttatgtattgtttaattgtagagatgagatgagtatgaaaatttttttgaatgtgtttttcttagtgctccggcatagggtaccgcagaaattaaaggaatacatatttttgagcttcaagcactttttataatcttagcgtacttatctttatattcatctgcagagtaaccgagaaagccgtgatatgtgtcttttctccttttttttttggctttccataactttttcttccagttgagataaatttattgaagcctgtgagtcttgattaatgacggcaaatccaggtctaggtttaaatcccaacttagatgtttctagctcttgcaaccagcggggatcttttgttatggagtattcaaatccacgtattgtatccaatggcctttcatttcttgctcttgtaggatttgaaatatcaggtgtttttatattcctaccaaatgtatccttcatggatttcaaatttccatctttatcgtaaataacataaccattgcaagttgagttttctgttaacggatgtatcttctgtaagttagagaaagtggcttcttcaaaaggctgggcttcttgaacagcctcgaggattggagcggccaaagaagaagagcgtaatttaattcttgatgtatcatcatccttttctatcttatctgaactttcgaaatgttgcattttttgataaactatgattttagagcacttcagatattactttaggaaacttttgctttaatattcttaacattataaaattgacgacagcatcacacttttgagtgcgtcacaaatgcatataaatgaaaaaaggtaacttagttgaggaaaaaatagacacaaattaaaattttgatataattatagtaataaaactacataaatcatattatatttatcaagacaaacaggttactatagggaaaaagattaaattttgagtaagaatttgcttttgtaaaggaaaagagcaaccagtatgaaaaatgcatattagggaaccttttctgctattgtcctttatgttttaacctctgtgatttccaatcagactggaaaaatacaagctttaaatactcgagcacaaagacaacaattattgtgtttaatcagtgagttgggctatattaatggaactcaaataatatgcacttttcatcttactgcaaaagtagcacattcacacaccacgtccatcgtttaaggatatgactcaataaattatcaatctgatcactgccagtgtttagaaacatagtgtacatttctttattgttacattatacaaaacctttacaaaagttttattcgatcaatacatcgttatactgaatctactttggtgaagcagggttatctttactgctatacattggacaagatttatttgttctaatgtgcccgatttgtccgcatgtagcacatctccttgtagtgttcttacctttattcctggctgctttcccgtcagttacaccggcaaggtcgctaccattatccacagagttttctgttctcgtggcaccaccatttctcttcgaattttgccttgctgctctacgttgctgtgatttttccaaattagctaattctagttgcaacagttttttctgtttctcaagttcttccaagttatttatctttgaagtgtcctcctctaacaatttgttaacatcttctttatcctgttctttgatttttatatatccttgaatgaccctaggatctcttatgaaaattgtctgcctttgaattataccattttcatctcttttctttctaacaatcttcagaattttcttatcatctctatccgtcttaacatgcttgttggtctgattaatctcatcaggattggtcatttcctcaaaaggattgcttatgctcaacgattttgtatgtgtataccaggtcttcgcaatttcttcgtcgtaagctttttgctgttgagccacattgtagctatgcgtgttagtgccttttttgtttgaactattgttattactggaaggagaaccagacttaacaaaaccacctttcattgaagttttcaagaaagaaaaaccttcaccacagcccgttgggtcaccaacaccatgtatttgtatcatagctcgcatttgtgttgaattaataaaattttttgtaatgttccatggtaacaagttttcttctagagattttagcttagaatcaaaattatatgcttcattatcttcttggaattgtaagccctgactcattgattcaacttggctgatctgctctggcgtaattaaacttttcactgcttcattgtctaacaatttttcatcatctttaagcctccacagacctttttcaggaccatctctttgatatttcatgaactccttcactttttgtctgttttgtccataatcttggtcgggaaagtgctttgcaatgggatcaatagaaattgccttgctgtgattatggtttagaattctataaataatcattttcagtcttgtagctttcattgatgtcacctttcttgaattaggtccgggaatctcctcgacaggaaaagtttgtccaaccgtaaaaagatggttaatattacgtaagtaaaatcgattgcttataccaaatccggaactttttgtcagaagaaaatctgttcctgatatatcatgtttgaaaacgggtgctctaatcatgttattgtataatgtggggacgatatgaccaggttcaacaaatccaaagttccaaaatggtgatttgtcttgaactcccaaaacgtgagtttcgccaacaggcaatttgggccttagagtatcttgttcattggctttccgataataattaattaatttattggccataccaaatttagacaaagctaccggtgtttgttcagaatattccattaaataaacaggagcagtatccccgatggttagatcttgagatgtagaaaatgattctttgacatctttacctttatctcttttccttttacgcgcttttaacttactgaagacaattttagtacctggtctgatgtgcgaaccaaagttttcacggtggaaatgcctcaactggtatctaggaacagccactttgtaaaatggagattgtaaattaatcgcaggttgagaatgctgaatatttaagttcgagatggtagaacgaacttttgtttgatgggtttttttcaagatttgatatttatcatcattagataaattgaatttttgttgcaaaatagtttcgttgaggggcaatatcaagttactactatccagttgttgcttttgctgcgctaaattattcgttttctcaatcatcagcaacagtttttcgtcattcatatttaattcagcatgtttagactctttcaattttgcatcaatgatcatgtcttcatcccactgccaatcttcagcaacatcctcaatcaagctcttcaatttataaccgccggagaactttaagttgggtgtcatagacgaatccgccaaggttgctgttgatgaagtaccttgattgatgattttttcttggtcccaatcatcagtggcaataagcaagtcttccgatatggtcttttcatcatgaataatctttctttttttttgttgctctttaatagggaaaagttcatcaatggaaacatgaattaaacctcttcgggatgcagaagagttactttgaagtaaattgtttttcccttgataaatcggagcgacgtaagatattgtccttgagttaaataacctcttatcatcctgttgaaccttgaatttcaaatttaaaggcataaacggtttctttaccctagatatttcactgtgccaatgataaggaacagatcttctataaatcagcttgttccattttaaaattttacccttttcaaaatcaggaaagtatttttttagaagatacttctcatggtttatcaagtctaatttggtggctttcttatgcttgccatctgacatatctggttccatgataaatccgccatttatcgacatatcatttccattaacgccaccaatggaaagttgagaatgcccaatttcatttgcgccactaccatcaagaactccagtttcagtggcgagatgaatttcatttgcatccattcccataaacaaagcattgctagttgcgggagtacccccatcatcctccaaaataaactgttgagacaaatcaccattaatttcaggcagttgcatattcaaactatttgagtcgataccgagtacggcaccgttctcgtttacatcatcatacgcgcccatagtcatcatagctggatgcaaattagcatcagattcttctggcaaatcgtcatcgtcatcagcaagttcatcttcatcttcaaaatctacagcatccggcaaatgctccgtatagtcctttgaattggcaccttcatccccgccaatgtatgacccgatttctaaagagccaaactctccgccaaaaatagcttcatatgcttcatcttcgttggccaagttggtcttgccggatccctgctgctttaccatatcgccttatactcctgttgtacttctttttctctctgtgtttaaaatgctatttattctcttaaaagcacatttgaaaaccatcgccgcgaaatgaaattatcgactagtttattaatgaacaaggcgataaaacctaatgttggaaagaaagagctacgtcagcaagagatagagaaaatggacccacagacgctcattactaaggccaataaggtttcttactatggcaaccctacgagtaaggaatcatggaggtatgattggtaccaaccatctaaggtgagctccaatgtgcagcaaccacaacaacagctaggggacatggagaataacttggagaaatatccattcaggtataaaacatggttgaggaaccaggaagatgagaaaaatctacagagggagagctgtgaggatatattagatttgaaagaatttgatagaagaatactgaaaaagtcgttgatgacatcgcacactaagggtgatacaagtaaggccaccggtgctccttctgctaatcaaggagatgaagctcttagtgtggatgatataagaggcgctgtcggtaatagtgaagccattcctgggttatctgcgggagtgaacaatgataatacaaaggagagtaaagatgtgaaaatgaattaaaaggaaaagtattatgcatatatatatatatatatatatatatatatttatatatttatacacatagaattattttacagtaaaggatgctacaccaccccgggctaactttatggcttctactatttcaggttccctttcgcgtcttttatctaatctttcctttttgtcttgaataaactctaactcagttgaaagattgttccatggtcttgtgtcgcctgtacccgacatgatcaaaatcatagtacctggtgtagcattctcgtataattgtgttagatgttgccctatatcatgaagaaccatggacgcatcgaacgaaggagtttccttccgtggctttttattatagttgcgtgacctctctaagttcttgattctccccacaataagtttgacatctttatttagattctcgtgaatatgggtccatgtctcatcatcttcgacgcaacggattaactggcccttagaatcgtcctcagtatgatttttaataatcatatcgttgagaagaacggttttcacttcaaaacgatgtaatttggtgaacaagttctccgtattgatacctatcccaaatgctaacccatttaagatttttaatttcgtcaattcaagacaagcccttgcatcttcgacagaatcgtgttctccgttttgaatgcttttattcagaaaggtttcgctcaagtattttaaacttggcttgaaaggatcgccagctttatgatggtatataatagctgtatccacgaccaatggatgtttcaatttcatgactttcaaatcattctgtagcgaatgtcctatcaaaatatctgaacgacttattatctttagtaaatctttttgtacttctcgcaatgttttcttggcaccaacagttagtttctcttcagttataccactgtaacgtgtcaaatagtccactatggggacatcaggtttcaccaactcttcatagataacttcattgtcaaaattcactagagaaatcctagttagaactaaaccttgttcggaaagacacatttcacagtctagtgcaaagatgtgggagccaccatgggtaaagtcaacagtttgtacccagtctgtatcaaaattggtgtctccagaatccagtgggtaatcgtttgccactaactgttgttcggatagaaccaaatcgttaatagtaattttcttcttcttttgtaactctttcaatttatttattttctccattttggacaatccaacattaataaatgaattgtagggcgaaaagagcgtcatcttggaaccaggtgccatcacgggaaatgtatgaaacgtggaggcaatttctccaggaatatatttgaagttatcatcactgatttcattaaaggtattttttccgttctcaaaatcatctggttgtaaacctggaatgaacagaactatcattttctgtaaacttgacctgttacaaatatcaatccatttgggagagttgttttcagcctgcaacaagtattgagtcatgtctcttacatcctttataccaatacctttttcaaccacagactttagcaatgtgcatgtcataggctttgccttttttttcttcttattcttattcacttccgataccacatttgtatgatcatcctcttgtacagaagtcttggataaccttcttttctttgatcccaaagccaaatcactcacgaagttagtgtcaggcccttctacttgcatgtttgcctgagtatagtctattattgttttcttcctcagtcatccttggtattgccatcgagcaaaaatcttccctccatttctattgtgtcctcgcgccacttataaaatactaacaataaaataatagtgaactacaacaataaaatatacaaaaatatgtttatacgcaagggttttgtggagtgcacgttggcgaagcagaggacttaagtaggcgtctgatttccgtgctgcttaacttctcgctccagccgtcttcctcccttcctccaagtacattaaccacatgtactgccaatgggctcatgcctttttcaatcctagtcttattcacagtctctgccccactgacggtttctctactcacaactaaacattctatctcgggtactttccctgtggggccgcacacgtcccttaagggaactagttctacggagagatccggttttaacaacttgatgaattgatgtacgtgcctgcatcgtgtatcataaggttcaatcaactctttgtatttcttgttttgcaagagctcatcgcacgtaattccacaaattaacctttgtgacgtgatgaatgtagagacgctcaacaatattttatgtccatcgtgaatgtggtcgaacgttccgcccaatgcggtgacatgaaatttgttagcatctttgggaccttctatctcttccattatattatcgtgtaatgcataatgttctatactatggtattgtccttgtcccaactctagcttccaagtttcaaaagtggattcctgtggcaataaaaccactttccattgcaaattactctcgacgaaatgaatattgttgaatatgatgttgattccgctgttgatcattccatagcccaaaaggacatccctggtaatactgtacatcttccctagcgcagaatccaactggaatgaggttttgaattcaggtacaatcacgatgtctagttgactttgacattctcttaagaacggaatagtttgccctataatcctctgcaaagtagcactaggcggtgtataaggaagaacaatcaaaactctggaattttcctcaaccatcttacacttctttactttagatttttaggtttaatcacgtctctttttatgacggtccttatttttatctttttccattacgtactcttgaaaaattatattacactgatatttattttggcattgtgagtaagaaacctaaaaaggaataaaaaggctacaaaccagcatgtctaccgctaccatacaggatgaagacattaaatttcagagagaaaactgggaaatgataaggtcacacgtttcacccataatatccaatttaacaatggacaacttacaggaatcgcacagagacttatttcaagtcaatatacttattggccgcaacataatttgtaaaaatgttgtggattttactctgaacaaacagaatggcaggctaatccctgctttatccgctttgattgccttgctaaattctgatattccagatattggagaaactttagcaaaagaactaatgttaatgttcgtgcagcaattcaatcgcaaagattacgtgtcctgcggaaatatccttcaatgtctgtccattttatttctttatgatgtaattcatgaaatcgtgatcttacagattctattgctactccttgaaaagaattctttacgactggtcattgccgtgatgaaaatatgtggctggaaacttgcacttgtcagtaagaaaacccatgatatgatttgggagaagttaagatatattttgcaaacacaggagttatctagtacactacgtgagtcgttagagactctgtttgaaataaggcaaaaagattataaatctgggtctcaaggtctgtttatattggacccaactagttacacagttcatacgcactcctatattgttagtgatgaggatgaagccaacaaagaactgggaaattttgaaaagtgtgaaaatttcaatgaactaaccatggcgtttgatacgctacgacagaagctgctgataaataatacgtccgacacaaatgaaggtagtaacagtcaattacaaatctatgacatgacatctaccaatgatgtcgagtttaaaaagaagatttatttggttctgaaaagttcattatcaggtgacgaagcggctcacaaattgctaaaattaaagattgcgaacaatttgaaaaaaagcgtggtagatataatcatcaaatctagtttgcaggaatctacattctctaaattttattctattttgtccgaacgtatgataacgttccacaggagttggcagacagcttacaatgaaacttttgagcagaattatacacaagatatcgaagattatgaaactgaccaactgcgaatcttaggtaagttttggggacacttaatatcttatgaatttcttccaatggactgtcttaagataattaagttaactgaggaagaatcgtgtcctcaaggaagaattttcatcaaatttttatttcaagagctcgtaaatgagctcggattagatgagctgcaattaaggctaaactccagcaagcttgacggaatgtttccgctggaaggagacgccgaacatataagatactccataaatttctttactgccataggattgggcctgctcacagaggacatgagaagccggttgacaattattcaagaagttgaggatgcagaggaagaagaaaaaaaattgagagaagaggaggaacttgaaaagttacggaagaaggccagagagtcacaaccaacccaagggccaaaaattcacgaatccaggttatttttacagaaggacaccagagaaaatagtagatcaagatcgccattcacagtggaaacaagaaaacgtgctagatccagaactccaccaagaggatcgagaaaccatcgtaacagatccaggactccgcctgcaagaaggcaacggcatagatgaagagcccggccaaacaaacattacacatgtaatcgtacatatttacatagaaccgtacacgcttttagccaaaaaaaaaagaaaggtagaatataaaataaaaactcgtatttcgtattaagacaaatatacagaaatacaaatgagatcataaacgaactaaaataggaaaatgaaaaaaaaaaaaaaagattagcgaaggcaaaccagaaagcagtcctttgatataacagagaaaaagaagattatcaaagccttaatttaaagttaaaaatattgggtatcgttttttaaatcaagattttttttgtttttttttacaattgagtagacttattcattggatagaataccccagtatttttcaacaccgtaagcaccgtcggccttccagtagtcgttgaaggcagtgaataagaaggtatcagcaccacaggagctggtaatggcggaaacagcgtccttttgattttccttagatggaacagcaacaccgtaagtctcaccctttgatggccaaccagactcagtgataacaacattcttcttaccatcacaagcagtccagactctttggatttgttctagtaaccatttaccggagtcttgggcaactgtgttcttgtcaaagtaagcatgggcattaacagccatgtagtcggagtagtcacacaattcagggttgttgatcacagcaataaaagtatcaacagaaacaactggaccagtgtaaccggcagccttcaaggcagatctaccagagtcaatgtattgaccgacttgggatggggtagcttggttaccgttaaccaattcgttaccaatggaaacagtggtgacatcgtcccaagaaccgtaagattcaacagcagacttgatggtgttgacaccgtcttggatttggtcaacgtagtaaatacctaaaaagactttttggttcgaagccttagccttgaaaacattttcaacttggttacagtcggtaccgtacaatctaatgactgggaagtcagtcaattgagctaaatcggaagcaacttccgaagcggatttacaagcaccgctggactcgtatggggtataagtgatacctctgacaccagaggcaaagctgctgacgtcttcgccggaagaactagaggaagaagcttgggaggaagaggaagattgagtagatgtagcagcagagctggaggctggagatgcggcagcagaaacttgtgagttgttctcagaagaggaagcagcagcggtagctacagaagcagcagacgatgttgtactggtagcggcagctggagcggagttgacaacagcattttcttccaaagcagcaactggagttgaagcggcaccattaacaatgatagtggtttgtttttgaacagtggtagtgaccacagcacgcttgtccttgtgttcgtggttagcgggagcagcaagagtagcagcagataaaagagaggcagaagcaattaggttagagagacgcatatttttctagtttgcttttcggtatggcttgctagtatataaacgattgtagatgtaaaagaatgacttagttggatttagttagatatctagctggacctttgtgtaaacactattaaaagaatagaataagggctaaaagaactactaaacagaaaacaattatgacagaagataaagaatacatatctattagttttataaaacagagatcttctcctcgaggaatgggagaaaacagaaaaaaaaaaacaaaaacaacggtgccgtttttgaaacaacaccacaagagaaaatttctgaaaaaaatgcgcgtgaaaaggaatcatgtgcctattttcctcatttggagaggctaaacgaaaagggaaaagaggtgcgttgcgcgtgtttctagggagaagatcctattgcagcagggtgtcgcgcgaaaagcggtgcctacaaattacaaaaccctctgggaaatgaccgtgcagggtcgtttgtggatgcatctcgattaggccgggctaggcatcttgattctttcccaaaatggagttaacgagctcgattgggcgttaattgatggatttggttacactgatacgaattgagcccgtttatcattcatgcagcggctttatggagggtgtggaagacgttagcgatgttatgctttccacttgctctactatcttccatcaaacccacctaataaagctgaaggttttgcaggggcagaagtcgtggcgcaataagttcaataaatacttataatattacttactagtttaatcatgtatgtaaaaactcgttgcggtatgctgtcgtactggcacacatttttttttttcatttttatttgcttttttctttggcaccggggaagaatttttccccactctatatatcttgctgcgtgtgcagactggccagctgctcacacaatgaaacgcaatggaatgtttagtcgtttgttatcataaagatctcattcagtgccttggagtccatcaacgcggccctcttttgttttatccatttggagcgcaccgatagtcttgtgtttaccgcatcggggatattggatgcagattcactagattttaattttgacgtctttttcgtttctttggtcttttccgcccttttttccttcttcaatctcttctcttcctttttatgtttcttatgctcctttttgtccttcttgtcttttttcttgtctttcttatgctttttgtgcttcttgtgcttctttttatcactgtctttatcctctttgtcgtcatcatcttcatcttcgctatcgtctccttccctctttcgtttcttcgcgttggagtaatttcttaacttgtgagtctttggatcccacgtgcttgctaaaacttcacccttcacaaaatggataccccattttccgtcaataatcttctgctttctctgcgtgtccaattcctctgatattttgctttcctttccgttcagcctaccaagaattcgctggaagacatccaaccctgcgcattcaccattatcaaactcgtcttttttgtctttacgttttaatttagcaccgagcccaacgttgtcgtccttaattgacactttgatatgcgaagtgttcgaattcatgggggataaccccagacccataccgggtttccatccaaacttttctagaaattggtgcccgaatctcgaggtgtcgttactccatgccgtatttctggggtctaaaccaaaccgctgtttggttcttgtagctgccaaacccattctgcttctttgtttaatggtgtaagctgcctatatgttactattgagtactcatctcatcgcttctttcagaacaaaatttttcatattttttttttttccttttctttttttttttttctttgactgttacccggttgtttatatttgtaggaaaacaacaacgacagagaaaatatccttgcagtggcggctaatttgttagttgactgattgatcaccttcacttattaaagtaaaatcagcatacaagagatcagaagggagaaagagagtgggcaaggctatagtactttgaagaaagcatctttgaaccgaccagttctcttcacaagcaaaatctatatgactaaccgcaaggggcaaagggttgtgagagggcccgtctttctcccgctatagccgtcactggtatccctcctggctgcacaaatccgatagaaaggggaagaaggaagtttagtgccaccttatagcacgcagttactgtttacgctaaggagaggcatactcaatttttattagtcgccttctttagttgctgcgtttttatccacggttctctactaaatgcttgcgataagcgcttctattttcctccccaccgcgaggcggaaatggcacattttttttcttttgcttctgtgcttttgttgtaatttttggcatgtgctattgtatgaagataacgcgtggttccgtggaaatagccggaaattttgccgggaatatgacggacatgatttaacacccgtggaaatgaaaaaagccaaggtaagaaagtggcaatatttttcctacaaatagatctgctgtcccttaaatgattaccatacatatatatatttattacacatctgtcagaggtagctagcgaaggtgtcactgaaatattttttgttccagttagtataaatacggaggtagaacagctctccgcgtgtatatctttttttgcgctatacaagaacaggaagaacgcatttccatacctttttctccttacaggtgccctctgagtagtgtcacgaacgaggaaaaagattaatattactgtttttatattcaaaaagagtaaagccgttgctatatacgaatatgacgattaccgtgggggatgcagtttcggagacggagctggaaaacaaaagtcaaaacgtggtactatctcccaaggcatctgcttcttcagacataagcacagatgttgataaggacacatcgtcttcttgggatgacaaatctttgctgcctacaggtgaatatattgtggacagaaataagccccaaacctacttgaatagcgatgatatcgaaaaagtgacagaatctgatattttccctcagaaacgtctgttttcattcttgcactctaagaaaattccagaagtaccacaaaccgatgacgagaggaagatatatcctctgttccatacaaatattatctctaacatgtttttttggtgggttctacccatcctgcgagttggttataagagaacgatacagccgaacgatctcttcaaaatggatccgaggatgtctatagagaccctttatgacgactttgaaaaaaacatgatttactattttgagaagacgaggaaaaaataccgtaaaagacatccagaagcgacagaagaagaggttatggaaaatgccaaactacctaaacatacagttctgagagctttattattcacttttaagaaacagtacttcatgtcgatagtgtttgcaattctcgctaattgtacatccggttttaaccccatgattaccaagaggctaattgagtttgtcgaagaaaaggctatttttcatagcatgcatgttaacaaaggtattggttacgctattggtgcatgtttgatgatgttcgttaacgggttgacgttcaaccatttctttcatacatcccaactgactggtgtgcaagctaagtctattcttactaaagctgccatgaagaaaatgtttaatgcatctaattatgcgagacattgttttcctaacggtaaagtgacttcttttgtaacaacagatctcgctagaattgaatttgccttatcttttcagccgtttttggctgggttccctgcaattttggctatttgcattgttttattgatcgttaaccttggacccattgccttagttgggattggtatttttttcggtgggtttttcatatccttatttgcatttaagttaattctgggctttagaattgctgcgaacatcttcactgatgctagagttaccatgatgagagaagtgctgaataatataaaaatgattaaatattatacgtgggaggatgcgtatgaaaaaaatattcaagatattaggaccaaagagatttctaaagttagaaaaatgcaactatcaagaaatttcttgattgctatggccatgtctttgcctagtattgcttcattggtcactttccttgcaatgtacaaagttaataaaggaggcaggcaacctggtaatatttttgcctctttatctttatttcaggtcttgagtttgcaaatgtttttcttacctattgctattggtactggaattgacatgatcattggattgggccgtttgcaaagcttattggaggctccagaagatgatccaaatcagatgattgaaatgaagccttctcctggctttgatccaaaattggctttaaaaatgacacattgctcatttgagtgggaagattatgaattaaacgacgctattgaagaagcaaaaggagaagctaaagatgaaggtaaaaagaacaaaaaaaagcgtaaggatacatggggtaagccatctgcaagtactaataaggcgaaaagattggacaatatgttgaaagacagagacggcccggaagatttagaaaaaacttcgtttaggggtttcaaggacttgaacttcgatattaaaaagggcgaatttattatgattacgggacctattggtactggtaaatcttcattattgaatgcgatggcaggatcaatgagaaaaactgatggtaaggttgaagtcaacggggacttattaatgtgtggttatccatggattcaaaatgcatctgtaagagataacatcatattcggttcaccattcaataaagaaaagtatgatgaagtagttcgtgtttgctctttgaaagctgatctggatattttaccggcaggcgatatgaccgaaattggggaacgtggtattactttatctggtggtcaaaaggcacgtatcaatttagccaggtctgtttataagaagaaggatatttatctattcgacgatgtcctaagtgctgtcgattctcgtgttggtaaacacatcatggatgaatgtctaaccggaatgcttgctaataaaaccagaattttagcaacgcatcaattgtcactgattgagagagcttctagagtcatcgttttaggtactgatggccaagtcgatattggtactgttgatgagctaaaagctcgtaatcaaactttgataaatcttttacaattctcttctcaaaattcggagaaagaggatgaagaacaggaagcggttgttgccggtgaattgggacaactaaaatatgaatcagaggtaaaggaattgactgaactgaagaaaaaggctacagaaatgtcacaaactgcaaatagtggtaaaattgtagcggatggtcatactagtagtaaagaagaaagagcagtcaatagtatcagtctgaaaatataccgtgaatacattaaagctgcagtaggtaagtggggttttatcgcactaccgttgtatgcaattttagtcgttggaaccacattctgctcacttttttcttccgtttggttatcttactggactgagaataaattcaaaaacagaccacccagtttttatatgggtctttactccttctttgtgtttgctgctttcatattcatgaatggccagttcaccatactttgcgcaatgggtattatggcatcgaaatggttaaatttgagggctgtgaaaagaattttacacactccaatgtcatacatagataccacacctttgggacgtattctgaacagattcacaaaagatacagatagcttagataatgagttaaccgaaagtttacggttgatgacatctcaatttgctaatattgtaggtgtttgcgtcatgtgtattgtttacttgccgtggtttgctatcgcaattccgtttcttttggtcatctttgttctgattgctgatcattatcagagttctggtagagaaattaaaagacttgaagctgtgcaacggtcttttgtttacaataatttaaatgaagttttgggtgggatggatacaatcaaagcataccgaagtcaggaacgatttttggcgaaatcagattttttgatcaacaagatgaatgaggcgggataccttgtagttgtcctgcaaagatgggtaggtattttccttgatatggttgctatcgcatttgcactaattattacgttattgtgtgttacgagagcctttcctatttccgcggcttcagttggtgttttgttgacttatgtattacaattgcctggtctattaaataccattttaagggcaatgactcaaacagagaatgacatgaatagtgccgaaagattggtaacatatgcaactgaactaccactagaggcatcctatagaaagcccgaaatgacacctccagagtcatggccctcaatgggcgaaataatttttgaaaatgttgattttgcctatagacctggtttacctatagttttaaaaaatcttaacttgaatatcaagagtggggaaaaaattggtatctgtggtcgtacaggtgctggtaagtccactattatgagtgccctttacaggttgaatgaattgaccgcaggtaaaattttaattgacaatgttgatataagtcagctgggacttttcgatttaagaagaaaattagccatcattccacaagatccagtattatttaggggtacgattcgcaagaacttagatccatttaatgagcgtacagatgacgaattatgggatgcattggtgagaggtggtgctatcgccaaggatgacttgccggaagtgaaattgcaaaaacctgatgaaaatggtactcatggtaaaatgcataagttccatttagatcaagcagtggaagaagagggctccaatttctccttaggtgagagacaactattagcattaacaagggcattggtccgccaatcaaaaatattgattttggatgaggctacatcctcagtggactacgaaacggatggcaaaatccaaacacgtattgttgaggaatttggagattgtacaattttgtgtattgctcacagactgaagaccattgtaaattatgatcgtattcttgttttagagaagggtgaagtcgcagaattcgatacaccatggacgttgtttagtcaagaagatagtattttcagaagcatgtgttctagatctggtattgtggaaaatgatttcgagaacagaagttaatttatattatttgttgcatgatttttctcttttatttatttatatgttgccgatggtacaaattagtactagaaaagaaaacccactactatgacttgcagaaaaagttatgtgtgccatagatagatataattgcatacccacattgtatactcaaaattccgaaaagaacatttcattttttatgaggcaaactggacaacgccttcggtcctttttcattctagaaatatatatttatacatcattttcagaagatattcaaagaacttattgggatgtctgtttactgaataaagtatacacaaaatacgaatttaaaatggaaggcataaaatagaaaacttagaagtgaaaatcctaaaaccgaaggatatttcaaatacgtaaaagaagtgaaagataaaataaagcctaaataaggaagaaaagaagggataacatttttttttgttactttttgcttattcctcacctaaacagaaggaaaaagccattcttgtttaaagagtatttttaaagcgttcatgaaaagtcacagtccaaggagtatttcaaattgtcacttgaagtgaaaacaccccagtgcttctcgacatcagaggtaccagaggtgtttggcttccaatcttcatcaaaggcttcaaaaacaataacgttaacaccccaagctctcatggaacagataccttctttccagaattgtttggcgttgtcaacagatgggtaagaactttcaaagttggtaccatcagttggccaaccggtctcaccaacccagaaggtaatatcggtagaacctttagtagattggataacctgtagagcttgcataatatcatcaaagaatgagtaagaggcattttgcatggtttgaccttgccagtaggagaacgcgttagccataacaaaatcggaagcttcgataacggcagaattgtaaccagcaaccaaaacattccaggaatcgacagtaccgacttgcttaccagagtatgactttccgtcagaatcggaaatgtcagcaacgacactacggacgtcattaattttgtctgataattgagaggcagtcaaatcgttacggtataaggcttcagaaccaaccaagaaaccagcaacagtggattctttaatttttggcaaataggtttgcaaagcagccttttcagcagcgtaatgactgtcgtctgttggccaaacaccgacaaagatagtaaatccctcagcttcagcagcaggacctaagttttgcaaagtgttacaatctgaggcagcgtaaactttgacggtggaagtgtagctcttcaaagcttgtaattcggtttcatagtcggaagtggacttacaagtaccatcgttgttcttgacacccaagttaaaggctagttcaccaatagctgaaacttgggaggctgtgaaaaatagcgcagtagctgcagtagcgagtgtagtagagaaacgcatctttgaccgtttttctttttggttagttgtctatctcaataaacttatattgaaaaaaacaagaagaagtccaaattgtgaatgaggaaaagtttctttataaggaggcagttaaaatcaaaataaacaaatatcctcttgttttcttcgtgacatttttctctttttcagggcgaaaaactgaaagaaaaattttaacgtttcttttactaaaaatagaactgcatatccgtagaaaacgatgattatataacataaatagtaatatcagttattaattgctatttatttcaacttgcccaacgctgaaacatggtaagagctatgggtaggctatcttgaatgggtatatttccctggggtacggaagcagggaattgcagttgaccagaaaagtaatgatgcaaagaagaggattctaagtcagatctcctgaaacaacgttttaaatggccccatttcccgaagataagcaggatattacagggtttttctgatgttgaactttttttcagttttgcgatgtatggtagctttgtttctaccttgtggtactttgacaactcttcgtcgtagtggaagtcaccactgttgacccaaacgatctttgtgtaaccttcggacacctcattcaaagtgcttgccattcgaacatgatagccgagtggttttcctttgtaagcatctatgggtgacactacttctttgcgctctgtatcaactgttacacgcgcagtattgggaatattttggttagataacgtaataatttgattctttcctatatacaccaaatttgttagagcatcatcagatttaccttttgagctatctcgtgcgattgataagccttccttgtagtgttgttcggcagatgcgttcataaaaggtagctggttcaatggcggaaaggtagatgcacactttaaatataacttgtttttttttttgaatgtagtatccagtaagtttggaggcgttacaaaatattgtaatagtgtggcaagtaataaacaatcagagatagtctcctttgatcttgattttttttcatgctttttatcttttgactggtctagaactatgatttcttgaacattgaacaatacagctgtccgagctatttgatatgcagtaaatgtaacttgctccaaattattacaattgtcgataacagttgtcggtatgcatatggaatatttgaccacattagattctatatccatgattttttttagcttcaataggcctgtctttgcctttttggcagccccctcttcgtgcttaaggctctcggatttatgttttactgccatcttcccctattatgctacacttcccttggtagatgtgtttcacctcattggtatcaattacctcctctacttaatatcccaatttcaacatggtgttttcaagcgatgaggtggaaaaaatttcaaataatatgtttgggtgtgcccattattgcggtttacaatagttgctaaagagctatttattaggaatttttaaactttagagattgcttaaagcgactttaaagcgtttctttggaaagataggagagcggatgctatctcaagagcatctcttcaatgatttaagcagtgacagtgtaaaacaattacggaccaacgaaaatggtcaaatcaaaactaattacaataaataagttctatcataatacaagggaattctgtgcgatataaccacattgattgaaggtagaatatacaagccaacgtgagaccaatcaaatttcgttaagtgcgcctatacaaaaagaaatcttttatgtagatatgacagtaagaaaagtatatatgtgagctagcagggtattgaaagcgatcacaagaaggcaaaacgaaatagattgttagaagatgagtgaacagaagggacataaagaaaagatttcctttacaatctagtaaatcttcttcttttcatcaacggataattcaccagcgccagtattagtaactaatagaagcccaccaatgatgcttaagttctggtaaaactcatacttcaagaaatctctcttagtattgttataaaaccagtagttgtttagcgtgatattgtaaaaagttagtatcaaacccaacataatggatgcgaattttgtcttgtaaccaatggcgaaacatattgtgccgataatggtcaaaacaacagtaaaccatgatttactgaaagtgaaagcgataaacattaaaacaattaaaattctaccagcaaacaacaggtaacccttcgctttgtcgtttttgctgtttaattcaggaagcataccgaatgttgtcttgttttgaacaattgaatcgctgaatgcaattaacaacccaccaataacactaaagtttcttaggacaaatgatgaacccgtaaacaacccataaactaatgcttgagaaataacgcaagcacataacacaccggtggcataattggtttgctttcttaaaactaacaaactggcgccaatcaacatggaaacggtaacaaccactagaaacacaacgacaaagaagtatgggtaatgcttccacttattcagataaaaaatttgatctgaccattgtgataagatcctaaacgaatcttcataaaaggtggccacaatgaaaaatcttgacaaacttggaatgtaaggcttcaatttataaacaactgcattgtcagtgagcccctcaattctggaggcaaacttttcaaaagaatgcttccattgctttaagatgccagaagtggattggttctggtttgatctgaattgtgcaccgccagagtatggtccttgcgatgatgacattggcataccgccaaaatttccaataggtcctctgtaagacattgatctatcctttcagttttgttttcactttttttgagtcgtactaattgcagctattgtaagtaaataaggacacctttgatctttcgttaaaggtgtcctttatttttcgcctttctcattattccctcttctctcatcttctagaaatacctaaaaagggaaccgttacccgaacctattcattatagaaataaaagagaacgttctctataatattcgtatacattcgtatatattctattccatttcttacggtattcacacgaagtaggacaacaagctggatggtagtttgccagaatcgacaatagtctttgcagattccttcaaaacttccttggcaccagcagcattggccttgatcttatcggcggtggacactaactcttcgtcattcaaactgtcaacgatcaaaccaacttgttcgtcaatcgtggtggccttgtcagcatcaccaaagtagtcagcttccttagcagagttacggatggctctcttgttctttttcttggcggccttagcagcttccttagccttctttttgtcagcttttgcggaggcgttagccttggcttcagattcagctttagccttcgcttcagcttcggccttggccttagcttcagcttcagctctggcaccggcttctctttcccattttcttctttccttttccttcttctcttcttctttgaacattttgatacggggatcttcactgacagctctttcaacaagtttgaccaatctagcgttatcagcagtcttcttcttgtctcttgcggccttgttctttctttcaatgtaacgcttgtggtctctgttagaagagtcatctgggacatcttcgtccaagaactcaaaggttctccaggagtcaaatctgtgccagaaagcatagaattgttcaacttccttcttggaagaatctttgttacctagagaaggaataggagtcttcttagaaaaacgagcttcagcttcgaaaacggggccccaagcttcataaaagtcataatcggtacccttctttggaggaggaacatcggcaacaaaatcacatgagtcgtactgagctctcttgttggaatcagtcaaagtttcaaaggccttttgaataatcttgaaaaagccatcttggtccaaactaccaccagcagcagattgcttgtctggatggtacttgacaacttgttttctgtgagccttgatgatttgactttcagtagctctgaaacgcaacttagacaaacccatagcagcatacaaatcggcagttttccagtctctagcatcatgagtcagtaaatcttcatcggccaattcagtgtcgaataacaactcatctgggtcgacattggattcatcaacggttttgacgttcttttcagcttcaattctttcaaattcagaccaggtgtggtttctcaaagttctttgagcatgttgcaaaaagaacttaccaaccggttcgaccggacgacggacgaatggggttttggtagcggaactgttgacttcaacagtgatgtctgaggttagggtaggtaaagaaaacatcgttactcttgttggtatatgtgagacaaaacgaagattttataaaagcatcggtaggaaaaccttatgaaattttctctaccagctcttgaaataaaaatttcgaactctttgcaaaatttcatcgagaaaaaaaaaagattcgtatttgcgggtaatattttttggacatttgtattaggagcgttatgttcattaatgtcatccaaaagatagttataaatctatgattgtatggtttctttgacatatttatagttaatatatatatatatatgtgtttaattttataaaaattccatcgtttatattcgattatttttatatgtcaaccttttttttaagaaatgttcatatttagtcaagttcttaatgaaatgaacggttgaaagtacaaggcaactatcatttcaagatataaaaaaattgcccaaaaaaaaaaggccatttgatgaaatgtctcatcgcgctacgatttctgctgtaatcagaactaaatgcgtgatcggaagtaatattagatattggatgcataaaagataaaacgccagctaacgatggcagaataaataggtaaatatatatatatataggttttcttaataaataagggagaaatgtacagttagaatcgtagaattatccacatatccctatcttcaagatctgtcgtacttaaatgcctccataggttgcaatccccatttagccaacattgccttgtcttcgtcccaaccgttacacattgtcgtcagcattttcttaccggtgaagatactgttacaacctgccatgaaacagacaaattgctctgtttctttcattgtataacgaccagcggcaagtcttataatggcctttggcataactattctcgctgtggcaatggttctcaaaatttcgtcgaattgcaactttttactctttggatcggcaagttcctcagccattggagtccctttgatagcaactagtctattaattggtagggactcaggatgaggagacatattggataatgtgtagatgaatcctatatggtcgtcttcgctttcaccgagacccaaaataccaccggtacaggcttttattccagattcttggacattcttgatggtctgtaacctgtcgtcgtaggttctcgtggtgatgaccttactatagtgttctctggaagtgtcgatgttatggttgtatgcagtcaaacctgcatctttcaattgctttgcttgatcttgatcaaccatacctaaagtaacacacgtttctagccccatatcattcactttggtcaccatttcctgaattcttttcatggctgatttacgacctttcatgtctctccatgcagcacctaggcagaatctagtagatccgtttcttttggcctcttctgcctctttaatcacttcatccactttaaccattttctcagcctttagaccggtatcgtttctcgaagactgcgcacaatacttacagtcctcagaacaaccaccagatttgatgttcatcaatgtgcacaattgcactttggttggatcgtgccactttctgtgctgcaattgtgctgcatgagtaagttcgagcagtggggtatgataaatttcttttaattgcgattttgtccacgaatgacttggttcatctaaagacaatgcatattgtagagcacccagagtactagcttctgaggatgcagttgtcgatttaactgcggcattggttgcgtatttagttaaagccggtctagcggtagataaatgacggtagatagtagacatcatactgcactaaattgaaaataatcggctaagttagctcttctgaggacaccactaccagaagagtaagatctgaaaaattttcagcaagtatgggagcaaaaaaagctttgcccttttatataagatctgcctaagagaagaaataaaagataccaagagaatctagcagagtggcaaacgaactacatagcctgtaaatacagattaggcagcagcgtagcggattttcctcaggcatcgtctctcacgtgaaatctgtgggggcaccagcgtgacagggacggttctaatgctttgcacttttcaacaacttttttccataaccaaatgccggcaaaatggcttcgaagaagacgcgagacttcatccgcgagtcatctcgacatgactatcttttgctagccaacacgcccctccgcaacttcccacgataaaattgtaaagaacagtactgatggacagagatttgcgcagtggcattttttgaaaataaaatgaaaaattatatatatatattccatacatagtatataatatgaactcgtttgacttggaaaattttagatgcaacaggcaatatcgttgggcttttttatttgatcattagcttatttgaatatgaaggtaatgaccaagggctactaatgtctttctattaagccgttttacaattgtatattttgtaatttgcatcgcagtcataacttcttgcaagaaatagtagtttcacacaatgaggtagtttcgttggagatgcagtaataatgcagaatacggatctcacggaccccaagagaaagctacgcaatcttacggcttgtaggttctcagttcccaatcgatgcaaaatgggtaagtattttcaagactgaaataaggtcgcttagaaacggttatccatttactattatctggaagctgctttccacagctacctactttggagtaatggtttccgggaagacttcatcctagagcctcttgctgttgttattcgaagttcagattcgtaaatggtagtacgttctgctttcgcaatgaataactaggtcacataagccctaaatgcgtcagtagaagatcagatgcattgaccacatcatatccttctaaagtaattaattgagatttaatatttttcgtactgatgagaaagctaaactagtgcaactattatagtcacatttgtacggaaaaggcagaagcaagaacaatgacttgaaagagcgtatagctatttaaccatttccatttgtatgctataattcaagtatttccacactcttaactaaaacgaatcagaagagtaggctactaagaaagatggctatccttaataagtactatccgacgttgaattgaagattaaactgagccacacattcccatcttctgcacacttagttccttatttagagacttttatgataaaaatttcttccgttcactgttaaacaaccttgggaacaatgctgactgtgcaggaaaatgacctatgtttgaaggatgttgccacataattgaggcatgttagcagagcattccctaccactggaaggagtgatggttgatgtattttccattgagactgtgacattgtgatacgatacctaatcaacgaccctatataactcattaaaaatggctttctagaagctacatctatttgattaaattggttcccattttcacaaatattttgccacctctccttctcgccaaggatttgtacaaaattaacagaccttttagaataaatattaaatttaggtcagcagaatacggccaccatctcattctttactagatcaagcgtcaattccaataattataaaaatataagtcaagaaagcatctttcttcgagtctcctgcattcggtttgcgttcctctctcgttctgcttgacaaaagaaagagttttttattctcctaaccaataaattgaagcaatcagctatagggttagatgtattcgttttcctttctgaccccttatgtccccatttggaagttctaaacaaatgccctttggtgcccagtatatgtcaatgacgtctgcttggcgaatctctgaatcataagtgttacataaaaattaagtatctacggcgcagtacaacgccttcgtctggttaaaatcgactcttctgtcattaacataagaacgtataacaaaaaaaaaattatatcaatgtatacataaagctacccaaaacaaactaaaacatcacttttgtagggtttcttcgcacattatcattattattctttgagaatactcattcgctgatatatattcttccttcccatggcttcaatgttctggaagaggcatctacctccttctttggatagtttccaaactctaacttgaacgatgaatcatcatttggaatcttgaaatctgtcgcatcagagctaaagttcaaagccgcaaacaatgttttattgttgtacttctttgtgaagctaaacaacttcttattgtctaaatcaataaactcgaaatcgtatccgtacacagtaatgtctttatgcgcctttctaaacttcaaggcctccttccagaagttcaaaaccgagttgggatccttgatttcatcttcgacgttaatgccttctctgaaagagtcgttcaagtaaaaccatggtttagcactaggaccagaaaaaccagcatttggctcctcacgagaccattgcataggtgttctagcatggtccctggagataagggcaatggcttctaaaaactttttcatctcctctgagttttccccatgctcttctttaatggcattgtagttgtttctgatttcgacatcctcgtacttttcaacaggccagttcttgaaattgatttggccaagctcttgtccctgatacacatatagagtaccggtcaaggcacttagcaacacagagagtaacttaccagaaataacacggttcttgggagaatcgtcaccaaatctcgtaattgaacgaggttggtcgtgattttccagatagattgttgaccaacaatctgtaccattaatgtacctgaacagctcagcaagggcaatcttccaatccttcagttcaaatgggaccaagttgtaacggaacaaaggtgaagtccccacatcagtgtgggaaaagttaaataactcactaagttcgtgtcttgaagcactcgtataaagtctcttagtttcgtcggaggcatgttgcatttcaccaactgtcataatctccctgccatccttcactctgtttctgatgaattgattcatttcttgatggaactcgtgaatacgtggtccattcaatgtgtatggatcactggattgccaagtcgagtttttgtcaacaacaggagcatctggtaaacctacaactttggagtacaaacttccgacatcaattctaaagccgtctacaccatggtctaaccagtatccaacggcactttcgtagattgcctttctacagtcttcattctcccaattcaaatcaggttgagtggagcaaaacaaacgcaagtagaattcttgtgtcttttcatcgaaggtccatgcggaaccaccaaaataggatttccaattgtttggaggaattggcttgccttcggcgtcataacctttaggaggtctccagaagaaccagtcacgctttggattagtcttcgaggatctgctctctttgaaccattcatgttcgctggaacagtgattgatgaccaagtcggtgataaatttcataccaagcttatgtgtcttttcgatcaaggcaaagcagtcttcattcgtaccatatgttggccagaccttttcgtagttggcaatatcgtaacccatatcatcttgtggcgagtcgtagaatggtgagatccaaatggcatcggcaccaagctctttgatgtactccagcttggaggcaatccctttcatgtcaccccagccatcgtcattagagtctttgaaacttgctgggtaaatttgatagaacgtggcctctttccaccactttggttctgtctctggatgtgcagaagaaatagtcatcgatagtaaatattacgttgaaaagctttgtttgtatcttgtttgatctgtgcttgctcgattaatttgagacagcttttttatttcaaaacaggcgtctaaccaaacgtctagcaactcaatatcattgcccttaagtactttttatttcaaaaggagatcctttctcattctggggtaaactgtggtatgacgaaaaccatgaaaaataaggaacataatttatccgagtatttcaacgatcccaagtactgacataaactttagtagccaatttatagcgtggggtgcctacttcgtcacatttgatatcgtacagcgaaaaaacattagtaactttatttccttatttcagggccacttttctcgagaataacgctgcgtgctgagcggttgttcacaccgcggagttggaaactttattctccgaaatattctccccactaaaatatccttacgtattgtgaaacttagttttctttttgtattagggtgtaatttcttattttccctgtatttcaccgcatgcaaattcttacgatatttactccggtaaacgcagttaagagctattgtccggtccgactgaatgaatattcggttagaaacgcatatttgtggggaaataacaacctcaaagatatagacggagcagtaccgtaaggtttacagaatggcatgaccacccacaataaagcaaggacctcgagacacatgcctttcaaaatagaaataaaggttttcgaacatcatttttcgcttgttgtatagtagtctttacagtaacagtgcatctgagtacaggaacgattgtcttgataatatgtgaaaagtgcacacgaaattagagggtgtcctttacaagtattcttagaaacacattcaagagcacaaaagtcgatgctttaagggtcaaggtggtggaaaacttgactggaattcttgacgaaaaaacaagaaaaacgtgattcgagcaatcataaacatacagccccgttccaaccggatcttgaggtttcccattttagatggaaataagcagagcaaaataaaaatcttgaacaagtaatagtggtgactgcaggttacgttggcatataaagtccgggtgacctgggtttcctgcaccaccagcccccatatgctagcacaatgggttttctttatccccggtcataattactcattttgctatattcttcataacttaagtacgcagatagagaaaattaataatctcgatatatattaaagtaaatgaaaagtagaaaatttagccagaactcttttttgcttcgagtatgactttaactaagcaaacatgcgccaagcaggcatgcgactgctgtcgtattcgtcgagtgaaatgcgatggtaaaaggccgtgtagcagttgcctacagaatagtttggattgcacttatctgcaaccgtcgagaaaaagaggtccgaagtccattaggttgaggagcttgaaaagaatagcagaagtgcagagggaaagcggtcctaacaccattgcaactgctcctgtaatatataagagggttcccaaaaagctaatcgatcagtgcttgcggctctatcacgataatttatacgtaatctggccccttctttcgtacgatgaccttcacaaacttctggaggaaaaatacaatgacaattacgtatattggtttctgaccgctttatcagcggccaccctcagtgatttacaaactgaaataaaatctgaagaggaagtcactttcacgggaaaacagttatctaatctttgcatctcatcgtgtcagcaatttgacgatttggataacagcaatatattcaatattatgacgtactactgtttgcatcgtagctttgcacaaatatcgaacgcaagaacttcttacagactctgttgtgaagcggtcggtctgattacggtagcagggttacatcgggaagaaacttacggatcccttacatttgaagaacagcaacttagacggaaactttattacttgcttctcatgacggagagatactatgccatatatcttcattgtgcgacgagcctggatgccacaatagcaccaccgcaacttgaacttgtaactgatcctcagctttctatggacagtttccttgaaatgattagggtatttactgtaccaggaaaatgtttcttcgatgctttagccgctgactctacagatgcttcttgcactgaagagtcattgaaaaagatatggaacgaactccacacaacttcctcggaaatagagccatggtctaacggttacatagacatctcattttcccggcattggattaggatactagcatggaagctagcttatcaaatgaggggtagcaacttttcattgaacgctaacaatgggcaaataccaatagaaattgcgagagatatgttaatagacacttacttaaccccagagaatctttacgatgtccatggtcccggggtaccagtgaaaacattagaaatagctactgctttggtggacattgtaggccagtatgatcataacatgaaattagaagcatggaatgttttgcatgatgtatgcaaatttgctttttctttaaaccactataacaatgatatgctgaagagattttccaccaaatgccagaatgccctaattactctgcccatttctaaacctttacaattggatggttatcccaaggataatgaagacatagacccttgattaattttcatttttgtgcatctcaacttcctggtaagtgatagctttccattgtagaaactgtgtttccgcaacacaagggtaaaattcactgctaattgcgacccattttcatgaacagagtaattaattttctatttggaggtctacttttacaagtataagactgcttcttaccatgatgtctccctattgaaaattatatttaataaaatacttttaggcacgctaacgttagcattcttcccagaattcctatactaacagttttcagtatatatacacttttttactgagtgctaagagccagattggatgagatgattgtgtactgatgggagacaagtttagcttgaataggctagctgcaatatggatactttcactctcatcctttcgcttttgtgatttaattagcataatcaagatgactttatatacagcgcgttgaagcacttagtgccatgtaattacctcatactattgttgaagaactgtataataaagttttgaaatttttcagtgtttgagaagtattatatttccacattgtagctaatgaaatcatactttcgtcagcactgacgctcaaatgaatgatatgaagtattgctcgaccgttataatggagcactagttgaagggcagaggaacaagtgaaatacaacagctgagtgcagataagtgctatggtttgttgataatattacttagaaatggtgtattcagcattgataagaaaggggcggtactttttgctaccatgttgctacctctgggatttggatatttgagtgaatcaccattcgcttattcaatacagagaagatagataaatgccagttaattttaggaggcaagatattattgtcatttatgtttgccatttaaagcaacatttttatggcagaacataacattaaaagaatccgatctaaatttaactataatagttactagatacggacatatctctaggaactatgaaggctgaaatgtctagaactttggaaaagagatgtcctttctgcgtagcttaattcatttccttcctaaaaagtccgtagaaagaacactgcacctcgccttgggcaggctcctcagtgaaaaccgaagaaaaaatactacaaataaaagaagcgcgatgatacttgttttagatatatggtttacatctcacagaaaacacgtagcccttgacgcggggaaattagaaaagaagcgatgtttttcacaataatgcaatatatatctctattcttagtaataataacaatatctactgaagaaaagtaatacgccacatgaagactaacgactttataacctctcgcaaggcagacgaggactgtcagaccattgaaaacttgacgaacttgtacactagtagatttcccatattcttcctccggttttttgaaatcttgtttgactttatactgaaaaatagatcaaagaagccatatcagtggcggctaattaggtaatatttataaaacaattccattatattcaaattcaaagtgatagatttttgaatcacaatttctaattagaacaccttcaccacatactgctaacacgaaatttacctaattgtttgtgaggatgacgaccacatgggtttgattttttttactaatcgcttttgtatatcaaatgcaatttattattattttcatgtcaccaagaaagaataattctttgaaatggttgtttatatcctcagaattggaaaattatttgccaagcgattgtgaaactatgtgatatgttttgagatatttcatgaaccatatagaatatgcatagtatatcccaataaagcattgaattatgaatgtcgtatctctataagctctcacattaatgcttcaaaaatacttcataaaacattataatatagtttaatgtgatttttgcgtgattctctccttctttttattaagtgtatggacatttaaagtaacagttaattgagaatacggttgacctggcatgttgttcgaatcaatatccaggcacaagtaccaggtgctaaagaaaaagtactctcatatttgcttgattgctgcttgggctattttaactaactactaacaatattttgcttaaaaaatggtaaatatgaatgttttacagaaaaataaaaaatgtatatatataaaatctcgagctagctgagggttttgggagcagtcaaagggattccttatttcttccaaaaaaaaaaaaacaacccttttacttaacatttatcagctgcatttaattctcgctgttttatgcttgaggactgactgatactctcatcagctagcgaatcatgttgagtttttccctttccgaatggatcaaccacagtagatgcaaattttctggcaggaaccccttggttgaaaagttcattaatttcactgaaggttctaccagttgtctcaggcagatcgatgatgacccaagctaaagtgactgctgtgaaaccaccccagtatagaccagttttggcaccccagttccaatcgctcacgtttagcatatagggcgttaatatagcgttaataacggccatgagattgtagcaaatacgggccagcactatagtcttagttctcaactccgctgatggaatttcagcaacgatacagtaaacaactgcaccgataccagcattgtaaaagaatgataaagccagcaataaaccaccggcaccattactagcgctgcttccagaaccaaaacccattccaccaataataaataagcagaccatttgaaatgcaagaccataggtcagtattgtccatctaccaacacggccagatattacccaggagcaaagtgtacccgctaacccaagacagtactgaattagagaaaaagtaaacgccttgtcggtggccatacctgctctttcaaaaaaatatgtcgagtaaccaagtaaaacggcaccgctactattttgagctacccaagttaaacatgcaagtctcgttcttcttccattaactcccttgaaacaattaaagaatgatcctgatttagatgctaaaagtctttctttttcaatagtcaattcaatctgctttaaagtaagatcaacttgaatgtccttctcggcgcctttaccactcaaaattctgcttaaagattttcttgcctcagcgaccctatcctttctcaccaaccaccagggcgactcaggagcgaaaaagataccgatcattaaaggagcaggccaaatccattgtaaagcaaatggcaatttatagcccaagtcggagttccctaaattctcttgtgagtttttcataataccagaggcgaagatttgaccaaataaccaacaaatgttggagtaactggtcatgtaatatcttaatgctaaagggcaaacttccgaagcataagtaacagccaaactttggaaacaaccccatggtatagctgagagaatttgtcccacagcaatcatagctaaacttttacagtagtagaggataaagatataagcagttaacaaaccaagtgctgtaatcatcgtataacgattccccataaattcaaccatataagtcgtgatttgcaaaccaatcatctcaccacaaaggacacacatgtttaaaccaatctgccattgggaagtaatttcgtaagaaccctccccgttcaaagtaccgaattttctctgaaaaactggcagggcatacagtgcgctcagtagtgcggtatcataaccttccataaccagggtagtagacactaatatggaccacagggctgcttttggatattttagcaacgcctgcttcaaagtcatgcttttttcctcgctgttagcttcatttgcatcatcagtagcgttcatctcattaatcacattctcgttatcttcgtcagaatctcctaactgggctgaattggtggtgaactctaagtggtctagctcaaaggcactatcctttttcccttcttcaaaatcttcagtattgaaaacctcctgttggtttacaatatctcttgaagactcagaaatgtttttatcctcattttttgaggcagccttcttcttgcttaccaatgaaatgatatttttcatattatactatttttttagttgtttgatgttcttctatgtagcatcagaaagaaacaccaacccgaaaattcttcaaacaatcaataccaaaccgctttatataaaaaattaagatgtcgacattccttattttttactgagttcgttaaagttgggtacactcttgattactgtaattgtctctgtatgtccctcaagcccggtacgttgtcattttctagtacgcatcaacggagtgttacatgatagatagaccgagtagaatctatggctatggggtaattaaaaccttaaagctcctttcgctgccatagtaatacgaatagaccttggctatagtaagttgcatctgtaccgtagagattcttgcaactcgcttaaactctcgcttttagataatatttctccttattgcgcgcttcgttgaaaatttcgctaaacacggggtttaagttaaagtttacaggatttatccggaaattttcgcggaccccacacaattaagaattggctcgaagagtgataacgcatacttttcttttctttttttagttcctagcgtacctaacgtaggtaacatgatttggatcgtgggatgatacaaacaacgtaagatgaatagttccttcctcaattcttcttgcagcatcattttcttgaggcgctctgggcaaggtataaaaagttccattaatacgtctctaaaaaattaaatcatccatctcttaagcagtttttttgataatctcaaatgtacatcagtcaagcgtaactaaattacataaatgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatccaactacgaaaaggtctggcccacatatggtaccaatgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaagggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaagttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttctcttgaatgaatctttcgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttaaatttcagtggcgaagaaattgaattcagcctcccaagagaaggtgcttctttatcttttattcttggaaattatgatgatactgacgtttcctccagagttttgaaaccatgggaaggtagaatctacctcgtcaaataaaattagtgccggcttttttttagcgcgtactttaacgaaataacacatgatttttcacatgatttttgttagataaattttttatatgtaaatgatgatagcgtaaaagcactgttgataatttgtttcaccattatgggtaaatgtgtttttctacatgaccctcgttcattatgatatttagcgtgtatataaatgtgaattccaaattattaatgaggcataagaagcactatcctttctcttcggatgaaaacaagggagaagaaacctgtgctggtattaatgctgaaatgtcttgctaagaatcatacaaggtggtagttttatttaataaagaaaagaaaaggactagatataaaaagtgaaatgaatataagatagcgttaagagatgtccgcagtacttgacacataatttagcgttttctcgggaagctctgtgattttatgattcaataacacagcgtaattgatttcgtgatagttcgatcctatatgtaatctcacgtaacactcaggcgagttacaaaatcgattcaacattgccggcttatgcgtttacgtcaagtctgagcatgcctacccccttccgaacccgccttttattgtctagccttcagatgaactaaaccaatcatctgtccataattcctctgctttagacagtgttattaagcaaaagaaaataagcgcataagattcttgctacttcagtaactccacaacattaacaccccacaatcaatatctaaaagccaatgaagtgaagatgagaggtggaatgacggtcttatcctttgagaagtttgactactaaaatctgtgtctcctataccattagttattgagctataactatataccagagaagtgtagtaattcttcagcaacgggcctataatctggatacgtatgattacttatcgctgtaatagttgtaaattcctcgaagaaaaacacatgaccagaatgatagacatattgaaacagtgaataaaagggagaaaaaggcttaaaggatttctgtattagtaacactaagccctctatcaatttcatccaaacagaaagactgcaggtacatccataggatagaagttctgtatgtaatccgccactttttgtctccttcatgtaccatataatgaatagaaaaacgtagacctaggcggcaaccgttgcctaccatacgaagcgctgatgctgttctccgattattagtattacaaaaaaaattatacaatacttattaagatgttaacttatcaatttccggtatagtttccgctatggtcagctttgtccagtggaagttccgctgtttcagaactagagcttcgtagcacctcgaatgctcatttattcttgtcaacatttttgctggcagtgtataagactgtagacacctacaatatacgactccggtattcgataagtctttcactttctattttaagaaaaacagaatctacaattttcccgtagcaaccgtttagcgcacaaagattagatggcctctgaacgagggttcaaagcaaatttggttttagctttttcttggccaaaagctgcagctgcatctctgaaggcaccctaaagggattcttcggaagtatgtacactgtgagaaaacattcttgtgccttggaaatgcaataaaaaggtataggcactatgaagcgtgcgcctcgtatacgggacctatgaaagacgcatcgttcaagtacagaagcaccgtaataatatgaataatgaatgtgggatgaacattgtacactgaggcattttaggtgagagatgggtgccagatgataactcgtttgtgccagggaagttggcaagacattcatataaatagagctgctgtagctatccatctttgaggtatgcgctttcatttcactatttcttgttaagcttacatcagcactaaaaaacaaaacaaatacaatggtcaaactaacttcaatcgctgctggtgttgccgccatcgctgctactgcttccgcaaccaccactctagctcaatctgacgaaagagtcaacttggttgaattgggtgtctacgtctctgatatcagagctcacttggcccaatactactctttccaagccgctcatccaactgaaacctacccagttgaaatcgctgaagccgttttcaactacggtgacttcaccaccatgttgactggtattgccccagaccaagtgaccagaatgatcaccggtgttccatggtactccagcagattaaagccagccatctccagtgctctatccaaggacggtatctacactatcgcaaactagagacaaacgcctttacgaacgaaattccataaaccttaagaaataacgaaaataaaaaaagctttttttttttgatagtataaatagttcattatatgtaagtgtatattaatattgttactactggtcaatcgtgatatttatgaacaacttggcggagcaaggacaagaatcctctcttccttttgtggtattcttcgatgtgtgtccacttcaacgacatgggtcatcaatatctatgttgaaaaaatcatattttaggatcacttgctagtaaaccggttgatgctattgttaatatataacgacaaatgttcaagcaattatataaccattttcttccatattcaccttaaacgaggtcgcctttattttttttttttttttcagggcatcgatcggcccggagtcgtcgccttcaaatgtgtcaaatttttaagattaaagttatcgatcttgaagtttttcgtggcaggagggtttctatttagtgttcggtaaaggctttcataagcttttgtatatcccttgattaacaataaatgtggaaaataagaagggtaatttgtgaaagagtccgattctagtcgatgtacagtaaaatcacttattatttaaggattccgctgcggtatgcgttttctactgatgcgtggagcaagccacgccatgtgattaaccttgcttgataaaagcaccaacccatcgttcagaatatgcatggaatatagcatcactgggaggagaaagacaataagttttgcgcatatggtaggatggtggcacactgatttctgtcaaccagtgagaaatagggaaaaagaaaatggttgtaatggtaaaaagtagtctcgttttggttattcgcagctgacaaactacaaaatatataaattgaaaaagttgtatttatctttacgctaaggactcctcactgcaggataattgcgcttctttaatatatggccatagttccacattcaatgatagagcccgcatagatttctttgcagagagaacgcggtagaagaagtggctaaaaaaccattcacagtcaatcccgtcaaagaaaaactcttcattcttccagacttttttctcaaacaagtacctattcattttctttgcaatttcgtcccatccatttgcaccactttcttgctcatttataatagtcgataaaaactgcatcttgtgttccattttcacggataaaacgatcatcctcatattccggaaatctctcgtcatgataaaaaacagcaccacaagaaacaagggacgtgctatagtgccatcatttcgtgaaatgaagacattatgcaaataaaaaaggaagagtggtaaacaccgccggttgaaaatccttttgagaacccaggtaagcttaaatcggtaagcttccttgggaagtttagcatcttccaggccaacagggctccatgatttctcagaattaaacaacttccattgtttttcaacttctgtaaaataaacttccaatgcttcttcaatgtaagggacggaatccttaaatgacttaaccttggcagcttcgtcttttttcaaagagaagggttcgagaagggttgttctgaatgcttcttggcagctcatggcactgaaaaaaaagtacttggtattccaagccttattttcatagaagtacgaatttagatttgctgcaacgacttcccaatcatgaggatccgaacttggtgtgtttttagtaatctctttgcaaaactgagtgagttgtttcgataaggaacgtttacgagaaagtctaaaaataacaagaacaaatactggtccccaaaacaggacaagaagtgaaaccataagcgggtaaatccaattgttggaaagtttccaccagacgctaagtggtagccataatagcatccagatgcgaaacactaaggacttgtaaatttcataacaaaaccaggtaaagctgcttctgaaaagatcttgaggtagaacagtcttttgggattcgagctgtttgacggataatacatctacactcttctcatttttaagttcattctctttcattttcggtagtgagatggcagttcgaggggttttttattcaaaataataacttctggcttttcgcttttatatagcagaaaaaaaagccgtcgaggcgcgcgcgttcatgcaatggctcagtaacctcgggatagaaaaagggcaacaatgttgagctattttaggcacagaaactttactattcgaaaagggcatccatttcatttccgattttctatctagctcactcgataatcgtaatagtacttttataaaactttagtgcgggtactgtgagagtgtgccgtaactttggtttacatttaaggtgcgaccagcaatgtcactacttttacaacaaccgccatatggctcgagaatttcattatcacatggaatgcctgtgacaaaactgtgtaaatatctaatagaaattagatgtagctgtcacaaatatttacacaggaaagagcctgtcctacgagtatcttacatgaagattcatagaaccaatttacttgcgaatgtgaacaacctttcaacatcatttcaataccattttccctccttatgtttggtgtcactgtaaagcggatcaaagcaaaacatagaggtacggtggtgctaagatcatgcatgacctctgggtaattactacttctcccgcttgttttgagattctgtatataaatatttcaaacaaaaggatagagcgcggatggcaggccttatagtaaaagttattcgttttaatcatgtgtcagtatgagattctatgacaatagtatgagaagatagggtgaagtaaaagtatctgtatgactatagagtgcagttatattacaatatattgaatagatcataatggtatgacgatattaaggaacatttaagttaatgacgtcatggtggtatagatacgcaattgagtgtgtttatgtattattgttgaaaagtagaatatttttatgtttaggtgattttgatgatatttttatgtaatattgacataagtgcatataaattgagtggttagtatatggtgcaaaagtggtacaacatatgtattaagggcatttatacaatatttggggccgccgaatgagatatagatattaaaatgtggataatcatgggatttatgggtaaatggcacagggtatagaacgctgaggcaagcgccgtgcataatgatgtgagtgcatctagtactgatttagtgagaatgggccatggagtggagtgtgagagtagggtaacttgagatggtatatactgtagcatccgtgtgcgtatgccgtatcagtatacaagtgagggtgagtgtggcatgtggtggtgggattagagtggcagggtaagtatgtgtgtattatttacgatcatttgttaacatttcaatatgttgggtagaacaacagtatagtgagtaacaagatggggcatggtagggtaatggcagggtaagtggtagtggagttgaatatgggcaattggagggtaacaggtggtggatgtgggtgagtggtagtaagtagagagatggatggtggttggggtgtggtatagttgaatgagacagggtaacttgtggggaggtagggtaatggagggtaagttgagagacaggttaaatcatatatatgtcactgtattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttctattatattggtcttttcgagagcggaagaagttgtaggctaagcgcaggctaagcgtaggtccatatttaaagtatccaagagaatatccacgaagcggctgagcaacgaacagaatcctggttctcctcgactaagcagatagttaagatactgtgcaccatggaaattgaaaacgaacgtacgtaccgactactttatttttgcaggccggaaatcaagcgatgaatgagacatccttctgctttctatgttgtgcttgaaggggacagacagtcgcttatcttagtgagatttcttactaactgaatttactttgctgctgctagagatttgcacctgcatagcgcagattctgcatcttctcaatagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggtctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggggtcttcagaaaagcaccataaggaaatatggatacaatttggcaccctacatgtttttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatattttgcatattatcttgcgagcatgtgcgctcaatttcggggcgggtccccgtggtggcgctggtgacgaagaggatcgatccattacgaatgaagaacccattattccctctgtggacgagcatggcttgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcgatgtggaaatggatcaaaattctgtaccacgaagtagcgcaggaaaccgcgctgaaggactcttatagaataactttggtaccttcttctgatggtgtatcagtatgtggaaaactgtttaatcgcgagtatgtccgcggcttttactttgcatgcaaggctcagtttgataacctttgggaagaattgaacgactgcttttatatgcctacagtggttgatattgccagcctcattttgcgtaatcgagaagttttgttcagagagccaaagcgaggaattgacgagtatctggagaacgattctttccttcaaatgatacctgttaaatatcgtgaaattgtgctgcccaagttgagaagagatactaacaaaatgaccgcggctcttaaaaataaagtcactgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatcatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctgcaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatatattattatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgctgtagggctaaagaacagggtttcattttcattttttttttt

SEQ ID NO: 12211 - DNA, 562638 bp, Saccharomyces cerevisiae
cccacacacaccacacccacacaccacacccacacttttcacatctacctctactctcgctgtcactccttacccggctttctgaccgaaattaaaaaaaaaaaaatgaaaatgaaaccctgttctttagccctacaacacttctacatagccctaaatagccctaaatagccctcatgtacgtctcctccaagccctgttgtctcttacccggatgttcaaccaaaagctacttactacctttattttatgtttactttttataggttgtctttttatcctactctttcccacttgtctctcgctactgccgtgcaacaaacactaaatcaaaacagtgaaatactactacattaaaacgcatattccctagaaaaaaaaatttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagcggtaccctcgtgttatctgcagcgagaacttcaacgtttgccaaatcaagccaatgtggtaacaaccacacctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcctggcactttttctcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatacgccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacggctctttgttaatgtcggtgactggatggaatctattatcctcagcattgccatctttattggcgtcctccttggcactagcgttggtactttcagtggtagtagcattagtgctggagttggtgctagcagtggtagtagcattagtgctggagttggtactttcagtggtagtagcattagtgttggagttggtactttcagtggtagtcgcactagtcctgacgttgatgctggcagtggtagtcgcactagtcctgacgttgatgctggcagtagtagtagcactagtcctgacgttggtgctggcagtggtagtagcattagtgctggagttggtagtcgcattggtactggcgttagtactggcattagcactaccatgaatgcacgtgtcgctgtcctcatcactgctgcaatactttctgtacctgtcactgctattgctctcctggaagctagacggtaacgcaacgatcgacatggaagctgtcgcctgattttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaattggtggcaattcacccttacgattcttgcggcccaactgttttttctagataatagataacagagcccccccccccatctcttagtctccctacgccttgaatgagctcaataatattaagtctattatcaagcatgatcaccatcatcaattgcttaatgtcaattccttcagtcactaattttgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcactttcaaagagggctaaaagaagcttcagtgcttcttcgggctgtgattccactttcttccgaattttatgaacatgccctaaaggcaccttggatttctccttgattagattaaacatccgtgttggatagctggatagacctctgctgagatcttccgaccgtttgagctcgttgatgtccatcgacttcttggccagtcccgtaagcccaatacgctgcaacgcagcatcagcaacagcctcaggggctgtgccgctcaaaaagattgctttctcaaaagcgtcaaaatcaaggttagttatgcccccaaattgcgactgccggtagacctccgtttcaaagttgtgcaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggcccaacctgatcatgcaattagcaagcaacactgtgtacggtacaaacagaaacgacacatattccacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcagtgggtttacgtgggcatagatcacgcttcagccgctctgtgtcgactttcttttcgccaggtaaacttgcttggtatgcagaaaaaatcgatagctcatctacgtgtagtaacaaaaacatgtggggtgccaaattgtacccatatttccttatggtgcttttctgaagactccttacaataggtgcgccagaaacaaagtcagtgaaagtacgcatcgtagagctgtcgttcggcctggcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtcccaacatagaaaacagaaggatgtctcattcatcgcttgatttccggcctgcaaaaataaagcagtcggtacgtgctttcgttttcaatttccatggtgcacagtatcttaaccgtctgcttagtcgaggagaaccaggattctgttcgttgctcagccgcttcgtggataaattttattaccccgctgaggtagaggagccctttttggcgtaccaagtcacttcctaatgctccatgtcccacccaccatgttgaaacgttgacaaatgatcgtaaataatacacacgtacttacccacacacaccacatgccacactcacttgcacttgtatactggtacggcatacgcacacggatgctacagtatataccactctcaacttaccctactttcacattctactccactccatgacccatctctcactaaatcagtactaaatgcacccacatcattatgcacggcacttgcctcagcggtctataccctgtgccatttacccataacgcccacgattatccacattttaatatctatatctcattcggcggccccaaatattgtataactgctcttaatacatacgttatacctctttttcaccgtatactaaccactcaatttatatacacttatgccaatattacaaaaaaatcaccactaaaatcacctaaacataaaaatattctatccttcaaccatagtacataaacacactcaattgcgtatcaataccaccatgacgtcattaacttaaatgttccttaataccgtcataccactatgctctattccatatattgtaatataactgtactctatagtcatacagacgcttttacttcaccctatcttctcatactattgtcatagaatctcacactgacgcatgattaaaacgaataatttttactataaggcctcccatccgtgctctacccttttgtttgcaatatttatacagaatctcaaagcaagcgggagaagtggtgattacccagatgtcatgcatgatctgagcaccaccgtacctctaggttttgccttgatcaattttacagtgacaccaagcataaggataaaaaatggtattgaaaggttgtccacatttgtaagtaacttggttctatgaatcttcatgtcagatacgtaggacggactctttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccttaaatgtaaaccaaagttacggcacaccgtgatgcacccgcattaaagttttgtaaattcgttattacgattatcgagttggctagatagaaaaccggaaatgaaatggatgcccttttcgaatagctgagtttctttgcctaaaatagcccaatattgtttccctttttctatcacgaggttactgagccattgcatgaacgcgcgcgcctcggcggctttttttttctgctgtgctgtataaaagcgaaaagtcagaagttactatttcgaataaaaaacccctcgaactgccatctcactaccgaaaatgaaagagaatgaagtcaaagatgagaaaagcgtagatgtgttatccttcaaacagctcgaattccaaaagaccgttctacctcaagatgttttccgaaacgaattgacctggttttgttatgaaatttacaagtctttagcgtttcgcatctggatgctgttatggctaccacttagcgtctggtggaaactttccagcaattggattcacccacttatagtttcacttcttgtcctgttcctgggaccattttttgtccttgttatttgtggactttctcgtaagcgttccttatcgaaacaactcattcagttttgcaaagagattactgaagacacaccaagttcggatcctcatgattgggaagtcgttgcagcaaatctaaattcgtacttctatgaaaataagacttggaataccaagtacttttttttcaatgccatgagctgccaaaaagcgtttaaaacaacccttctcgaacccttctctttaaaaaaagacgaatctgcaaaggttaagtcatttaaggattccgttccttatatcgaagaggccttgcaagtgtatgctgcaggatttgacaaagagtggaagctgtttaatactgagaaggaagagagtcctttcgacctggaagacattcagctccccaaagaagcttaccgatttaagcttacctggattcttaaaaggattttcaacctgcggtgtttaccactcttcctttattattttttaattgtctacacgtctggaaatgctgaccttatatcacgtttcttgtttccggtagtaatgttttttatcatgacgagagatttccaaaatatgaggatgattgttttatccgtgaaaatggaacacaagatgcagttcttgtcaactattataaatgagcaagaaagtggtgcgaatggatgggacgaaattgcaaagaaaatgaataggtatttgtttgagaaaaaagtctggaataatgaagagtttttctacgatggacttgactgcgaatggttttttaggcgctttttctatcgtctcttatctttaaaaaaacctatgtggtttgcttcgttgaacgttgagctatggccatacattaaagaagcgcaatcggcccgcaatgagaagcccctaaagtaggaacaaatgttccttttccaaaatatactatgtgtagttgatcgaatatcagtaagtcaaaacgtattttacttgtttattattattaatactccttttcgcatatgttttatcactttacaccatacaataaccactaaattcaaaaacacttattttcaatatttgttatagaaaaataaccactaaaatcacctaaatataaaaatattctaccctttagcaataagactgaaacactttacttggggtaagaatactgccatggtgtcattaacatgaaagttcaataatgttttcatactaatcaatatgtacacaggcttcacattagaacatcatatattaaagcggtaacttaaaatccagataatacatttttggtcatataagtgctttttttttgtaggatataatcgcaaatgatatcactacactatgacatattgttgacgtagtaaattacgatttagcttatatgtcataatgtagtaagtttatatatgttatgtaaatgtaagaattacataggtactgtttttgtacacagaagctataatttctcaagtactaccggattagaggtttgctacaatacgttttccactatatgttttctatgtgtgaaacattactgaaacattactcatattacgcttttgtgttatcacattaaacatatacatggtaacaaatattactatcacttatcttgcttcatcttatgtaccatacaaaaattactgcgcatatcagagatcattttttcgaacacatatcctgttggggttttgtaaatctttcttatgacctcctaaggcctttgcaaaacgtttcgcgatccagtcattgataggatcatcttccttggtttggacatattctctgtcaggtaacttttgggcaaaatcttcagtcaaccgaggatctcttacgcagaatgttagaaggaacataggcgctgaaaatacaagcgcaacaataacttcgtatttttgaacgtgtctgtaagcttcaaccatcgcagacctaactggagtaccccagggattggaaagaataaaagttagtggtgagccatatgctgctgtagccaggtcagcgtctcccatgtagtgcaataatttagggtacaatgactgcgtccatatggcaccggaaatggcagctgcaactgctccacctattctgaaaactgtatagtttaatgctgtgacagtagccatattctcatgggatgttaccgactgaatagaaacaattgtaggataatcgaataaacaactactgagaccccaaataaccataccagcaattatacctccatcggcgtcttgacctgacctgtagcggtaaaatagtcccatagtaatgaaataaagtgagccaccaaaaataatatacgacttcaatctagatgatctcgtaacgatgagccccagaaatggagcaacaacagcagtcacaaaagagtataagtttattattcttgtagctgaggaagcgctctcatctaccgcaactactagaatggtgtagagatacccagcagccatttgatatacaaagcagataaaaaacataattcccaatggggcccacacgccacgatcttttagcagcttgaatggagcgaaaggaaccaaagcaagtcgactttcccaatatatgaagcctggaaccaggacaaagccaagcacaaagggcccgataatctttgaatttctccaatttgtagagacgccaccagcaagagtgagtggtacaagaatacaaccaacaccagcagtaaacaacaacacaccgacaacatctagcttccagaacaactgtaccagcatttgtactaatccgtgcgtttgatagtacgatttttcatcctgtaattctttccattccacgtcatttcttactttccatctcatatggagcatacacaaaatcaatgggatacagcatagagggaaaatgaacgcccacatagcaatattccacgaccagttctctaacgggtttgctgcctccactacactacctgagacccacgtagtgataatcgagggccatgaaggtatcaatgtgtaaaatagcctccattttaatgaagaattatcagacaacatcaaaacaacctgtagcataacaccgacaagtcccacataataaaagacagctccagcagcatacctctggacatcatatgcttgagattgaattattgtacccacaatgtaaagtacaatggatacaagaaacaacgttagccttccaaagatatctgataaccctccaaagatcacctgtgaaacagcagatatcattagaactatgacgcttactgtagaaatgagagaatgtgcggagtacgagttcattgcgtaggtcatatatgtaccccttatgctgctatctaatccataagcgaaagtgcaaatgaatgcagaaaacaggaatatagcttttaattgccaagtatcatactttttagccattagctcagacttacgaataatcaatgattttgttccctttaatttatctttcatttcatctctgggcgacgaatcgtcatccatcttttcatcaaccatcagttcattacaatttttttcagtattcttacgctttgtttggctagaacgattgtcttctgggacttcgatcatatttcctttggcccaaagagttacaactgtttttggagctcaagtggaaaggacacaagcaaagttcttctaccaggatctcatgtctttatagaaaaaagtaaggtgtaaaaaggctactgggtaaaattcaccacgttatcttcttaacttgcccttagtgaaaagctgtatcatttcagcttctgtgcagattagtgagtaactgtcttagatttgtggaatcggagcacagaaactccagtagggttgttacggactacgttctgaaagtatattccgttttcttaaagcaggtgcaagttactggcataacaggacccatcacttcagccacagctttgcttctaaagatatatacgacatactggtaaagcacggagccctacggacgctcaaagttattcttttttttttgttccttactgtgaactaagaactgcacccattttctgattgcttgcttgagataggtgcttatataccgggtgtttgtatatagcaaaggtagagggagaacggattgcacacaacccggcctgacagggaaatttaatatctgcaggaaagtttcgtatgatcccggacgggagggaaacctttagaatttaataaaagacgatcattggactcacataatttaaattaacaaggaaaaatattgctaggtaggttgtcgacaactcaatatatatgaaaaaaaaagaaagatgctaaaacgaggcttttttcttttggacaaggggagtccaaccgccctgcataagtttattcagcctgtgaatgactataaaccatatatcatacttcttgcttctttatacatttttttcaatggaaatatttatatagaaagggcgctgcgctttttgaggtgaatgttttcatttttcaagttattcagtagcgttacccagttgagtggatagagaattcaagtttaaagctcatctcaaacaaacagtaaaggattctacgcggtacagacttatttcctagtcgagcatgattcgatcattgacatatatcccatctcttgatctaagacttgatcattttctttaaattaagagttttgggcaagtgtaaagcaagggttaaatgattatgtagttatggaagtaccaaattcaagttcgtaagaggcttgctttctactgatatataaaacgctcgaccgattggttcttcaattggtatagctaataactatagctggactaattaagacttcaaggacgtcttacgcaagcgtgggtgattttattattaaacaatttttctgtctctatacgcatatatgttctataacataaatatgtaatggatactaacctttttctgtgattaacttactctttgcgttacacctccatctgactcataaaacaggaagactcagatttattaactttagcatttacgccgcaaatggtaaatgctccggcccgataccctgaaatagcaacatgtacgaaagaaggtattcaactgaagccttttagacagacaagactattggattatcaaggcactatattttaccactacagtaaatacttctgataagaacggcatgaataatcaagtaggttttataatactggtatacattaatataatcaactatttatactatcaaaaaaaaaagcttttttttttttgtttttttaagttttatggaatttcattcgtaaaggcgtttgtctctagtttgtgatagtgtagataccgtccttggatagagcactggagatggctggctttaatctgctggagtaccatggaacaccggtgatcattctggtcacttggtctggggcaataccagtcaacatggtggtgaagtcaccgtagttgaaaacggcttcagcaacttcaaccgggtaggtttcagttgggtgggcggcttggaacatgtagtattgggccaagtgagctctgatatcagagacgtagacacccaattcaaccaagttgactctttcgtcagattgagctagagtggtggttgcggaagcagtagcagcgatggcagcgacaccagcggcgattgaagttagtttgaccattgtatttgttatgtttgttatgtttgttagtgctgatataagcttaacaggaagggaaggaataaagacatattctcaaaggcatatagttgaagcagctctatttatacccatgccttcatcagtcatcactacttaaacgattcgttaacagacgctcatttagtacctcgcatattctccatatctcatctttcacagaatttgattatcactatgaagatgttattgtttttaaacgaggcatgcatctttatagattccgtatgcgaaggtattgttttctggggcctttgtctattcgtatgcgcagaatgtgggaatgcctattataggggtgccagagtgccttataaaacccttttccgtgcctttgaagtttccgttttcggtcaaaaagaatatccgaattttagatttggaccctcgtacagattcttatgtttaagcccatattcaatttgctgtaaacagcctccaatggaagaggtaatactatattatccctctcctgatagtttaattaaaaatagaaaacgtgtattgggagtcgcttatttgtagagtttgtagtttttaagcgttctcaggaaattcattgacgcaattacgtaattgtaggccgctgagaagcagctagtattggaagagccgcgtatggtaaaaaaaaaatgttgagttcagtttgtagcagtactacaactctgtgcggtgggaaaaatttattcttcgaggcacagtatttttcttctagctagatataaagaaaagtgaaaaaggcaatatatggcgctaatgtattttattcaattaaaaactttctgtaggaaatggtattaatagttggtattccttgtagacaaaaccatcgctatattcatggtgacggctcatctctaaagcttcttaaatgtacagtcagctaagtgttctcataagaaagggtttgaagaagtctccgatagcgtgctttagtatgttgacgaaagaaatcaagatctagcttatatgtcataatgaagtaagttatattggagtttttctggtaaattctacaaaagttatgcaacatacttatttctgtcctcttcttactcgtcttgcggccaaaactcgaagaaaaacatacgggccaagaaaaatgatgcaatcctcccagttctagatattcccgcttttaagtcccgaattataacaatataaaaaggatatagaaaatgtaattgttaacttgtggtataaagacaaattcaaaagcaagtgagggcccgctaaggctatgagttcagaattattaatatctaattctaaaccaagaccagaaggattaagaaaattatgcgaaggtgagacagtgatccttccaagggacataacccccagcaaatgcgcttatttcttaaaacagaatatcgtattcatttcatatattttcatccatattattattaccataatcttaaaccgcctggcattatctgcacacggtaatactttgattattatcttagcggctttactaattacaatttcactattccttttactcctcttaccttacttaagctgctcaagatataagttaagatgtttagatgatgattgtaagttcaaactattagcggaagtcattacacataaacctaacatggacttgagcacatgggaccggattgcatatgacatgaaccaatttgtatatgaccgtcgtatatgtgcagatagatcttttttctacgatggcagttattgctatcaggtttttaaaaagttggtggctaccccgtaccttgtgaattccaatatgaatagtatatatgctgatctggagatgagaagtaatggagcaaccaacattaacgattctggtaatagttcattacacatcgaattgggcacttatatttttaaagcattggccgttttcaggaactctgttgacaagtactgggaggataagtatccagagatgggggtcacagtttgattggaaggtatttctaggttctactttagttttttataacgcatccagtacaaagaaatgatattggtatttggaaaagtcattgaatattcttgaatagattataagtgagcttcctttctgtatcaggatatgtggcttaactttaaactcgtataataaaagtactcgtatttttgtgggatgtttgcctccgtaaatttataaatggcaacaggaacactattataatgtaatgttacaatattacttttactgtataagtttaatgctttataaaactagatggcagcttctaagttgtggcttgtgtcggaggttcaagctgtcctccaagttcagcgcagcgattatttgcaaattatctacgtaaggactatataaacgtttcgatgccctctcttcacatcttttgtgtcgaacctcgaacatcgagcatgcattgtccatttttgagccagtttctgcttattctcgtatttcaacaataatgttgttgcataatgtacgcacactttgtgcggcattttatagcttacagatacagatgaatttacgagctgtataaaagaactacaaggaagttgtaactgcaaaaaaatgtcaccgggacgatatcatcacaaatatggagggccgcaaaagtgaagatgaaaagaacgaagccgctttagcctgtgatgtctttgaatcctccaatgccaaactaccaaagaatgtattcagaagttcctttacttggtattgctatgaagttatcaataggtcagcattccatatttggttattgttatgtttaacgctcattgttggttggaaggttttttcaggcatcggtggtagaagaccatctgactcaaacatggacggcccccaaaccaaacataaacggaatccaggttttttgaggcgtcattcgaccatcgttatcttagttatatctttagcagtgtctttctcatgggaagctttcaaaatgtatcgtgaacgcaccttcgggaaacaaatcactcagtttgccaaagaaattattaaaagtgcgccaagcacagatatggaaagctgggaccgtgttgcagcggattttaactcttatatgtacgaaaataaactttggaacacagaatactttttttgttgatggttctagctgccatgtagcatttaggagaacccttctatggatttcctcaagaattgacggcgactataaaatagaatattttaggaaacacccttatattgaagaagcccttaaagtatattttgcagaagtggatagaaagtggaatttaaatacttctcagcaattgttaagcaatatttcggttggaaatatcaaacttcctggtcaatcatgtcgtttcaaattatttcatattttcaagaaagtcatgaaacagcgtttttctcaagtagcaactgttatattcttcgtcatgagtatccgttctccaagaaatctcggctttttttttactcttgccctttttgtcgtacttgtttgctcccaggaatggttctcctttgaaatgaatagatcttgttcaatgaaagtggaacatagaatgcaatttttgtcaactataatcagtgaacatcagaaatcggatgtgaattgttgggaccaaatcgcaaagaagatgaatgtatacttatttgagcagaaagtttccggctcagacgtgtttttcttagatggagcagattgtgagcgctttttcgaacgtaatttcctccgttatctaccctcaagaaagtcttcccatcctgacctaccaattgctgaattgttgccgtatatcagaaaagccgacattgcctgtgctggtaagcaattgatttaactactgaagtttgcctttggtttgaaaaataattctgccagccagacatgtttttaatagcgctaacctaaataataataaacagcagtgcgtaatagacttatgatactacctgataattagtttgacgtttcacttcgcagccttttctggtctggccacaagactatatggcatcaagaaaggtgtttacgtttataacacacgtattgtacaagctttctgcgttggctttagtgtctgtagaaaattatagaaaattctaattatgttttaaggttaagtgctagtggtgctcaaaataaaaaactgtttagtaactgctcgtgtaaaatggaagtactccaaaagtcccttttcttactgaattgcgccgattttaaccttttaattcggatgttttatgtttttttttctacaattgcacccgtttagtccaaggcatattacatttcgatctgagtttaatgaataggaagaatttattacatagcataccagtcccttttaatggcaccatattttgtgcatatgtgatacattggtaggccacagtgcagatcacacacatcagtagcgcataattatttttttgcctgttcaatttaactctgcgcaaatagcgcatctctatacgcacatatccgatttcagcacgaactatactgcgggaactgtaaaactaaaagacatggtaataattttcatgtttttcaatcccttacaatggacaatctagccaatgtccgaatctgtaaaagcggtagatgaagagattacgaagacaggcaagtgaaagattaagataacttgctacaacatatgaaaaggcttactttaggcttcaggcaccctatagaggccaaccacttaataaattcttggcgtagtgcaatcaagcagtgaacagaaacaaatcacatgtttccttggcagaatgctcatataaatgatgacgtaatttttacaagaatgccatatattaactttttagggccaaattaagattgagttgaaatattcatttttacactactaatctttttgaatgcgcgcagttttctaagtatcaagctctctgcaatcttgtatgaaagatgcagctaggcacataggaaatgagaaatcatagttatttttatttttatttctctccgtaaatatgcacttcatacaaacaaggaaaaaatatgatcaaagaaaggcaaaaatagtaagttcaggcaatatagagaaaataatttatttctacaagtagaggggcgcagtagaatgcatttgtatagcatagccaagtcaacaacaatactgcgttttctaaggcatattttattgccatttttgcatctctctattcattttactagttgcttgtgcagaataatctatgttggctggaaaagtttttggaaacatttttttttttgcgggcataaaataaaaactccgctgttcatcgcttcctacgcaatgttcttagccaagcaaaaaattatagttacaatgtttgaggtttcttccgttctagagaaactgccgcagaatattttactgtttcactaccctcttccttccaaaatgggaaataatttattaatgtcgttcttaacacaaagatcgatcgatgaaaaggaaattgatgcattattacatcctaatgcggtctatcgtttctgcaatatgagaaccacattcagaacattatcctcatatggcaaataaacgagatatcaagataccggacccccttttttacagtagataaaccggagaataccagagtattttccaaatatagaaagaaaagggttatttctaattctcgctctctgtttttggaagacgaagttattaagtttttgcctgcatttggaaacctgctgcgatttcctcgatattgaaaaaaagtaaaggccacaagaaaaaaattttatagttgccttgggatgacaaacagctggatattattattattggcagtagccctagtatgttgtaaaagagttatttacaagattttctttttacgagggcacgttataacgttggactcaaggggaaagtttctaaaggcacaaataaacattatgggcttatggaaaaggtgccagtgacgtgatggttacgcctcgccattcatgttaaacgatgtaaattacttctattacaggatattttcttgccttcgtttagcgtattatcagcccttttctctgttttacaaataaggaaagcgcgacgtcagccaatgtgaataccgtttatggttcaaccttgtctacatttagctacttttttttctttttcgaaagcattgatgcgtttgctcggtgattacatcataattagtgaacacacgcagcaaaccgtgatcactgcgagtattctactcttgtcatcccagactacaagtaaatcatactatctctttacaagctgaatggaatgggcttagccgactggaaggataggcttgccaaggaaaaacaaagaaaaaaaggcgagtggatttaagattcagcgaccgcctgtcttcccttcctttttcaccatagttgacataacactttatcttgtctttatatctcttctcgaagcacttatgataaccgacttcaaagtcaaggtacataattattcaacgcctctaatttttcacttgttatgaagcaagtgctgagacaactggccaatcgatgttataaacaggcagaacaaaagaagtaaagatattactctgttacgtaatattaagtagtgccgcactatacatgtagatatgcatatactgttatggtaaaaggaatatgcaaagaactagacatttctgatcttttcttttcttggttatgatcattagaatggtagagtcttgtagagaggaaaaagtaggaggtgacaccgtatattttgggcaatatagtcatggaaagtgatatcaagcaatcatgcaacgtaaacatcaacttattcccgtttaaaagtgaattttgatggaagtttttcaaaccaatccaaaattggatcattgtctttcgtgtcgacatattcgccatcctcgatgtattccacagcaacagtatcagtcaatttaggatcccttagacataaggagaatgcaattaatggaacacaaaatactaaagccacgatagtttccaatctttgaacgtatttgtaagcgttcattaaggcattcctttgtggggtaccccaagtataggtttcaatgaaagtatatggagattcgtaggcagttgtggctagagcaacatcacccattctcttcaaaatttgtttgtacaaagtctgagtccaaatggcaccggaaactgcggaaccgacagcagaaccaattctatagagggtatagtttaaagctgtaactgtcgccatgttttcatgagagacggcagattgtacagagacggtaactgggtaagtgaacaaagtagtgcccacaccccagacacataatgcaccaataatacctgaatgggactgacttccacctctaaagtggtacaataaacccatagccaccatccatagcgcgcatccaaacattatgaatggtttcaatctcgtacatcttgttacaagtaaagcgaaaaatggagaggccacagtagagacaaatgaagataatgtggcaattctggttgcagatttaacggattcattgacggcaacaatcataaccgtgtacaaataatcagcggccatatagtaaataaaatcaatcaggaaagaaatacccatagaagaccatacagccctatctttgaccagcctatatggaagaattggatctctagcgaatcgatattcccaaatccataagatagggatcaaaacaaagccaagaacaaaggggccgatcaatcttgaatcattccaggtagttttgaccccaccagccaaggtcagtgggaccaagatacaacctagggaacaacccatcaaaaggacaccaacgacatctaacatccaaaataattgctttaagatcttaataaaaccatgttcttgataataggacttctggcccttcaaagcgtgccattcaggagtctttctggccctccattgcatgtgcaacatacacaaaacgattggaacacatgataggggaaagatgaaagcccacatacctacatcccaagaccagttgacaacaggattggctctggaagtgatattaccagcaatccatgtgttgatgataaaaggccaagtcgggacaaattgatacagcagtctccactttaaagatgaaaaatcggataggataatcaaaagaataaggattacacccacatagccagcattgtagaaaatggcacctgcagcgtatctttgaacatcataagcttgtgattgaataattgtacccacaacatataggatgacagcactaatgaaaaggtatagtctaccaaacacatcagacaacctagcgtatatgatttgcgaagcggcactgaccacagcattaatgacgttgattgtagacagcagagaatgctcactataggatgatgtggcgtaaccagtgtaaatataacggatgttaccgtccagtccataaccgtagccacatatgaaagcactcaaaagtaaaatcgcttgtaagtaccatttattgtaagcagagccaatgatttcagtctgctggataattaggctcctgttctgtctcaaggcattgtatttttcagataactgagggagaccatatgagtcggagttggaatcgttatgagtctcaggattcaactcgtgttccattcccatgaagacatgtttcttttcctccttaacaggatcgcgagagtgaacagactccattagtacgttgctatgcagtggcttgaactactgtccatatatttttaagaaagaaaacaagagatatagtgaacgaaagcaaaaagagagctatcgaatgtttcctcccctatatacaattattcctgaaatcttcagttctatgcatcttgcattacttcatgtaaactgtactccgatttgcttggcctttttttctctttgacactattttcctaacgatatgtgcttgttatatcacacctgcttttatgggtgcattttgataaatttgcaatcccaaacaggaaagaagtgaaaaaggccaagacatatgtggctttctaacaaatacaggcacacaaatttcgtaagagaacaagtcctaaagatgaacgttaatgataatatacaattgtcttctcatttctgttgatggattttcattcgcaggtgtatttttccatcgcttcgtgatagagctgccagtacgcttcatcgcggtcgcttacatgcgtgatatttaggggatctttcattggcttccgatcagataatatgtatcattagtcagcggaagttacaggtggaaaccctccccaccttgatagttgtcttgattgtataggcctgtaatctattactattattctattggagtcctgctcgttgttcgttcaaggcgaatgtgcctgcgatgagttgactatgaaaaagaaaatttttcaacttgaacttgaccattccaacaaagaagaaatgatggaagtaaaaaagactaaggaatcaagcttggtgaagctacctcgtcatttaattaacgaacttctgcatgatcacccaaactgagctagataactgcttacaatgggctcaaaataatggagccttcatcgatccgaaaatctcttttaggattacagaggatgctggtgttagtgcatttgtaaacgaaaaattctctcccaaacccgaccaagctttgattagggtacccgaaactctgctgatcacttcccagcaagctttatcagaattttcccaggctgctaatgaaaggagtcttttgaattccgtgacacagttgtacttgtcaaagttgaaatttggcaccgatgcagttcacctgaaatccttttacaaaccatatttagatgtgctacccttgcaccttccacaaccatatttttggtctactgatgaagtcatgaatttgcatggtacagacgtgtacttaactatgagagatacgctgaacaaactagtaaaggagtggaggatgctgttccaagctttatctattgaacactcttctcaagataagcagttcttgtctttattccaggagaataaagactctgccgtagtgccgttggaacagttctgcgcacacatcaatggatgtaaactagaagattcggaatggaactcgttcgtggcgtatctttggtcgtactgcatctttaattctagggcatttcctcgtgtcattttaggcagggccggtacagaccgcaccaatctgaacgaaggatttttgtatccaatagtagatttattaaaccataaaaacgatgtaccagtaagatgggagatgaatgaacaaaatgaactttgtttcatgtcgcagactaccacatttagtgcacaggatgaattgtttaataattatggtaatatttctaatgaaaaatgtttgttaaactacgggttttgggattcctcgaataagtttgacttctctaggttgactttaaagctaccatccaccttagttagcggtttgcccgtggattttaacaaatcaggtaattttgttactgacgatggagaaactaccattttacaatttagtttaaaaatttctgaaccattaccaccggttctactagcgttatttgcctacctaagtaaattaaagtctgaagaaactccaaccgtaaggagcgtattggaaggtattgatcaattaacatctgtagtatcccagagattgctgttttataagaattttaaaattaaaacttcttcgactcaaaaattacgccctcatgttattaaactaatcaaactatactatcaagataacaaaaaaattctgaacgccactactgagaaattgtccgttttacaaaaaaaaatatatagcaataataaggagttttctctgtcattcaagacaatttttaaaaacgacaaaatatttgccaattctctcttactggtatttggtgctataaattacgaagatttgatcacaaaagactgtcttaatgacgcattgttgctctggatagtcaaattaatcaacgataaaagtaataatcagggaggtttcattaaacaaaccttcaaagaagttagtgattcaattgtcattgaaaaagaagatgttatggagtttttgccgttctataaaaaatacttccctaatttatcggagagaattccagaaatttatagtgtcggtgattggggcataagacagttcattgtggcagatactgcgattgatagattggtttggatcaggaaatcaaataaagagcctatatttctaatgaagaaggcatacgacttacagatttagctttgatctgtagcctaagtataaaattctacgtatgtatatatttacatgcaattttttctttttccaattcatgttaatgttcttcatcatttgataataggccaatgatattatctactatcttctccttttgaggagaagctgctttcacttcctcgttgcttttctcttcgtataaatacatgaatttcgacttgtccagcatttttttatcaatacaatgcatgtgcccatgaagttctacctccgacaaatctttaacaaaatatgtcgttatttgtgtcatgaatttcagtagggtttgaaatatttcgggtatggcgttcttcttatccagaataacaattttgtagtttgctgataatgttattggacgaagctggatgggcctatttacgcggaacttttcgccatatatttcctgttcgaagtataaaagttggttggccaatttctttaatccgtttgcagattgtagcgattgttcattcgcaaaaccaggttctattgttgcatttattgactcagtgaaacccaccaactccattaaagttggtcttaaatcatcttgcataaacttgtacaagtttggctggaaaattctaatcattttcgattttgtcagcacggtttgcaaaattaatgtgatgtgttcaaatcttgataaagtcgtttcatcattttggaaaatagagaattggttccatttcatttctgaaattaccagtgcggaatatgtttgtaggtcatgaagaaaagagtcgtattttgtcttgtagttgatcagagaagcttggtccgtgggtattttcatggactcggtctcttgatattgcttccatatatatgagtcccaaacattccaactaaattgaaaggaaggcgcattatcgttaccagagaaggaacggatgcttttcttgttacgttgtaaaatggtgaatatattgtagagaatgaaatttttgcaaaattcagccctcaattgccggatggagaagtcgtttgataatattgtagctcttaaaatgtctccagggcacgttctgtctttgtttgattgtttgctccacaatgtcttatggctaaccgatctttctaaaagttgcttcaaagtgacgacattaccaccagcgattcgagttgtggcactgtttgcatccagatagaatggtttaccctcttcgttcgccagtatccgaccagcgttagccttctcaatgcgctttcgttcattcaaggtgcaaagtggcgaagctatcttggtcttcaatttgtctacctcagtaacgaaaaattctctatgtttatctacaaagtaagggaaaataccaattccatcgaattccccaatcatcgcctcatcggaaacctggaaaagaggcaagggctttgcattagctgggtttacaaacatgggtacctcaccattattttgttccaagagtctatcgtaagtgctcttcttaaccccgattccccgacaaaagtttgaaaatatcgacttaggccaaattacacgctgcagtttcaacttatcatctttgcatcgtacccttattaattgttgccactcgaaagatggcttgaagtcctcatccatttcgctgaacaacttctcgtagagacttaaggggtggtcaaacataggcgcaatccgttcccagtgttggatcctcttcttcgaggatttttgagttagatctgttctaacaatcttgaatgcgtgttcgcgaggggcgtttatatcacgtaatagcagtttttgcaagtccgtgagtgaaatattatacagtactccttcaagatcacaatattcataagataagtttgtcttcttaaacgcttgcttacagcgagggaacacctgatgtgtgatattctccatgttgaacttatacctgtaacgagaggaactgccctgtctcctcaatgagaccatgaacaatgtttgccaattcaccattttggtcactctgtctcaaacctttccttcagcgcagccttactccttcaagagaagccttcattgtccattcacttaagcataatttgtcatcttcaatgcaattgaactttcactaaatacacccatacacaccaatcttggattctactcggcggcaatcttcactctttcctttgttttatcattttctattccacctttagttccccaacttcacctcttatcgaactatcaacacatttgactatcattttggcaaattcactcacgtgagggcgtgtgctaaccatgcaagggttatgggcatgcgcatccatgtggcgtttcctacttttatttttacataatatataagataattgcacatgcaaacagtcaatctttttcctgcaattgatgtggagaccaaaaggtttgcatctcctagtaccacgattttttggtgcaaaagtgttgataatgtaattcaggtagaaaaggtagaagtttcctctagtatgttcacagattggattagaaaaaaagatcacgcgactcttgccggaaaaaactgtggcgtcgctgcatatatatgacaaatcaatcatatagattagaggcctgcctgagtcaaggggcaaaaacaatacacatataaagacctggatgcttatcgatgatctgtacattctgtttgtagtctaagttgctgagggcaacgtagacgtacagtgctcaaaataagtaaaaatggaaccgctgctttttaatagtgggaaagcaaatccctctcaagatgttttcatagatgtggaagttggtgatattaccacaaaatatggttccacaaatactggatcattcagttcgatggatactgtggaagcgcaggcgataaaggcagagacggcaagattcatggaagttccacagggaagacatttaggtgtgttctccacggttgtgttatttgtttcgaggataatggggtcaggtatatttgcagtacccagtgtgattttactgaatacaggtggtaataagctgatatattttgcgatctgggtttttagcgctgcgatcgcttttgcaggattgtatctttttctagaatttggttcctggataccgaaatcaggtggacgtaaaaacttcctcgaacggagttttgaaagacccagactattaattagtgtggtgttttcgtgttacagtgttttaactggctatgcattgacgggatctatcgtcttcggtaaatacgtgttgagcgcatttggagtcacggatgattcgtggtccaagtacgtcagcatatcatttataatatttgccgttctcattcacggtgtctctgtaaggcacggagtgtttatacagaacgcacttggtggtttgaagttgatcatgattgtcttgatgtgctttgccgggctatacacgcttttcttttataaaagcaccggtcaagttgcctgggacctcccagtaacccaagttgagaaagattctctcctgtcggtgtcctctattgctactgcctttatcagctcattcttttgtttttctggatgggatacagttcacacagttacatcagaaattaagaatcccgttaagacgttgaaggtgtcaggtcccttatcgttgataatttgttttgtctgctacacaatgatgaatgtggcatacttgaaagttttgacatatgaggaaattgttagtgcaggccccctggttggttccgtgttgtttaccaaacttttcggacccagagttggtggcaaattcattgctttttctatcgccatttctgcagcatctaatattctggttgtcatttacagtatatcaagagttaaccaggaaatattcaaagaaggttatttaccattcagtattcatatgtccaaaaattggccatttgatgcacctctaccatctatttctttatgtggctttataaccattgcttggatattgattttacccaaagagggcgaatccttcaattatctggtatcgatggatggttatggtaatcagtttttcttattattggtcgctattgggctctttatttggaggttcaaacacaagaacgaagtcccagagattcgtgcatctacttttggagtattagccattattacattatcattatacatgttgatggcaccattctttgccgaccctagcctaaacagagttgggttcctgccgccctaccaaatcatgtcattactggtaatagttgcatgcttctttttctggttagttaaattcgttttactacctaaattcttccattataaacttttacccaaaatcacttatttgcatgatgggctcattgtcacagaatgggtgaaaaagccatgtctgtgttagtttttccttttctacataaatattttatagactactattgcatttttaataaataatattcatcctcatctttgaataaaagaaagaaacattcgattatttcatcatcttacttgattgcttggctatttgcttcaaaagctctaggcccccactgtcacgacacatactataaaatataccgcgttcatctttcaacagttcactagggcgatcatattcttttacctcaccggcatccatcacaattatcctgtcgtaatcgataacagatctcaaacgatgtgcaatagtaagaattgtgcttttattaaactcacttcttataataccctgaattaaatggtcagaatcgtaatcaatagaggaagtagcctcgtccaaaagtattatctttggctcgcgtaacaatgatcgtgcaataaaaagcaattgcctttcaccttgggacagatttaagccgccctcagctatttctgtgtgaagatttaaaaatttattatgagtgctgttaaagcgttcctccgagttaagcacttcttcaaattcatgtgaagaaattagatttacttgtgaaagtgctttgaatatttttttttcatcatattcatcatatggatcaacattacttttgattgtacctgcaaatagaatagggtcctgagggatgatagtaatggaacgacgtaatgtaacgagatcaattttacttatatcctgcccatctattttgatacatccggttattggttctagtaatctgaataatgccgttattatggtagatttgcctgcgccagttcttccgacaatcccaatcttactttgaggatccactttgaaactaacatttcttatgacaggaggcaaatttggcgcgtaacgtaaagataagttttcaatttcaatttctccatcttttggccacgatggttcgtttagaagtagaatgcggccttcatcatggccaagatagttctcttgttcaatgctagaatattcttttagtctttcaacagagttcatgttcatttcaaatgttgagtacagtctaactaaccataaagcaccatctgtaaacaaaatggcatatgtcaaagaaatgccggcaagacccgagtcaatatttgcaatattgagcagaataaaagaacctgatgctaaaacaatgaatgcgccaatcatgtcgactctaaaagaaaaccatttgacagtaactgataaataaaagaatgctctgttattttggtcaattttgttcatattttctaaaatgaatctcctctcgtcgccaaatgcacgaattgtgcaaacgcctaccaaggtctctgagaaatgttgaaaaatgggtgatttggttattgaatctaaccttttcaattctctacttgccgttaagtaccatttccccacaaagaaatataaaacaaaaacgataacggcgactgtcaaaaagcgaggagttattacggtaatgagaaatataattgatgcgcattgaattaggcaaaatatagttacttctaagtatggaatcaattcttgatcaacaccttcgatgtcctttgaaaagcgattcatgattctaccaaccggcgtcacgtcgaaaaatcgtatttgggcatgtagaactagatctagcagattattaaagatctttctggaggctcgcataccggataaaaacgtcatcattgttttaaaaccacctagcattgcctgaatgataccaataagaaaatatacggttaagtaataaaatgcattatgtttatttttcgaagagtcggtcatcccttttaatggcagcgtgtccatcgcaaaacctggagcatttattcgtacattggtatcgttgacccaatgtcgtatccaccaagactgactgatgaacaaaatttgagctgtgatataaagagcgaacagggctgttaaagctttgaagcctccaaaaaatttcaggtaccatttataaacatcggggcttatggcaccgtttgatttttcttcctcttctattagctggccatcattgacaaaatttgcatcaaaatttatgttctcggtgacaggttcgattttctgagagtcattttttctgggagcttttaatctattagcgttcttttcattaatgctatctcgagaagaaagttgaacatatttttccttaaaaagccctttgctttgtaattctgtaatagttccttgattcttcactttgccattttccaacacaatcgcgaaatgggcatttctaagtgttaatgaaacattgtgcgtaactaaaatgcaggttctatttttcattagtggacctgtgatgcaattttcatagatccatacagcagtatgtgaatcgacagcgctcaaacaatcatctagtaagacatgcttagcactcgaataaacagctctcgccaaggaaattctctgtttctgccctcctgataaagttatacccttttcaccaatttctgttaggtcacctgctggtaaaatctccaggtctcttttcagcccacatgcatcaattactttgttgtacctatcctcgttatagaagttatcaaagataatattgttttttaccgtgtcatttaatagccacgcactttgtgaacaatatgcgaaggaattggttaaaccttcgcagtcgggaattaaatcatgctttggttctaagctcggaacaatgatagagccactaattagatttagttcacccagtaaacccagcagcaatgcacttttaccagatcctgtagaacccaaaatcaaatttaacttaccaatttgaaatttaatattcaaaccacataatttgaatgcattcatatcgctgtcattttcattccaggttaaagtcgcatttttaaattcaattttatttttgtctggagatatggttagttgattatatttttctgtatcgtccatccttaaaaaatcgcttattctttttagagagacttttgattgatttatgaaacttagcatatttgataattgatccaggggtgtctttaacaaagtgaagagtgacaaagtagtgaaagcaagcggggcattcaaatcttcatgttgaacaaatgtacagatggcgaaagtgacacctgtcaccaaggtcggtgtcacgaaccaaagaaaagaagttacggaccacaccaaagatttttttaataaggatcttaattccttttgccttattgatttgatttcatttataatattcctttcccaagcaaaatatttgacaattcttatgttctgtaagcactcgttcaattttgagattctttggtcagtacatttcagtgtttgcttttgaaacttacctaacaaattcgctaacaagaaattcaatgggaacatcactaagataattgaaattcctgcaaaagctgaaacacctaaaaagttgaaaagtagtcctacaacaactattatcataattactgcctgaactgtcacataaaggtagtttgctagttccgataccttaaatgagtcaatagaaatgagattaattatggtaccaaggtttgcggagatactatctgaatcagagctggtttttggagatgtaaacagcctcctacgtaagccttttgcataaatttctcctatgagtatggctcttattcttaaacaaatcttatcagaaacaaattgaccttgggaattacaaattgctaatgtcaatctacaaatgaacataccaataatataaagccacgccaaattcatgcatgatgaggaacggtttgggttatccacaatttctaaaaatcttttcattaaaattgtgggaagaaggtttacaatactgttcaccagaacccataacattcctatgagtaaatatgttttgaaagattcaaacagtgctagcgtcaaattattaatgtgcttgtttctcctggtaaacccttttagaatgaaaatgctatagtcttccattgataagccccaaatatcctttaacttaatagtgttcttttgggcctcccatataaaattggtaatccagctccaagtaatgcaacttaaaattgaggatatgtgttccctcgaaggagacgtatggtcgtctctaacgtagatgatggatgagttgtctttaatcggtgaagtgagctttattggctgtaaggttgaagtaattacgaattcaaagatgtaaaatatctgtgagggtacatcatcgatattaccaatatagaccgaacgaattggaatccaggttgaaatccaaatagttgtatgggcagtaaaacagatggcccaaagattcgttgaacgcttgtaaactcttaagatacttagggaaagtagtattaaccaaaataatagtaaagttgtaacatctctgttcgttaattcaatattgatttttgttactcttaaaaaggaaaggccaattatttgtaaagacattaatacaatttcagatgattttcttaagtggtcactagtagacggtctactaaacgttagtccaccatgatttttagcatcgatttgcttgacatctatagttgttatatcaaaatgtctaagtttcaaaatccttccttgctttttgacgttgacgtaattggcttgggtatttgagttccgtagaagtctttctatactattatcttcttttctctcttcttgtgcgccaaatagatattcgttcactaaatcgcactcggcagatcttacataacgagataatccactgcgacaaagtgcgaaaatgccaattgaggctatgatagccaatggtaaatagtagctcaatagctgagttcttcctaaacgagtaaaatcatcaacttcccaaaatgaaccattatttcggataataaggggatccgttcccattctccgaggtagtgaaccattgaggttgcagcatgaataagatataggtgagagctagcgatttgacatttagtacatagatatttatatatatatataagggagtttttttttattttttttttcaaaatacgaaaatagcagttcacgaggcactcacttactggtttttaaaagtgcacccctttcgaaacgttatgatgcaatccttcgtagtgctaaagcaaatcatgtcgaagaagttaaagtagtgtcattgcaaaaaactatacggggaagtgtttgaaaataaaacaggggcgtctcatttttacatatcatatataggtatacacgcatatataaatacacatatttcttttgcagggaaggtgaacaaaaatacaaaactctagcaaaaactcaagttagaaatagggatgtgggtaagaagtaattattcttgcttttcttcagaaccagtttcttgctcaatttcttcttcatcattttctggtctaataacagcaacatctacagttaactccctgtcaccgaaaaccttgcctttaaattcttcagctttagcttcaatatcaacgttttcaccactgaaagtgacaaatgccatacctctattagcagaatcggatgtgaagatcctaccagtgtgttggtctctcatttttctcattggcaaagagatggagtcggcgtcagtaccgaaaaattcagcgacctcctctttggtagctttgaatgggacgttattaatatataaggtatcctttgatctttccatttggtctaatggaatcttttcccttttttgtccattgaaaccacctctggcgccgcctctacctctgaagttccctctgcctctgaaacctcctctgtagccgcctctgaaacctcctctaaaacctcctctgcctctgaaaccgcctctgcctctgaaacctcctctttgcatttggcctggagttctagctctcttaatatgaatttctctgtccttaacgactttcgtgtcataattctccttgatattatcaaaatcaatcttggttgggaacttgactagagcgtgtttactagctggaatgtgaccgtcggtgtgttccttaattgggatctctacgctgacttcatccccgaattcctccacaaacaattgcttcaagtcgtcttcggtacattcgtgagcaacattaccaataaagattgtgtcctcggggtcaattactgtcttatgagtaggagcccttggttgctgttcggagtcgttgatgctcaagttgtttacggcattagtagcttcttcaatttcagcagacatatttttcttcgtttgagggttttcttctttcttttgggggaaacttcttctctcgatgtagtgataactcagtaacttcctttaaatttgcagaatgattattttgagtccaattgcgtatcctttatgccacaacctgtgacactcagggtggctaaattagaaaaattttattctgcttttcgactagttttgccccttccctttggcgacgcgtcacctgggacgggaatttaaagataataaagaggcaattcatacaaattttaaaatatttagcggcagtagtgacccaaaaaatagtgtactatcatattttcactaccataattggctgcaaaatagttactagtacaggtcaaaacgagcagggcctttttaggagaaattgtatatacttttcaatattttccgctcgatgataaaattggtaaattgtagatctaataacttaattgcagagaaatttatgtatttgagatccctagatagtgcctacattgccttagccttaattttaaatataaagttccccatacaaaatgcaagtgtacagcgcggccacctgcagaagtagcatggtgactcttagtgtgcggcctcgaagtctttcataactgtaacggacgtctactgacgacatttcaaatgacattacatttattcttgactcgaccaatgatcgtggagtttcaaacatcgttaaacacgccatatcagactaactggacgctggcttcaagattgccagctgcacgggtagcgcaagtgagaatatgaatttgaacttcttcccagcatcaatccgatatggcaatacttatttacaacggtgactacttctgtaactttgtctcgaaaccacggctttcactcacttcaatggcacaatcatatcgcttttggatgttaatgaccttctgacctaataatcttggatgcgatcaacatagcttaggtaatccaaaactactaaggcatgcaaaattattgtgatattcaaaataagtcgatatgattttcctataatgaggtacttcccatggtccaagtatcaaagcttcaacaaagcaatcaccttaaaaggttatttaaggtcattattatattaaaacgtttgaaaattaatattattattaaaaaataaattttttatgcaaaatttctcattttcaatttaagcggagtcggagttcttagctctcttgtccatcttggcttgagccttgttaccaaggataccaccaccccagtgcttcttgacttcatcgtatttgtcagcgaagttagcgtcaatggtagaaaccaacttagccaaagcagcttcgtcttcggctctgacttcagtcaaagcggcaacggcagaggtcttttggttaaccaaggtacccaatctagccttacccttgacaatggcgtatggaacacccatcttcttacacaaagctggcaaaaagacaaccaattcaattgggtcgacatcgttagcaatcaaaaccaacttagccttcttgttttcgatcaaggcaacaacgtggttcaaaccgtacttgacagcgtatggctttggagaagcatcttgcttggacttaccttcagcaacagcggcagcttctttggtcaatctttccttcttttcagcagcagtttctggtctgtacttgttgaacaacttgaaggtttcggcagcggtgtttctgtccaaagtgtattggaattgagcaatggttggaggaaccttcaatctgatggacaagatcttcttttgtctttgcactctgacgtattctggccatttgacgtatctggacaagtttctctttggttggacagcttgaccaataccgaagttctttggagtagagtgagtcaatgggtttctagtcttgttagacttagttgacttagcaccgaatggagctggagcgactttcttacctggggccatttcgaattagttgttttgatgtgataatagagggtaagcaatgtaaactgacaactggaatagtaattgatagatacaaattcctcgcctttataaacaatttagcgtctttttttttttgcgttggtttttccaatttgtttgcgtcggttattatttttcaataaaaataaataagaaaatgagaaaaaaatgaaaaatgaaaaaaaaaaaatctgatggcctagatatgtttgggtgttttcttcataatactagtgttacagtcatttgaatagtacatgatgcaatagaaggtggagaggaatataaaattatggaaattacattgttaatagaaattatttatgttgttattggaagttttctagaacctgttcgtgttcaccttctatgtccttcagccaacctttggatctttccacggcaacttcccaatacttccaatgctttctcctttcagcatcgtcggattcacttctgaatatcttaaggtttggatgagcctctggtgatatttgttcgtttttctccattccattgtaaaagacccatttcttaacatcgtgtaggtccttccataatgggcgctcgttcacatccttgaaagccatattggctgcaatggctgcccccaatgcggtacattccgctgtcggagaccttctgactttgacacagggacctaagatatcggcttgaatttgcatgacttcattagacctcgacatcccgccatccactgccagaaccgacaggggcgacttttcatatgtgacgtcggaaatttcctctaaaaagtccctgtctttggaaccttcaccaaacgcgtcagaactcattgccttcaagatagccctggcttgaaagcaaacaccttccacggcagctctggcgatgtgggaggcagtagtgaattgagacatccccattatggtggctctggcatctgggtcccaatagggagcgaataggccactaaatgcggggacgaaaactacgccaccagaatcaggaaccgtagatgcaatcggtccgacatcctctgatttatcgatcaatcgtaaattatcacgtagccattggaccacagcaccagccacagcgacggaaccctctaatgcaaaatgtggcttgctcaattctggtttttggccaccgtactcttgcaaatgtgggaaccaaaatgctagagtcgtcagtgcgccatgttgggagatcaattttttggtccccgtattgtacagtaaaaagcaaccggtaccataagtacattttgcagcaccgggtttgtaagcgagttgccccaccatggatgcgctttggtcgcccagacagccctgtatgggcaggtttctcttgactagatctcgcagtactgtttttggcgaatcgtgtagcttttccattatccaatcaggaatgccaaagtcaccgtagtattgagatgaggacacaatttcgggcatgtgaatcaggttcttgtcaataccccaaaattccagcaactcgttgtcgtactttaaagtggagaggttcataaatccagttctggaagcgttggttacgtcagaaacgaacgccttttgtttagttaattggtaaatcagccatgtgtccacagtgccgaacatcaggtcgttctcctcatacgccttggtacacagaggctcattgtcgaggaaccagcgcagcttggaacaggagaaatacgtggagagcaatggcaatccagtcttctgtctaagctgcagttgcctatcgacgctagtgttttgccatttgtctctaacgattttgatcgttctggtgtcgttccaaacaataccgtagttaacaattggttttcctgtgcggcgggaccacagaattgtggtttctctcatgtttgctatacccatgcatattaccttgtaaggtgggagaccgtttgctacacgttcgctgttgatagtctgcagagagagcaaacttgaggcaaggcattggacgacgttcaccagtaatttctgcggatggcactcaacccaacccggtttggggaacttcaacgtgggttcgttatggaagtccaagtccaattcctcgatttttaggaatttggtttcttgaatggcatagccttctgcagaaaagatgggctttccgctggttttgatgtcaccggcgtttggtgtttcacgagctggggctgtagagggtctccttaggccagacaccccaatcttgcccttcgatgctgaagttgaatattcaatttggtgttttgaaacgtcctggccccatctgttgaacagaatgcatctggatgaggtcgttcctacatcaatactggcgataagcgggacgtagtcacttcgtaaatcttccattattttggacatacggctctgttcttgttttaaactagtgtaaaggcgctggcttgatcggaatatgtaacgtttggagaatactacaagtcggaagagagagggaaacatataactatttgtatagttccggccacaactcaaaccacatggtatattttatatggttcgagaacaggcatccccccacattttattacaccttatccgttctaaaagtcttggctgtctttttttcctttccttttccttttttttttttcaatttttttgtcaatgcagtcagcccctcactatgctactccacaccctttaattgatggttttactccaattagaagagaagaattacgaaatggcctgtatgggtagattcttgttatgtttttacatacgttgtttaataaaagtcgttatttaccatgtgaaaaacaaaaacagtatacaaagggtggttatcgtggccaatacaaacgcgtttttcttccttctcgtgttaatcttcataataagctgattgacacctggtattctttgtaaagtttgcaacaccttgttgtttgccgtgttcagcacgttgctctgcgagtggaactgcgaccgagtctcccaggcttgggagatgagacggtcgactacgttgttggactgatcgattcgccttgtttcgttctgaatgtactcgtcagcatcccctataggagctggcgcgtccgttgtggaattagcaatatcgttcttcacgctgaataacaagtttagtctgttgcgctcttgctggatggaggacctgatattgcggaagctcttccagtggtcttgtaagatctccttgtggcggtgcagttgggaaagctttgaggcggagattgccgggttagaatcgcagatttgtgttaatgaatcgattacatcctgtctctggcctaagattccctccaactgcttgtctatcttcttttcttggccagtttgttctgaactagttgtctgcgcgaatgtggagtacttggaaagaagtgactccgtttgtgtttctagagaaatggccttgccccttatggtgacgaaagacggttgtgagctcatgtggtgtggttgcttgtctggaattgggcttttccctgtgtctagttagtttattttttccttgtctttttatctctttttttttgtttttcgttctctttattttcaacaacgcctagaaaatttggttaccaaccacactattgaacaaagataactaactgattgaacaagagtaggcgtcttacactgggtttgcaagtgtcattgacttttgttgcattgctgtgaaatgcacattcggagcagttgaaggtctcttgctgaatgctcacatattttcaaaatattgttttggctgcggagtttgtgcctgatcagtaactaccaatctcgtgagatttttcataagcatctttgaaagcttttatacttatttgatctttgtatatatcaggttttaccagtttagccgccagagttttggtatttatgtgttacccggtatatccatatgccttttcttggtggcaaaaaaaaggtacttcctgatataaagaagctggtaagctctcgataactgatctctttgtctttgtgcaggattggataatacaataattatagaaaagtttctatttcaccacgaacaacattatgtccatttcttctgacgaagcgaaagaaaaacagctcgtggagaaggcagaattgcgcctggctatcgcagattcccctcaaaagttcgaaactaatctgcagacttttttgcctccattattactaaaactcgcctctccacatgcctccgttagaacagcagtattttcagccttaaaaaacctcatttctaggataaatacgctgccccaggttcagcttcctgtgagggcgcttattgtccaagcaaaggaacccaatttagccgctcaacaagactcgaccaatgtccgcctttacagtctgctactggcgtctaaaggcatagataggctttccttgcaagatagacagcagttgctaccgttagtcgtttcgaacatctcgtgtctaacaggcacagtagccgccagaatgttccacatccttttgaagcttattttggaatgggttgcaccccaggagtcttcacatgagcaggaagaatttgttcagttccttcaactggacaacgacggtttttcgtttttgatgcgccaatttaccaggttttttctgctggtaccttcaaagcaagtccaggtttctcaacagcccctgtcgagaggttacacatgtccgggcctatctctaactgatgtggcattctttacttatgatgcgggcgttactttcaacaaagaacagctgaataagttcaaaaaggctatttttcaatttgtttgccgtggcatggcggctacccaaactattgagcagtcacctaggatgattgaactgatggaatttttgtgcgttgtctctacggattctacaaatttatctgatgatgcggctcagttcatgaaacggtttcccatgccttatgaaaacgaagagttcatcacctttcttcagacgctgtacatcggcaacacagcaaatggaagaccgccggtcaaggctatcttgcaagaaaaaatcctgtccatattaaacagaagtcacttcgccaccaccaaagcagaatgtatttcgttgatttgctctattggattgcattcatctgagtataaacttagatctttgactctttcttttattcgacacgtagcaaaattaaattacaaaaatttaaatcctgcttcttcatcaccttcatcaacagacttttccacttgtattgtttccttgattagaaataatcttcatgccgaaggttggccgaagttacaattggggcctcagaccccagctttcaatacagccattctgcagagacagctgcaatatgaaacattgggtgatatcttgaaaagagattttgagcttgtaagtgacttatcctatattgaatttctattcgagtccttgaaaaatgacttaccacagttccgctccagtattcaggagtctctgctttctctagtaggccatttatcaattctaccccaacaatctaaattaaaattaaaaaatttgctcaggaaaaacctgtcaattgacgagcaacagcgggaggataataatgatgctgttaattctataatggcactcaaatttgtatctataaaattcactaacgctgccttccccttccatgatcctgaggcaaggttattcaatatttggggtactgtacgaacgaatagatttgacattattgaagaatcctttaaggggcttcaacccttttggttcagggttaataatgcttccataaatacatcagctaccgtgaaaacatccgatctgttgggctctcacttgtcagagactgaatttcctccattccgggaatttcttcaggttttgatcgaccagctagattcggaagctgcatcaattacacgaaaatcactgaacaacgctgtcagatttagtaaacaatgtctcatttccaatgcaatatacggtaaaaaaacaatggttatacaagatgaggattggtcagttagaatagacaaagctttggaacttgacgacacagttgtgtcccgagttaatgaaatggttcaaggcatgaatgatgatattttcattcgctatttgactcttctgtcaaacgagtttacagctacgaacagtaagggtgaacaaattgcaatatttccatatcaagatccaatttttggttctgtcttattaactttattgaattttgtgagcaataatgttttacggagattggaaattcttgttcccgatttataccatctagttatcatgaaatttcaatcgttgagtgataatgatcttgcagtctgtgcaaccatcatcggtataatttctactgctatcgcagactcgactcacgttaagcgaatcacaaaaatagcacaatcacaaacaatggcagagacatatgttgcatcttatgttgttccacgattatatttgaaagatcaaacaaatcacattgaatctgacagtatcctaaacctattaaacattttaacaactcatctatcgcatcctggcactaacaaggatatgatattaaagttggtctgccaagtgacaaaattcggtttacttctccaagtaagtgcacaagaaaggaaagatttcttgaaaaaagtcatggatactatacaagacaaattgatcaacgatgtgacagcaattcaaacgtggtcatacctatcactatattcaacagatttagagaattccagtctttttcaagaaaaattacttgaaactaacgtttctaagcaaaacgatttcttattttcagttggtgaatctttaagtgttgtggctggtaaatggtcaagtaagtacttgatcaaacagattgatattcctaatttcaatgttgagatcatgcaacaaaaattccctgctacaaatgttaccactatacttgatgagatcttttcaggttgcgactctacaaaaccctctctgaggaaggcatcttgtatttggctgttatcatatattcagtacttaggtcatttgccagaagtaagttccaaatgtaatgatattcacttgagatttatgagatttttggcagacagagatgaatttatacaggattccgccgctagagggctttctttggtttacgaaattggtggttctgatttaaaagaaagtatggtcaaagggctacttaaatcatttacagaatcaaccgcagggtctgcatctacaagtgctactggcatctcaggttcagtctccgaagagaccgagttatttgagccaggagttttaaacactggagatgggtccattagcacttacaaagatattttgaatttggcatctgaagttggggaccccgcacttgtttacaaatttatgtctcttgccaaaagttctgcgctatggtcatctaggaaaggtatcgcattcggtcttggcgccattatgtctaaatcttctttagaagaattattactaaaggatcagcaaactgccaagaaattaattccaaaattgtatagatacagatttgatccatttcaagcagtatcacgctcgatgacagacatctggaatactttaattccagaatcctctttgacgatttccctctatttcaatgatattcttgatgagcttttatgtggcatggctaataaagaatggagggtcagggaggccagtacttcagctttattacaattgattcaatctcaaccgcaagagaaattttccgaaaaaatgctgaaaatttggacaatggcattcagaacgatggatgatataaaagatagtgtccgtgaagttggtaccaagttcaccactgtattggccaaaattttggcaagatctattgatgtggaaaaaggtgtgaaccctaccaagtctaaggaaatactagacaatattttgccatttttatggggtccacatggtctgaacagtgatgcagaagaggttagaaattttgcgctcacaactttgattgacttggtgaaacactcccctggagccatcaaaccgttcactccaaaattaatttacgattttatcacattgttttcttccattgaacctcaggtgattaactatttggcattaaatgctgcaaattataacattgatgctaacgtcattgatacgcaaaggaaaaatggtgtcacaaattcacctctattccagaccatcgaaaaattaattaacaattcagatgattgtatgatggaagaaataattaatgtggttattaaagctagcagaaaatcagtcggattgccatctaaggtcgcatcctcacttgtcataattatcttagtgaaacggtactctatcgaaatgaaaccctattctggaaagttgttgaaagtctgcttgactatgtttgaagatagaaatgagtcggttaatatagcatttgcaatttcaatgggatatttattcaaggtttcagcgttggataagtgtattaaatactctgaaaaactaataacgaaatattttgagcctacctcaacagaaaataacaagaaagttgttggtacagcgatcgactcgattttgaattatgcgaagtcagaattcgataatgtggcaagtgtatttatgcctttgattttcatagcatgcaatgatgaagataaagatttggaaaccttatataataaaatctggacggaagcttccagctctggcgccggtacggttaaattatacctgccagaaattttaaacgtactttgtgtgaatataaagtcaaatgatttctctattcgaaaaacatgtgctaaatcagtcatacagttgtgtggcggtattaatgatagtattccttatccacaaattgttaagttatttgatatatcgagggaggcattaagtggtagatcatgggatggtaaagagcatatagtggcagcattggtttcattaacagaaaaattttctcaaactgtggccgacaataatgatctacaagaatcaattaatcatgtaatgtacactgaagtttcgagaaaaagtatgaaatatgttaagaagatactaccgctttacgcgagatatatcaatgtgaatccacaagaagagacgatcaccttcttaattgaaaaagccaaagaaatgattcgattgttgggcagcgaatctgatgatagtgaaggttccattaagcagacttccgatgaatccacaataaaaagaattaagcctaacactgaaattacacaaaagtcatccaaagagaacattgagaacgaagagtatgtgatcaacttgttaaaagttagtgttgacatatgcaacaattctaaatcgaggtatccgatgaatttattggagttcattatagatgagattgcataccttttccataatgacagaattatacacacatggagaacgcaactagctgctagtgaaattggtatctcgatagttggaagatttagtaccataagtagcgctgactttatccaaaatgtggggagactatgggatcaaacttttccaataaattgtaacaaggaaaccattgagaatgtgaaattgcagatgataaagttcggtggcctgatcattcagaagattccaagcttgcagaacaatatcgaggaaaacttacggttgttgaacagtattgattcaacgagcagaattgagttggaattgaaaaatattggtctatgaactccgaaactttttcatattgataaatagaacagttaataaaacttatctagaaagacgtttgtttataaaataatgtatagtatcggtactaaatattaacttttccgaaaaatcaaaacatcaaagtattcaaaaagtgcttgaagaatattgattagagataaaaattcgtatgcaaggtgttaaaaattgtgtagaagtagtatataattctaaaggaaataatttcaacttttcaaagagagctttcctctaactctctccatagccatttcctccaaatatccccagccatatttaaaagatcatcaaaacaatgggaagccttagcatcattaccgacttcgattaacatgtgataattcgagatatgggcactcgaattggaactggattgtaatgacgccattgtagaagtagtcggtgaagaaggcaaactggttatgctagattctgtattctcgtataacttcctataggaagagtcatcaaattttgttagcagaggaacgttattaagaaactcagaaatttccgcttcttcaaattctaatagcttaaattcgttaaactgcaaaatcgcgatgaaaatgaaaatcaattgcatatgaggatcaatggaagaaaacggtagtttcaattctgacttatcatttgaatcactaccaggagatggtactgtgttgtccttttgagctttgctttgagtacctccgtatctattccttaaaattaattctttgaagacactataatcatagggaaattttttcgaacctagtgccatgctatccagatcggggaaccaaaacggatcattattgtacaaagcgatccaatctttcatccagtactgctcgttgtcacattgtggtgtatcgtgatagaggtgatccattttcttatcgttatagttcaaaaagaaatttatcgtgtccatgtttggtttgggcctccaaccgagcagcaaatcccatacacgccctctatcttgtctttgtaaagctttagctccagagcatttcaaccaccaatatatccaggagtttcttgacgacgaaggttgtaaggaagattcctctgtcaaaggttggtacagctctggcaaaattgaagagaataccttgaaaaaaacttgggtctgaaatgaaagatcgccaccagatataatagggaaataatttgtgttgaagtttgagtttgcctttgagctggaagatgcgttcgagtcatttttcaattgtttgtgtgccagtatggtatcagggcaatgtagaatgacaagagctagtctttcgaaaagggcactaaatgagaaaattggttttgtaggcaattttgatcgcagctcaaagggtaacggatattccttataaagatatgataacgtgtgagaaatgtacggagaattgtgcaagctggtatttgtgttgatgctcaagttgtgcatgcccgatgttatattcgtgttattgttgttggtgttgttgctagaggagttgctatttccgttattgccgttgttagtgcttagaagagcgtgctttcttccgctcagaactacataatcctccacttcgtaaaatgaatgagtctcgttgaaaggagacatggtttcgtagggatagatgggataccattcagccaatcccagagcaatccaggcaagaccgctttcgtacttgaagatttttgaccacttcagcagaaatttcacgatggcatttttcaaagtctcgatgatctggaactcatagtctaatgagggagacagtacctccatagaagaaatagtggaagcgtcggacgacgaaacaggtgtcggggtggcgatattggtggtgttagcattactcgatgagccagcaggattagacctggagtggaagtattttttcaaatcatgcaggataatggattcgatatcgtacgggagaatattttcatcgtcgctcttgtcttgcttatcggttggagccttacttttcagaaaagggtcattaagtatgaaatcattggttattgggtcccaagaaatggtattggaggtaatgtttggtgaaatgcacattgggtggtacttcagcaggatcggccacacgacgtgtcgcaactgtggtggaaccccgtatgttcttgctaaaaaggccaatgagtcatggtcattgcactttactagatggatagtcgtttcgataaggttcttgttgcgaaactgctgttttagatttttcaagtagtgggaattcgccatgggcgacttcttgtcgtgcatatttgctagcgagccctttaccctgtaacgtctctaagaaatttcgaatagtgatctacaggtacgtctgagctattatcaatttctaccaggaatttgaagctcccacagaatagcttccaagaaacctgaaaaaaaaaaaaaatgaaaaatatgtatcattcctcacgaatgagtccattgctttcccgtctcaaatgattgagaatatatcgtatgataacgtaagagtattcagtatcaacggcaacaacaacaacaacaacaacaacaacagcacaacaacagcacaacaacatcgaacggttgctactgcgacgttacggattatatccacagtatatggcgtgcagcgataaggctcgagacaccgttctgtacggacctgacgttgactgtgagacacagacggggccgcgggaacccttaatgtggttcccggaacggaatgagtacggtgaaaaagggaatcaggaggcacggtacctgcatattgcgccttttttggtttccccttcgggcagcaagtgtttactgtaggataatggtactattacggtatttccactttgggcgacgttaagatacgggcatgaattaaggtaagcaaatccttttgttgcaaacagcaaggtcgttatgtgtaaatatatatatatatgcgttctgtgctagtgtgatttgccctgcttcaggggcgggtgcagtagggagctcatgacagcaagtacattttgtttattttttaaaaggaaagaaaggctagatacctcgaattacaaaaccaaaaacgcatgcagacgtcaatggtgagcgcaaaagttagtatatggctagtatgtagcgttatatgcagtagcctggtacgggctacgcaatctgtgtgttcgtcgcaaaacacagcgaccactgacggtgtacgaaatcaatttcagagtaatggttggtgttcaaataactgtgctggtcatcagtttgccatcgtacaggggttcatgtgctggtgcagtgattcggaaccgagcactcagacatcggtgggagactgcagtggcacttgtcccggttatggctacgaagattgtggtaatgcggataaggatctttttggttatatatatctggggcaaaccccgctaagttctgtacagagtgtggaaacgtcaacagagtccagtgtgtacgtttcaagtagctctatcacgagtagtagtagtacgagtattgtggacacaaccacaatctcgccgactctgacgtcaacgagtacgaccccattgacaaccgcctcaaccagtacaacaccatcaactgatataacatcggcactgcccacgactacaagcacaaagttgtcaacatccattcccacaagcacgacatcgtcaacctctaccaccacaagtacctcatcgtcgacttctacgaccgtaagtgtcacatcatcaacatctaccaccacaagtactacgtcgtcaaccctcatttccacgagcacatcatcatcatcatcatcaactccaaccacaacatcgtcagcccccatttctacaagcacgacgtcgtcaacttccacttcaacaagtacaacatcgccaacttcttcttcagcacctacaagctcgtctaatacaacaccaacgagcacaacgttcactacgacatcacccagtacagccccttcaagcactacggttacttacaccagtaccacagcatctccaataacgtccactataacttctgtaaacctgcagacctccttaaagtattctgtgataacagtgacttcagtgcacaccatggacactaacatttcggaaatcacctcgagatatctcaccatgaaaaaagtaataacgcagatttactcttccaccctcggggctactcctacttctgcagtggctactacgtctgccagcgtaggtggtagaataacaaacaataacaatagtaacaccaccaacagcaatacaccaactaacaagtctacagaaaagaaagggtactgggattcgcccgggaaaatagccgctactttcgtcgtggttggagtggtatgtttggtaattatatgcatactaatatacttaatacatcattatagaacaagacccgctcggaaggctcaagattttgagaatgaatatcagagtaagttttaccagtccaagtacccaaatgaagttaccactaccacgttacacacgccttcaccatcttcaaattcaactttctcgaccccaagattaatatacactgatgaaaagggacaaattatgtctgaatcaccatccccacgtcaatctacgtattccttgactgcaggcagtccaccaaatgacccaagcacgttggcaagcccatttcacgatcccattcttcccagaagaacttctacttttcttcattcgcccattcaaaagcaacacgaaaaaatggaatcaaacgttactctaggtgaagacacggtactggtggatcagaggctagacccaagtaagatgcttaacactttagcaaatgacgatgccacaaaccactctaccatttcgttatcagacaacgtagactactccaggagggttctgcggctaatgaacgaataaagactgcagctcttatacgtaataaatattccacgaacgataatacatacataattttaattctgaactttgtttttttccttcgaatgttctcaaaagaatgctttacgacaataacgctgttatcttgtacatacttttctctgcccagtgacagcaggcacaataatctaaataccgcgttcgtgcgagacattctctgtgattcacagattacggcgcagaaaataaaatagccgtccagctcggagtttctaaaattacgtccgagatgacggaggcttataaaatcatttcagacgggtgagggatgccaatctacgagacaaaagataaaaaattaagactcaataatatagaaaggaactaaatgttttcataagagtcaccgtctataaccttttttttttttattggtctgttatcacttccactgagaaagtaatattgctattgcacaacactttttgaacaagtgcaaagataaaatactgaaaacggtaaagtaggtttgtttaaattgacttaagatggtgccattggaagatctgcttaataaagaaaatggcactgccgcacctcaacacagccgggagagtatagtagaaaatgggacagacgtttctaacgtcacaaagaaggacgggctgcccagtcctaacctatctaaaaggtcttctgattgttcgaagaggcctagaattaggtgtaccacggaagctattggcttgaacggtcaagaagatgaacggatgtcaccaggcagcacttcttcatcatgcttaccatatcatagtacttcacacttgaacactcctccatacgatctattgggcgcttcggcagtttcacccaccacatcatcttcctctgactcgtcctcctcctcgccattggcacaagcgcataacccggcaggtgatgacgacgatgcggataatgacggtgattctgaggatataacactatattgtaaatgggacaactgtggtatgattttcaaccaaccagagctgctatataatcatctgtgtcatgaccatgttggcaggaagtcacataagaacctacaattgaattgtcattggggagactgtaccacgaagacggagaaaagggaccatatcacctcgcatttgagagttcacgtaccattgaaaccgttcggttgctctacgtgctccaaaaagtttaaacgtccgcaagatttaaaaaagcatttgaaaattcatctggaaagtggcggtattttgaaaagaaagaggggacccaaatggggctcaaaaagaacttctaagaaaaacaaaagttgtgcaagcgacgcagtgtcgtcttgttctgcatctgtgccttccgctatagctggtagctttaagtcacattctacttctccacagatattacccccattgcccgtgggtatatctcaacatctgccttcacaacagcagcagcgggctatttccttaaaccaactatgctcagacgagctatctcagtataagccggtatattctccacaattgagtgccagattgcaaacgatcttgccgccattatactacaataacggcagcacggtaagccaaggtgccaacagtcggagcatgaatgtctacgaggacggttgttctaataagaccatagcaaacgccacccaattcttcaccaaactatcgagaaatatgacaaataactacattttgcaacaaagcggtggtagtactgagtcctcgtcatcatctgggcgcatccccgtagcacaaacaagctatgtgcagccacctaatgctccttcataccaatccgtacaaggtggtagctctatttcggccactgcaaatacagcaacttatgtgccagtacggttggccaagtatccaactggtccttcgcttactgaacatttgccacctttacattcgaacactgccggtggtgttttcaaccgccaatcacagtatgctatgccacactatccatctgttcgtgctgcgcctagctattcctccagtggctgttctatattaccgcctctacaatcaaagataccaatgttaccatcgcgccgtacaatggcaggtggaacttcattgaagcctaactgggaatttagcctgaaccaaaaaagctgtactaatgatattatcatgagtaagctggcgattgaagaagtagatgacgaaagcgagatagaggatgatttcgtagagatgttgggtatagtgaacattatcaaggactacttgttgtgctgtgtcatggaagatttagatgatgaagaaagtgaggacaaagatgaagaaaacgcattcttgcaagaatctttagaaaaattgagtttacaaaaccaaatgggaactaactcagttcgcatcttgaccaagtatcccaaaattttggtatgatatggattgtcggatattttattcttagttgtttctttgcggctgtatagtaaatgaataaatcacacatgccctagcgcggcgtcgcggattaaacaaggtaacaatggttaaaggaaaaattatttgttaaggtgggtatattatagattgctaattgtaaagtattaatagtttattaagtattaaactagagttcgcacatgcttttatttttttgttgcttttcttcacgctaccgcttcttgagactgttgtttggtagtactgatatcttgatcggttgatcccgagctgcgattacccgtggagcaaacttcttgatcctgctgtagcgtaccgtttgctaagccttcatagtaaagttcctcgtgaaactggtttctcaacacaatgacgatgatggccactggagtgcatacaaaggcaattacaacggcataaatcaacttcatgacctgcggtagtggataatcgttgaagtagtagtcgtgggacccgaccttatggcctataccagcaaggatacccatagtgactggccaaatgacaatgaacatggcaatggctaggatcatagatctgatgaatttctgcacaaaccattctataaagttcatgaatttggactgagtagaatcatgaatgaactgagatgtgagaaaacctttcaacgtagcttctttacctttgggaatgattcctctattgacctctaaatagccaaagagccaattatgcttatgatacagagtgttctgcttcgcaacgacgttgtctttggattcgaagtaatccacaatgaaacgctttttagggggtggtatttcttcgttagattcggttttcagtggtgacggtttcgtaatccatttattcaatctgaaaacaggcctcttgtagtcatcgaatccaactaaaatttcctcgctagcccatgtaagacccacctggatgaataaacttagtgcacaatcgcctgaaatggtgtgaggaaatgcccataaggtgataagatctacacgggaatggtacatggcatatgcgatggcaaactcgatgccgcccgagattattgcagaacctagcgcttggatgacgaaaaggtagaagatgatgaaccagatggaatttctgaacccggtcgggtcgctggcgctggctctgaggatttcatatatgtgaagagcgtctattttcaagggtgttgatgcatatatatccgtatatatgtgtgccggtggaaggttataacatcttgaagaaagaaagaggagaaattggttttagatcaaggacagataaactatatctttcaaaagccgatgcaaatcgtatacagcaaatatcaatgaaggaatgcgatggaggtgatgctagtgtggactgcactatttttttttcctgtttttttccacttttgtgtaggaagagtattgaatcaggaaagcgggaaaaaccgcaaagaaaaaagtaaacttatccgtgaaaatcaattacattaccgaaaatggcaagatccaaacaagaaaagtaagtaaacgaatgcgaatactggaacaagcagggcataaagaggcacatgcgtcgtttgtagccgacgtgcttcatttatcaggttagttggcagcggctggaccatacaggttctcacaatgtgttggtctacgttcggtcatgcaccacggttgttccgtcaaacggtcagaaaacacacgcggaaaatccaaaggaaaagatgggagagaaaaaacatgaagttgagaagcaacgaaacaaggtttgatccagaaaggggaggctaaaggcgaaaaaggcgaaagaaaagcgtttaagagaattttacaaacgtagtaaaataatgggtgtcatcaagaagaaaagatcgcaccatggaaaggcttcgcgccaacaatactactctggggtacaggttgggggagtaggcagcatgggcgccataaacaataacatcccgtcgttgacgagcttcgcggaggaaaacaactatcagtacggatacagcggctccagtgccggcatgaatggcagatcgcttacgtacgcgcagcaacagcttaataagcaaagacaggacttcgaacgtgtacgacttagaccagaacagctcagcaatatcatacatgacgagagcgacacgatatcgttccgatccaaccttttgaagaactttataagctcgaacgacgcatttaacatgctgagtttgaccacggtaccgtgcgacagaattgagaagtccagattgttcagtgaaaaaacaataagatatctcatgcaaaaacaacacgaaatgaaaacacaagcggcagagttgcaagaaaagcctctgacgccacttaaatacacaaaacttatagctgcggcagaggacggaagccgtagcacaaaggatatgatagatgctgtcttcgagcaagatagtcatttgaggtaccagccggacggcgtggtcgtacatcgtgacgatcctgcgctggtgggtaaactccgcggagatctccgcgaagcgccggcggactactggacgcatgcttatagggatgttttggcgcaataccacgaggccaaggagcgtatcaggcagaaggaagtaactgcaggtgaagcacaggacgaagccagcttgcagcagcaacagcagcaagatttgcagcaacagcaacaagtagtgactacagttgcctcgcaaagtcctcatgcaactgcaacggaaaaggagccagtacccgccgtggttgacgacccactggagaacatgttcggagattattccaatgagccgttcaacaccaatttcgacgatgaatttggagatcttgatgctgtatttttttaatagccatgggcggctacttcttggaaatatatactttccttttacatatttagtatagttatacatgtggatgtgtatggaggtaagatcagatagacccttcactgttttctgtgtattccttgtgacatagtggatttgtgcagctactgcttataggaagcagtgcctgcaaaacaattcattcgttggttgatgtggcgcgctgactgaatgtgtagggtctgttgttacccccttgctccgggggcccacatctctctgacgcgaagaaaggctcgagatgtgccagtcgtaaacaccgcctcatttcccttgcattctcctccagtgaaaaagcagtacgacctatctccgaaaaaaaaaaacctcctgtgcgtttactgtggatcatgcaacacgatttctgtagattaaagacgtttttggcatggactaagctaaattccgtttgattagccgcccataacgggtggcaaacaacacgatgaaactctatatccccgcttaacgtttcggcggctgtgatcaaggaaaatagtatataagttcgtcggatttcttatttgttttctctcttcctttctctctccctttctcgtgcttggttgttttccttaattagttaaaacaataaaagaacaagaaggagaaggcgattttggactagaaaatcacgaagaaaaaatatctaattgcattcctatatatatttatatacatactctctattgtttgttttttgcctgctcaagaagaaagaaagaaaaaaatattatcttttttagcttgttgaaacatgaaaaccgaaatcagcactgcggattcccttcgtgatcctccctctaatggtctaaaggccgactctgagctggttatcagagaggatatagaccaatttttgccttcggaagtatcttcgttggggtcagatcaccagaatgatggtgaggattcagacactgacagtgacaactttttgcaagaccctgaagacgatgtggatgaagaaagcactggtagaggtacagtcactaccacttccacatccactgagtcaagaggccgtccatcttcttgtatcttcgtggcaagcttagcagcagccctatccgatgacgaattatgtctgtcggtgactgaaaatttcaaaaaatacggtgatttggctagagttaaagttttgcgtgataacgcaaatagaccttatgcttttgttcaatacaacaacgatcatgatgctaaacatgctctgatccgcgctcagggtactttattaaatggcagaaggttgcgttgtgaacctgcaaaagtgaacaggacattgtacttgaaaaaccagcaaagtattgatttcaacgagatcagtcaaatttgtgaaaaatttggtggtttggaacagattgttcctgatagaactgataatcaatacacgagaagatatacttatccgatatcttcggcaaattcttggtttgttcaattcgtttacagagacgatgcaatcagagcttatgcgaatttacgaactgatcccaattggatcatcgaatgggcacaaaatataaacgtcccaaaaaattataaccttttacacaaaagcaaattcaaaagttccaaataccatcaaaacaacggtattatcaataacgatggtagtaacaacaacgataataataatagtaataataataatagagaggattcaaggaggaatggcgacgttatagaagaggagtgcggacatgtgcatggtagtgattcagaggaaaaattgacaagcgatggtatttatgacgacgaagataaagattccgagatcaccattgataaaagatccattttcgtgggtcaattagacaaagaaaccaccagagaggaattgaatagaagattttccactcatggtaaaatccaagatattaatttaatcttcaagccaacaaacatatttgcgtttattaaatatgaaaccgaagaagctgctgctgctgctttggaaagtgaaaaccatgcaatttttttgaataagacaatgcatgttcaatataaagaggtaggtggtcgtcacaacaggaagttctctggtaagaacggtggcagcaactttaaccatcatcagttttttagcaccagatcgggcaaaacatttacagggccagaactgaacttagcaccaccaccaatcaacatgtacaggaaaatgagcggcggatcccagcaggaaagcgaaactatgatgccatacatgcccatggggcccatgcccatggggcctccaccaccaaatgcagcaagtctcagtgattttgatatgttccccccaagttactccacgtttatgaagggaatgatgccattgaggcgtaaatctatgcccaattcttggtcatccccttcttcaaagagtgtgaactctgaaaatgaaagtgttaatggtggtgatgagaattccgaattgccttccgaaattcctgaatcatctggtagatataatgctgctaattcctttaccacatataataattcctcagcaggaaactctaacaacaacaacaacaacaacaacagtaacagtaataagtctcaatataaaaagcgctatgcaaggaggtcaagctacggatacaatgaagtacctccaaaaccatactatttccagccttattactatcaccccatgcaataccatatgggcccaatgggcccattgcatccttctcaaggttctgctggaaatcaccatccatatatgatggtttatcccatgtcaccacctccgccttctgggttagatggaagcatgatccctcctccaataaatgtaagccaatcacatgctgctaatcatggcagtacccatgttcatgcgaacgaattcatatcaaacgatactggtgacataaatgaagataacaaagcttatagtttagattactaaaaatgattggtcgtaaaagctgcaaaagatgtatgtaattcagcggtgatgttaactttaaaagtgcagtttcgttttctttttcgtctccctatttttttctctggatcttttttttttttttcacttggtattgttttcatccttctttccttcttttaccttctttgtctcctaatataacaatacatactttcgagttttgattacaagtcactcgaaatgtttttttccttttatatattcttccttttgtctattcttatatacacatattttaatttttggtagatttttttttttttacttacattttgttacaatagagagatttaccaatggtgtatctcgattaaatacttatctagagcattgagcaatttctttaggtcatgtctgctaatttcctctttgatgataaccaattccatggggacctttccattgaagtacttgagcaacttgttaaaaagaatctggatatctgaaggctgaccataaatacatctataaagccatcttttttcaatcgcagtggctctttcaggttccaaaattatagtatagtcatgttgcatttctggatcatcgtattcgaagtgtagtatttcttcttcatccgcaatagctatttcattgtcatcacgatcatcaacacgactatcattttcgttatctttttcgtccacatctttgttgttgtcgttggactgcatgccttcattctttcctgaacacgcttcgctggcgtttgcatctctactttgcccatcttcatcatccagctttttatcagtttttttgtagtccatgctgggccttctagcagtattagtcttacggaagccttccttttctagatcctcatctactgccatttttatgtgtttgtccactcggatatttatgaaagtcaataattgggttacatacccgtactgtattaaccacgctaacgcgttcaggtaaactggcttatgttcccttgatgggattatgttactgtacgcttgaggtttgtccgtggacaacaaacttaaaaaaatgggtaaactgggcaatgatgggaatttggatctgaacaacatcgaattttgataaattagtggtactctgtcgcttccactcttattattttcgcgatcgtccatttttttcacgttcccatcattttgtgaagtacttttataatcatctattgtataaccttgaataggagccaagggtgaaacaatatacgtgtatttggagcttagtgggatcactattcttgcatgtctccaatacattaaatgcaatgcgcaagagcgcagtatgcttgattccaatgagtttgtttctgtagtaaggtcgtccagtgaagaagggttatctaataaatcagttatcagatagcgatacgaccttagagggatatttggctggatatttctgactaaatgtttcaatatgatagtgccaatatcgtcctggtatgaaaaagtttcgagggagctaataatattatttggctcgtccaataataatagcgcatagtttaaaaggtcatcattgtcgtcgcagtagtaattgctttcattgtcgtccccgtcatccacatttgctgctccacagtggccggtactattaatattattgccaaacctgtatatgttattattggtatcactgaattgagcctgatcgttttgacgattttgactttcaattctcaatgatgatttttctaaaaatttcatgttcaaaatggacgtcaaatatgagcctcttagcacgggttgcagtttgaagtttggcattttttcaaactcgttttgaatcgggatttgcaaggaaattactttatcgtcattgatctcaagacatgcgatttcatttcgttggattttatcaacacattccgttagcgccctagccaacgaagatttggctaaaattctttggtacagatacttccccttgtttcctgcgcctcttatagattggtatgttttcgaatgtttcagtacccgttctttttcctttaaaattatatggcattcgctagaaatgtacgaggtttttgattgcacatatcttaacaataatgataaccttgtaacaacaaactgatacatgtcatcaatccttttattatattcgattaaatgcggattcataacaaagcatacatgaaacatgttcatatttttgcccaagtcttccttttctctctcaaattcgtttccactgacatcagtatttatcctcaaattcggcgtatcagtagaagcctcatgaccaatattactgtcataaacagtgtcagcttcaccactattaactttcttcaaagtattctcactcagtgatgaaattttggaagcgatagatttctttctactgatgtttgttgtagtactcgaagatcttttagagcgggttttatttttgtgcttggattttctccatctgccttgagaatctacatgaataggtaagcctaagaagcagaaattatccaccgtgaattcgaatctggtattgcacatttccctctcagggctacaaaattctgcaacaaaatcattatcaaattctagaattttatttatatcctggaagttttcctcttcaaaaaaaatttcattcatagagattttaccatcctgcaacattgccgaaacttccatgtcttcttcttcaacatcgtactgggtatgggaatttcgttggctcgtcgcggcatttttatgataatggtggtaacgatggtggtaatgatgaggtgattggccaggagtgtcgttcaggctactattacgaagttcttggttatgctctcctgtactcgataaagattttttagaagaaattgaacaacttcctgtaaaagcatttccatcagtctcattggacgtattttttaacagtttgttgccttttttagtgctttgtgatggcttagatttaagctttcttactggagaatgtgtttttgaatcagtactcttcttggtactcaatttatggaagaaattctgggatctcttggaagcggcccttgatttgttattagtcccagaatctagatatgattccgctactgaaatactatcgttttccattatcatttgtggtgaagttggagacattgaatccgtagattggaaactcgaattagttcttgataagccatcttgcggaggggaagatgaggatgaacttgagggagaagaagataaagaagatgacgataaggaagaagatatagaaaacgaatcgctagaaatgtctaagtagtctgtggacaattcgctgtcacttaatcccgatgatgacgtttcagattcagtttcttggtattgaaaagtccgagaagtatcttcgatatcggtttttctataacctacaccattagtagccgcaggaattgaactttgtgatcctacagtattagcatgcgatctagttggaggtaatgtcacattattagtattagtatttgtcattgatggcgtaatagcggtattgtaacttttcgctgactcgtttagagcaatttgagaagctgttttcgtagagccagaattaaagagtttttcttctttatttgtacttgtgtttttatttagatttgcatggtttccatagaggtgctgatgcttcgttggattatttgttagaaatgctgtattggagggtgggtagtgataaactatttgtggccccgaatgcgttgaaatgacgaggtgaacacctagtagacatgaattgggtaaacattcatccattgaagcttagtttctacccaaaagatgactctgttcccttttttttttgaattttcttcacatttcaatagcttatctatgtttaatggtatttcaagatatcacaagcgaaaaagttacttaaggaaaaagactagtgatccttacatggcttataactcattcaccatcgaatcattgtaaaatcatatgccatcttagtatagtggttagtacacatcgttgtggccgatgaaaccctggttcgattctaggagatggcatttatttttttgaaattgtatttttttttggactagtattcattatcaaagatttcaatttatataatatttaaatgtaaccgttttcaattcttgaaaaacattttttataaagcaacagctcccattcttattcatttgtattcaaaaattctggcatcaatctcgttcatttcagctttcttttggaaaaaaatttcccgctgacattctatgatgacgttctttaatggtgaagttgcaatatcccagctgttggcagtcagagatgctatcaaattcttggctaaggagtagtcgcgctgattcaaactcaataattgaatggatttgttatgcacttcattattttgtgccaaaacttgcgtaatacgaattcctttatagtttgccatcgtgcaaatataagcgttgcgttcattcgagtgagtataatttagggctatgctaatcccataggggtccgcatcggtaaatatagaacagtccgatatcaatttggagcaatattgttctagtttttttaggaataaccttgtcaagaaatctggaaatcccttacctgtaatgagcatggtatttgtactcaacttgtgataattatttactaatttggtgaagacagcttctttttccactattacaatattacacatacttgttgtccctaacttgatgaccgcatcatcttggaaaaatggaattagacagggcttaccagggaaaattgtttgcttttgcatctttggttcattttcacatgtcagaatattgtcataaatatcaatggggaaaggcgaataaactaaacccttttgagctggtataatgtttaaggattttcttggagagagcttgaaattaaagcgtataacgtccagccactggactacgtttgcttgtctttgaaacaattccacgttggagtagaagatatctctcactgtagtgtttttacctagcggtaatttttccataacgactttcaataagtttaaaaggattgcgcatcttttcaacttgaactgatgagtgcatagatgcgggccattcaaagggaagtccaatgttgtgtgaatgtcaggactgcttgtatcgccttttttttttttgttttgaaagacgattgaaataggctgttgatgttgctctaatgaattagccgccaatgacaggaaatgcttaatatgagccaaaacatctgcgtttgaacagggagttccgttggagtgaccattggagttcaagtgaatggaccgtcttttaggagtgagtgctttgaccaattcctgccttgttttatattttttccgcaatccctccaaagccatgagaaggtgaacttagtaaatcgtaaaatcttaagggtgaagacaaatatgtgaggttatttgaatgatatttagttggatataatcactaaataaagtagattttccttgggtagtagactttcttttacgttattccttttataattttaattttagttattgatttcaatgaaacaaaaggaaactgacggcttcttaaaataaatatatttaacatgaaacattaaaaaaaaattgtcactacacagagagaaaataaataaatataaagaatcacataactatgctgaaaaaatgaagttatttgtcatgaggaaacttctcttccaagaactttaatttactcttgaaagtatcagaatcgaaatagcaaccctttaaccattgctggtttgagcttgttaaagagttagcatgcaaaattctcctgttgttaaagataacacaacagttttcgggcaactgcaatctaaattgattgttgaagtcattgatatgactctcgaacaagttcaaccccctaatgaaagacttaaacaaaaatctctctgttagttttgctggggtggtaattaaattcaagtccagattattatttagatctgagggcttatcataaattccgaaagtgaaaggtgcttggtatggtggagagtagttaatgcatttaatcaaggcctcataattacccagaagagtattgtcctcgttaatgtcgtgatgttcgattaaaggtttggattggtagtacctcttatcgccgttttcatatatataatttacaggaacaatttgtaaagcctcataagcctcaaaatccgattctctaacattacgggtagcataaaatgcgtccacgaagtaattcatgggtctagtattgggatcttccccttctgtagcaggtagagattgtagaatctggaaacctggcacattttctaaaaatggtaaatccgtatgtagcggcaagtctttattggcataatgggcattaacacttgtcgcttgggatgcattcacgtcaaatgtaccttcaccatgtacagtcgatcttatgggtccgatcctttcacagatcttttgtatggtaaggccttcagaggaggatgaaggagtaccggaaatgaaagcgataccaaacttttgtaggttgaccagcgtttggaaaagcttggagtcatccttaggatcaataaactcgttgtagctcacagaaagtaagtccttgacgttatctttcaggatgcgcttattccataactggggtctatatctggattcttgttttcttgttgctggcgaaacaaaactggaacctttatagtcgataaagaattgtaaagggaactggtgatgaccgccatctttccatttcaccactagagattttccgtcctcagaaatttgaatgtcctgaggagcggtcaatttctcgttatgatacagttctcccgtggtcaccagcttggcactatgggaggcatctctaagaaaaacgttgttaaagcaaacggaaaccggcttgctggactcctccatggagaacgtaattgtcgtagaatctctattgaagtatgttttgatgatatgtccccgattcgcagccgcagctgtcgccgcagatgtgtatgtccttggtgtagtggtcagtcttgcaaggattcgagatcctctgcataaatttgatcttagcatcttgtgttggtaattggtttctaataattattttttctttttaacttggaatatgttcctggccagttgtgaagagttacccctgatatttggatctagaagggcttctccttatatagatagcacttttcctcgaggatcaaccccggaaatgtattcccgacccccttacggctgcgcaaaggtccttactgagccattcaaaggtaaagagggtccgataataatggtagttcaaaaggggagaagcggggctggtacaatatcacgattatgattatgattatgattatgattatgattatggatattatataaactatattattccgtataatattattactggtggtaatgcatgaaagacctcaatctgtctcggttagtccttgctatccacgttgtcctgagagggctttacgtaattgccatccttctgctgttgctgcctgtactgttgctgctgttgcaagaaacgctccctgatcatttcttttacctcctgtttctgcttcacccattcttcagccttgcccaacgtggagtcgactacgcccatgacatttctcaccatttccagggattctttggcgagaatgagtactttcccattcgcagttacggaggaggacggcgaggctgagtcgtcgccatccttgttccttttttgctgttgctgttgcaggagttgctgctgcaaaagttgctgctgctgctgctgttgctgttgctgttgctgttgctccactttttgttcttcacagttggcataatgaaacgaagcatgatgcggcagtgatgtactgtggacgctgtcgaaccaatttgtgggtaagtttagaagactttcccgaacctgagatcttgcgggctccggcagcgaatttgctgtgaacttcgatatcagcgagtagactttcttgactgtgccgaccacctccattttcaccacaatagactgctcgctggcgttgacctgctctgaggcatcaaaaaactcctcatcgtcgtcgtcttcgtctgacgatgtctcgtcctcgccagctccagtggtcgtcctagcatttccatcttgcttgtgcaaaggatgcacctgctccttttcaacaaggtcctgtaaacacgagattttatcggaaagctgcttattggccagctttaaaagatgcaagcacgttacaagcctcttcttagactcgatggacatgttcagcttgtactctttcaagttgtccttccccttggcaatcgcccgcgacagcttctgtctcttgttggtgaagaactcatcgtcgttgtagtcgtaatcatcatgctcgtcatcgtcatcgtctagcagcctccctattgatttcagtggcctcttgttggtgtttatttcatcgtagaatgtcactacgttactgataattttgttacttacgcgatccaaaatgtttagcggcgtcgtagacgactcacttgccggcattttgtcagcttgtgagacgtcctctgaaggctgcgacttctgtctgcatgattgtttcaacaccccaagtacttcagccgcttctacctcttcctctgataatcctaaacgttgattttcagacatcaatgactagtatcttcgttaaaaacactgtcctgatacacacgctttaatcagcactgtaaacaaaatgccacgttctggcctgatatgctttcttggctaagtgcagatcgctgtcttgctccaatcctcttattaatccctctcattgaggtggaaaaaaaaaaaataagaacgcccgattttacccggttgcatatgaagattataaggtgccatctatatactaaaacgaacgtaccatttgtctatctatgagatgtctgcgtaagcgtcaaacaatatatgcgtactcttcgtcgctgacggtcttgtatctgacccaggggaaagactggtactgcaattgtggctcttcgaccttcaagtactcaactttcaggccactgcatgtacagtacggaatctcgaaatcaatgttgaccaacttatctcgaggagtaacgtgggaagtttgttggtcgtgcacttgtctatatagttcttccagcctgggtcccgtgcgcaagggcggcggattcattgaggttttcatttcttcttgcaggcggtcatattcttcctggttgaagagggggaactctgccaccatggatgcacacgtatttggatcatcttcgtcgctgttgtactgtgagctcttgtttgtgctatgttctcggtgccccttcatggtttgtatctcccagaggagaaaatcgtcactcaagttaaacacgaccttgccgatgtttgccttgaatctaatttgcttgctgaggtctattttatattcctggaagacttttgtcaggggaattctcacgtttagcttcgacgttgagttggtgggtttaaaatttgtttgaattttggttacaatttggattttaaacttcttcagtttaggtttgatttcaaaatctttcaacctcaccatcggcgcatcctttacatgtctcttcaactcgtattggcaaagaacaaattcgccatccggcggtataaattcgatttctcttgcatctgtggcggcctgcaaaccagcatcatcgtcactattcttttcttcatctttttcaatagtgtttatggaatctagtgaaacacactgatgaaagctggaattcgacatgaactgggggtccctgttcagtatcttgtttatggatattttcagtttgggcatccctgataaatagcatctgcacacaatctctccatgtatcagatttttcctaatcactcctttttcaaaatccatcaagtactgaacacgttcaataacatcaagaaagaactcgtttttggcgtaatgtatcccctttgttctccatgatatgggcattataatcgtcttcgcaatatcgccattgatgtataaatcattaccgtcattggggagctcgtcattagcggcttctttaccggtatcattcttgttccttagtgtctccttgacagtttccaccacgtttatgcccctattttctttattgtttaccattatactttttaatttacttttgcccacgcttttccctttagtgccctttttcttcttccttttcttcttcttatccttcctcttattagtattgctgtactcgctatcgctatcgctaccgctactactactgctctcttcaccagggctccactcctcattgtctactgtaactcttggtacgttgaccttcacacgaatgtagtccttgatgatacttggatccgtcacttgtacgataccaaagtctatacattcatcaatcaactccaggacaagtaagatgttgtccagtatgacattcttagttaagacctcgatttcaaaatatttttgtaaaagatgataaaattgttccaaaaaggctagtatagtcattaagtctatatttggtttgtctgtggtatgtatcactgaaacgaaatgcagaaagtctctcttcaaatgtataaagaaccaatcgttttgggagagaattggaggcgacccgtcatgataacattgtttgaaacttgaaagaaccgacgatagattcggtagtgctctaatattcttcgataccaatggctccagattttcatccaggataaaaaggcttgacgacatgcctttccttcctgatttcctctttactatttttgggtccctttatttgctttttgtccaaggcattctcaattttccaatctggaatttaagcccttccagttataaaacagtaaacacaacctaccaaaagcagaaagaaaccaaagtaagaatacaatgcacaacaagattgttagaatcgcgtccagtgcactcacagggggcaaactactcgagaagctaaaacccttgacccgttgggaagttcaatgggaccctaataagaccaaatgtttgggaataacaagagaggtaacattcaaggactacgaaaccacatgggcctttttgactcgtgtatcgatgagatctcatctatggggccaccatcccctgattcacacaagttacacctgggtcaagctggaacttcatacgcatgacatagacccgaaagacggggctcacagccagcttagcgatatagacgtccggatggccaagagaatagattcctacatcgatgagatgacaacttgataaggcagggcaggtctaaaaggctattgctctttccattttttttttcctatcgattttactactagaaatttttgctacccatacccattctcgcattgcaacatggaaaaactgaaaattgaaaaaaaaggtattgaaatttcaactgtattgtgtaaatcatttttgggcaaactagacacaataactagcgaacagaaaaatggatagaacgtggctattactgacgtggctgttgctactctgtggggtagttcaagggaaccaagaaagcataaatcaaaaatatcacgatgtctgttcagggatgtattccaaggaggatttcaatggaaaagttgacccctatatatcgtttacgttggaggaattgtcacttgctgatgaagacgatgatggcgagggggttagtgttgctgtgtttgatttccaagattatgagcatattggtgtgcggttaccaaatggagaaattcagtatatttgcgatgactacgcattggatttgggcctctgtgaggattcgtcggaggggcaatttatcattcaagagacagccatcgatccgttcaccagtaaggaacataagctaacgagtcagattttgactttcactcaacaagaattgggcactaacgacaaggtatactcaattaacaaaactggttactattgtgtgaccacgtcatctttcatttcttccagttccaagtttaaggctacagtgaattttaggaacgcttacggtcaattggacgcttcagaggcgtacaagatgcctatttatgcctttttggccgtcgcttatgccgtctgtacattagtgtactcttggctatgctggaagcatagacatgagttactgcctttacaaaggtacattttggtattttgtattttcctaacagctgatactattttcgtctggatgtactatattattgagaaccagaagggaaactccagcgtcgctcttcatgtctatatggttttcatatcgatctttagcgccggtaagatgactttcacgcttctcctcgccttgctgatatctcttggatatggtatagtatatccaaaactggaccgtacattgctaagaagatgtcaaatatttgcgatatttacgtttgcagtgtgcgttgcattcctggtccaaaaatattcccagaattctgagtctttatccaatttgattttgattactgctatccccttagtattatgtctattcgctttctattatttgacactgtcttcaatgaacaaaacaatgacttatttgagggaacaaaaccaagtggtgaaattaaacatgtacagaaaactgatcatattgtgttatatttcgttgtttatactcttcttaggcttactagtctctacttttgcatacgtcggtatggacactgttgacatgatagaacaatattggaaaacagaattcctcatcacagatacttggcctagtttcgtttacttcttggtcttcgtcattttcgcattcttctggagacctacaagtacatcatatttactagcgtgctcgcatcaattaccaactgacatggaaaatgtatcagaattcgatttagatgacataaattccttgtctgatgaggcattgcctaatagagagccacgtaatgactaccaggaacacgatcacaatatggatattgatttagcatccgattttgaagaagtgccaagtgtaaatgcaaatacgaacgcaaataatgacgtattgttcgacgtagattacgacagagatgcaaaaaatgatagaagtactacataaacggaccaaataacataaatttagaaatttccttttttttttttttttccccttgactttcttttcttttatgtacctataatgaaagactattttataattagagctatttaaaaattattaatgaggttgatgagtggatagaatattatattttgaaagctaaattatttcatcaacttgtccgaaatgtgatgattgtctatgtgctctcgcactaatttggcttgttactacatgcagatcttgtgggttcgaattttgccattcccttaatttataagtttgaccagatagatcccagtaaaggcctcgcaaagtggtatatataccatgcctaccttcccagagtggataaatacaaacggcaaacgcactgaaaaaaagccagatgatcatcacaacaacccaaccggtaaagaattttttactgaagatatatttggaaccatacatgggcatgggccaaactaccaaaaatgccaaagcgaaaaaaacacataggaagtatgcaatttttaaaccacgtgctagttctctttgttcttcgtctaattcattttgtaactgtgtgtcatcttcttgaaaaatggcattacttattacaacaccaaggttaggctcaatcaatttttcattatttactctaacatcgtttttttcactatctgagaccagagaatttgtttcttcttcttgttccttatcgttagcttcagcatcgtaaagctggatatcagggtcagcctgaactaactctgcagtttcgtcaactctagtaatatctttcattttctcccagtcaaaattttgtggcttaaacacatacgttaaaataggaataaaaatggctggtgatagcaaagccaccaagttacctgttaacattggataatccatgaacgtagtatccacggtcaattctttataaagggatttggtacagacaagccatgacattatagccagtcctgtgcccaaaataggcgacactacagcggccaccaaattcatgtctttggaacataaggtcaaaacgacaggtaatactgcactactaataattatacccatcatttcatagatataacccatagaaataccaccatagtataaaccaaccgaaaatccactcatggcaagaccaaaaaagatacaagcaacgtgtgatgtgtaaatcaatttcttaccgcttgcacgaggatcaatatattctctatagatatcgtaagtgaaaacagatgaaacggcaattagttcagcagacatagcagatgtgacggccatgaaaatcattagcagcgatgccacagcaccccccttacccatgatagcaattgcagctgccggcaagactaacccagaatttgcctggaacgaagtaagtggatcaggataggtggggaagttcggagacgtttccaccgcaagacatgctaatcccatggtcaatgaaatcaaagaaggtactgcaaaccatgctaacccaccgatggcatatgctttcaaactcgctgcgggactagcagaaatcgctttattccaataaccattatcaaggaaaacggtgccgaaatttccaatcaggttaataattaataaaataccagcggatttggatgtcatggtcatatattcaccctgatagttaccgtctactggatgcctcttggcggcttcacgaactaagtcataaacttttcccggtgagcctaaaacatcactagtcgcataaactttaaaggcaaatacgaggacaatgatgataatgacacatgtgtgcatatagtccgttaagaaagttgctttaatcccaccaaatagagtataaacaacaacacccacaggcagtaaaaaacatgatgcgatagtgttcatcccggttaaatcactaaagacagcagaacctgaagttaaaagcattgaagtgactaaaatattcgtcgcgatggcataaaacaagtagcaaccatggccgatcttaccatatcttgttctcactaattctaaatatgtgtgcgcattgggagccatttgcttggttttaattgccaaaattgcgaatgcaataatttggaagcatgcgccagcagcgtacgcataaccgccaaatataccgtctgcatattcctttgttgacgacgttaacaatgtagaacaccagatccaactagaaaccacggctgcagccactaagccggtttttacagatctaccggcggtggtgaattcttctgctgtgatgatttccttttgataacgtttcagtaaataagtggtcaaaaccatcattcctgcaaatacggcccctaggcccaatacaatagcgtacccagcgccttgaggtagcggaggtttaaattctcccatactataacaatgacaaatttatgttattactttttcttggatgaacccaatttaagaatctagacaagggaaactgctaacaatagtaaagctacggctatactactgcttcattttatatacttggcgaacaagacgtatcttcatgcaacaccgatgaatagagcacatcttgcctgttatctaaggataaccgtaccgtagaaagcgcaatgatgagttacacctttcccataggtacgcctgcttgtttctatgctgcaactgactattggcctgtccactctcgagcattattgtctgtcgcatttgctatcataaaatatcccgataagataacacccaaatgtgcgccgcctcatttcatcatcggaaaaaaggtgcggcaccaatagataaacagaattggaatgcctagtttgagtcagccttgctgcataaaacaaatacctgtatgactgcttttgcatctttaagagaacctttggtcttggctaatctcaaaattaaagttcatatctaccgtatgaagcgctgataaagagcgccaaatctgcaccttgtgcattttgttcacacattcttggcgctcctaactggagaaacgtctatcattgaggataactccggatagtcgcattctgattgaatagccgtctagctccctattgtgactagaatactattgacatcgttttctcatcaaaacctcccgataaagggaaaaaaagaattatctgaccagatcattcggaaaaatgcgtatcgtcattgatatccttcttgtcttgtctgctgctaacactatttactatggaaagagagatttccctgaaacttcttatttttatctctatagaaggggaaaagataaaagtaaaaatgtaaaaatgtttacctgcaagttcacacctgtacattttctacatccgtaaacataagagaaaaaatgccacaactatttttatgaagataaagttcgggtaacgataatgttttaattttgaaaaaaaaacttcgacgcattcgcgactagcctcagagattgagtaatagaccgtattgaattcaaaataatagtaaagatgggttatttcattcaagctcagctttagattgaaactcctacaagaaagcaagtaaaataaacaaaaaggtatatacaaaatgtctgactttcaaaaggaaaaggttgaagaacaagaacaacaacaacaacaaatcatcaagattagaatcactttgacctccaccaaggttaagcaattggaaaacgtctcttccaacattgtcaagaacgctgaacaacacaacttggtcaagaagggtccagtcagactaccaaccaaggttttgaagatctccaccagaaagactccaaatggtgaaggttctaagacttgggaaacctacgaaatgagaatccacaagagatacatcgacttggaagctcctgttcaaatcgttaagagaatcactcaaatcaccattgaacctggtgtggatgtcgaagttgttgttgcttccaactaagctggttctaactggaaataatttccattagattcctctttttctcgtccattaaccaaaatatattattgaattcagcggttccttttttctcattttcgcatatagctgcactattagaatcagcccactctaggtaaacacagttcctcgatatacctctgtcttactatcagtggttaaaccttatgcaaatataatatatatatatatatatatatatatatctcatacttttgttgattcttgtgtaattattggaaaagacaaaacaaagcaagcgtttctattcatatttacaagtattttttatgacaaactatttcttaattttcccaccggcggctttgaataaggcaatgtcattgtcctgcataatatattgtttgcctgcacgtttgataagtcccttagattttagtaaagactcatttagcggtggttccatcttcttcagatcgtcatattttattacatcagcgctgataaatgtttcacgcaagtcgctatggattacacccgcggcctcttgagcggtggttccctcccttatattccattggtgaacttcttgtgggccgcatgtaaagaagctaattaagttcaacaactttctcatttctagtattatttgcggtatcgcagaaactaactgttgatcagaaacattggtatcttccttgatcttgtcaaaatactctgacgctatgcctttacattccatcaattgcgattcaaattctgcactgaaaagtaggaatttatctcctggcgaaaattcgttaatccattctataatatttctgacaaatttattttcattcctaacgtaatcttgaggtgaaacatttagcaatatcaaagttggtttggaggttaaaaagttatgcttattcaaaattttgacttcatccaggttccaatgatctttgaaatgccggatttttttaccgttaaacaaatgttcctctaatgcatctaataattctgtctctatcttcatttcctgatgttctttagaattcttcgaaaccattctcatcttcttactaagtctttccctaatgttttccagaaattctaagtctttcaagatgagttcatcttgtaccacggatagatctctgacaggatcaacattaccttctatatgggtgatgtcttcctttaagaatcctctcaccacttgaaatatcccctctacgtgtctgatatcgtttaagaacttgttacccaaaccatggccttgagatgcgcctctggtgagcccagcaatatcatatattgtgagtgttccaggtacgcatttcgcactctgatatattctcaataaattagagagcggcacgctaggtatattgactttggcacattctgcgtcaatggtagcgaatggataatttgcaggatttcccaattttgagtttgttattgcttggaaaaaagtcgatttaccaacattagcaagccctactatccctgaagttggattattcgatatcctcccaagtaaaaattttcctccaccaatgttcatatccgattattacttctctttattcttttatatccatatgcttcaaactatacaattaaatagatgcattaaggtttacaaataagcatatctcattagatacggatgggaaaaatcaagaatcatgcaatgaattataatgctcacctaatgcatagctgtgtttatagtaaactagcttcaattcaggatttttcccacattcattgtacacttgaataggtcttccactcatcagaatgctaatggggcagtcgaaaacgtgagagagagccaaaatctcaatttcaccaccccattgagctgtatgctccatctctttcgtatactcatcaatgtctttcatcttcatagtttcttcatcaaacaaatatggaatgaaatcatccctgtgctcctgtacgtaattacaactcaaccatctcagcttcatgacatccatgtcttgatccagtttttttggatcatggcgtaattttaactgatctaatatagatgcaaagagacagtggccatcgggttgtatatcgaattgtttcagtttcttcaactcgcataactgatctatagactcctgctccatttttttcaagtccggttgtttggatgcttctaaagcagcctcttctttcattttagcaattgctgcatctcttttggccaatctttccttttgtctattgcgacgcttctttgtctggccttgttgctgttgttgaacgggaacattctgttgttctttctcatctcgagatatggatagttgttctaaaagtttttcaggagtcacttcatcttcttgttctgcgtcaaacacttcattatttgcaattttccaatcccttatttcattttcttgcttagtctttagtttatcttgaagatctaggcatttcgaattaacttctttccttttggatttagtagcctgctttttcatacccgttatcttattctgtaaatctttattttccttgcgatgtctcgccaaaatatcttccatgttttccaaattctctcctgattccatgccggtcatgatgaatatctcttgttctctctactagattgaatgctgtgctttagttggattttgtattagatgctttcgagatgcccaaactaaaaacaaggcgtgaagaaaaagaaatttcgcgacgcataataatactttctttgacagggccagggctgccaacttttcagattttaacaattgagaaatttattgtggtaagaaaaccataaatttccactctgttggaattaaaatttcctgtattgaacgagagtagaagcacacaattttcttgaagaaaaagtagttagtcttccataatgttcaatggccttatcacacaaaaaaaaaagaatgaaagtactatcagcttataagtcctgattaattaaaaaaagaatgcagaatagcaccttatagtaaaaaaagtaaatttaagtaattaaatataactatactgtaacttttttgaattgtattttccctggcatttacaatctttttgtaacctggaatttaacgataactgacacaagtgattcttgataataaaaaaaaaaaggaaaaatatttcactgttctacatagtatatacaagatcaatgacggttttctctggagtaaataaaatagagtttgaaggtactttcgaaggtattggaaaggatgttgttatgtcacaaatgataagggccttgcagaaacattttccttcgatacgtgacaagaattatgagtttagcctatttttgcacatttttcaaagatatgtcttagaaaatacttcaatcacccatgatctagtttgtgacaaaattagattaccgataattgatgaagtggttgaactcgatgatattaaaaattacggtttgttagagggtaaactattatcaaagttagctattttaaaattaaccggaaaggctaatccaatcattggtaaagaaagccctttattcgaagtaaaaaatgggatgtcttcattggatgtaatagttcgacaaacgcaaaatttgaatgtacgatataattcagacgttcctcttatatttatgacctcgcttgaaactgaatctcaagtatcaaacttccttgaagagcattattcttctagcaaagtgagatggaaaaccgtagttcagtcaagctttccacaaattgataaagatagattattacctatcgatttacaaataaattctcatgaaaatgatttttggtatccttgcgggactggtaacctaactgacactttgtatttttcaggagaattggacaaattaattgctcaaggaaaagagattttatttgtttcaaatgttgacaatttgggcgctacaggagatttgaacattttaaatttcatcataaatgaaaaaatcgagtatcttgttgaagtagttgaaaggactgcaaatgtttcaaacactggagtgttggcaacatataaaggtaaactacgatcggtttattacaactgcttatccaatgaaagtgcaagcacgtgtcgaattgtcaacactaataacatttggattgatttgaaaaagctaaaggtgctaatagagtctaatagtttaaatttgccaattcattctagtgaaagtaaaataacacacaaaaatgaagagatagagtgtcttcaatttaagacacagttggtcgattgtattgccttctttccgaacagtcgagtattgaaagtatcaagagacagatttttacccctaagaacatgtaaggacttgtttttgttgaaatcaacattatatgatctcgattcaaatggaacatttaacctctaccctctgaaatttggattattaccttcaatcgacttgggcgatgagtttgcaacttatgagacttttaagataggagtaccagatattcctaatattctggaattagagcatttaactgtgatgggaaatgtgttttttggtcgtaatataactctgaaagggacggtcattataatatgtgatgaaaatgatgtaattactgttcccgatggctctattttggaaaatgtaacgatttggcataaatctcagctggaggatatgaatggatattaaacaagagaaacttttgggtaaaatgcatgaataaagttttcttctattcccactatgtaagaggaatcatgtatcctcacagaaaaaaaaaactggagcacattgcaatagtggcattacattgcaatttgtgggaagagaagtatacacatcagatacgtaggtatttatcaaattctgaaaatcactcatcatttttgtagtattttttttctccccatttattcttcagtcacttataagggataattcttaaataaataagaaatactttcaccattatgcaaacgacgaatactttcagccagcacactactgatgtcaatgactgccagttttgggcacttcttgattttttcttcaaatggaacagtatttgtgcaaacaactctatccagtttagaattgttaatattttcaatagctctgcctgataaaacaccgtgcgtgacaatagcaataacagatttagctctattctccaaaagaatttcagcagccttagctaaagtaccacaagtatcggccatatcatcaacaatgatacaaatcttatcagtaacatccccaacaagaaccatacgagaaacctcattggcacgagctctttccttatggatcaatgcaaaatttagatccaaacgatcagccaaagtggcagcacgttttgccccaccagcatctggcgaaattattattgaatccatatagttgacattttccttgatatacctaactacgcttggttctgcatataaattatctactgggacgtcgaagaacccttgaatttgggaagcatgcaaatccatagtaataacatgatcacacccggctgttgttaacatatcggccatcaatttagcggtaataggagcacgagacttatcctttctatcttgtcttgcatatgggaaatttggaataatagcagtgattcttcttgcagacgcagtcttcgaagcattgatcatgatcagtagttctagaacacgatcgttcacgacaccagagccaatttgcgtgatgataaagatatcttggtccctaacagattctccaatagaaaaggaaacctcaccggttggatctctctttagtttgctgcttgttaactgtagacctagccttttggcaacaagttcagctaaacctcggtggacatctggtgctaataatttgatggaatttgttggcattttgtaatcctaagtgaatatatgaggctcagtttgaatgggtaggttcgtttatcctgcgctggcaaagtacgtagaaaaaagagtatgaatctttcttagatatattcaagaaaaagtaagtaaataagagggtacgtgattataaacagatacgagtttagcgaataataccgttcgcaatcataactttataaaactcatcctattacttactattcgactggaaaattttcgcaggcaaaaaaaaaaaaaaaaaaaaaagaaaagaaaaatcgatgagcctgccgtacacagagatataataaatttagaatgcaagaatggtatggcggtgatgaagataatcatttccctgcttttttatttttgttgcgcttcttcttgcttttggatgcctgtgctgccccatgtggttgctgtattaggatggtaccttcttttacactctcatcagcgtctttgaatttttcttgagaatctagataaaacattaggtccttgacttgctcttccaaatcttgtttagactcttctaacgctttgttttctcgctctaactgctcttgtttttttgataagtgatctaggttcgcttgtagtccttcgattactaacatatcttcctcaagcttagatttctgggccatttcccttttctgccactccttttgagtgacctgaaattggagtttcaaatcttccatagacttcttcaaactttcaacattcgaagaatcagacgcagtttgatctttttcttgtaatttcagttcataatattctctttgagactctaattgagatattaggacttgcacatattctagatgatactccctatgccttaaaaaatttgccgccagctcgccatcttttttattagagttcgatttctcaccgtttttgctcctgttcccgtaaacaacattttgtagttcatcggagttgcctatatcattgttgtcatcgtcaccggagccgccgacctctactaacttcccatcaacttcattttgaactaggcgatggacataattatcacccgcataatcccacactctttgtgtccgtatatccatcgcaaaacaatgtaaagtttcttcataatgcttgattgcgtgtttggaattgtaacgaccgcatccaacattaccgcagatcaagcaaatccatagattatcagtggaaccacatgttgcacaatgtgcggaatcacctgcctgtttcaataatgattccctgcttagccgcagacttgaatgtcgacacactggacaccttgaattcttccacttatttaagcattggcaatgaaaagtgtgctggcacgggatcgttactaatccagtagtttctgaatccattctttcaaggcaaacgggacatgtggggagttcgacttttaccagttccttttttttcttaacagtgaatggatcagtaagcagataggggaagtcctcgttagcggctggtctttggaagagctttttttgaaaaactatttcttttacagagatcacatggcatgtttcgggatccatcctgctgaaacttttgccattgaactcttccttgaaatttttcgcatcaagtgcattcctgaatttaattaagaccgtgaaattaaaacccattcccttctgctgatttcgtaatatacgaaagtttgaaacttgcttattaacaatatcatcaccaatataaaaatgcaataaatcgtgaacggtaaaataagttggaacaaacaggatacatatcatagtatcatctcccgggatagtcaaaatctccttctcattaagagtattattggcattgcttagcttgaatagccttattatcccatggcctaagtattgtgaagtaatcaaatcactttcctcttcttttgatgtttgatttttgaaatcagttatcatgtctatttccaagtcacagactctccaatcctgccagtcttgattattacttttaatactttcttccccgatactttttgccttcaactttttcggaatactcttgaaaatttgataagcggattcaacctgattttggtttccaaattctaaagtaatgatatactcaaattgatccatagatgtgagggccaaccagaaagtaatacattcaatgctactattccgttattgcctctatgtgttttcctttgaacttttacttaatccgcgggtgaaatttcatttttatattttccattttataacaggccgtcccctaaaaacaccgcgtaagaacatagtttatacacttatataagtaaaaggtgtagtaggttggaatggtaaagggcgtattgtgtgtcaattatgcgatgaaaatgtatacttcgaagtcaataaaaaaagaacctggtttgcctcatgaagatgttgcctgccctttcttatttagtgtttgtaagttatttttgtcaaagtctattcattcattcaaagtagcttcctccactagaaaatcgattaaacttcttggatacgcaggtccatgggtatgacaacattcttgtccttgcaatttgctcataacgtatgtcacatcaaagtccctctcttctgaaagtttgtaaagatactcccaggtggcggggactgttagtacatgtcttcctgcttcgtcagtatactgggtatttcgcttcataatttcattatcctttagcgaatacttgcctttgtgattcagtttgctttccaggaccatagaggtaaaaaattcatctttcgttgggaaagaatatttgtagttggtatcatcttctatgtcctttgaaaaattttcattaccactccgcagtagcagtctgttctctgcgttgatttcagtatttgcctttcttagttcctcaatttctttcaataaactttggcggttcctttcactttctaacaatttatcttgtaattctttcattctggcttcttttctctctctgaaggctttttgggcggctctgttttgagcctttttctttgccttagagtcatctggaacattctcattatgagcaactgagggactcctcgaacttggagatataccattatttttagaaaaataatttgtattactataactatcattatcattattattgttatctgccataacataggtagagtagtcgcctgaaataggggttagttgaattgcttgaagatcactacccttagggaaagatatgttgttctgtaatagcaaatcattatttgatctgtcaaggttcaaagcaggacactggtcttccaaaattgggaagggtgctgtttgctcgctcaataggtctggttgttgttttatacatttgctatcttcttggaatagactatttctgatacaacaatcctcctcttggcattgagggttaataaatttcatgaatccgctggtattatcatccatattagaaggcgtcataacaattgcttcagccttattcttcgttagtttatactggaagtaaagcaaacacctactgccccttttatcgaaatgataaacaaataagaaagctcagagggcctccggtaatattcaaatcgatctgttttataatgcttattgaataataatgccgttgctgtactcttaacataaagctacgaaaatccactatacatttttctaaagaaaaaaaaaaaattcaaaaaaaattgatttcgcccaggatcgaactggggacgttctgcgtgttaagcagatgccataaccgactagaccacgaaaccaaattcttattgattatgttgtattacgggctcgagtaataccggagtgtcttgacaatcctaatacaaacagtcttagggaagtaaccagttgtcaaaacagtttatcagattaattcacggaatgttacttatcttatatatattatataaaatatgaatcatactgttggaacgagagtaattgatagtgacatgagttgctatggtaacaatctaatgcttacatcgtatattaatgtacaactcgtatacgtttaagtgtgattgcgcctattgcagaaggaatgttaaacgagaagctcagacaatactgaagcggtgttaaagacctattagttgaacatgttatggtaggtacatatatgaggaatatgagtcgtcacatcaatgtatagtaactaccggaatcactattatattggtcataattaatatgaccaatcggcgtgtgttttatatacctctcttatttagtataagaagatcagtactcacttcttcattaatactaattttttacctctaattatcaacatggcgaccccagtgagggatgaaacaagaaatgttattgacgacaacatttctgcgcggattcaatcgaaagtcaaaacaaatgatactgtcagacagacgccatcatcattaagaaaagtttctattaaagatgaacaggtgaaacaatatcaaagaaacttaaataggtttaaaaccatactaaatggtttaaaggcagaagaggaaaaactttctgagactgatgatattcagatgctagctgaaaaattattaaaactcggagaaaccattgacaaggttgagaataggattgtggatctagttgaaaagatacaattattggaaacaaacgagaacaataatatattacatgaacatatagatgctacagggacttactatttattcgatacgttaacttcaaccaacaaaagattctaccctaaggattgtgtttttgattataggactaataatgtcgagaacattcctattctcttaaacaattttaaaaaattcatcaagaaatatcaatttgatgatgtctttgaaaatgatatcatagaaatcgatcctcgtgaaaatgaaatcttgtgcaagataatcaaagaaggactcggtgaaagtttagatatcatgaacacaaatacaactgacatttttaggataatcgatggtttaaaaaacaaatatagaagtttacatggtagagatgtcagaattagagcctgggaaaaggttttggttgatacaacatgtagaaattccgcattgttaatgaataaacttcaaaagttggtactaatggaaaaatggattttttctaaatgctgccaagattgtcctaatctaaaggattacctacaagaagctatcatgggaaccttacatgaatccttaagaaattctgtgaaacaacgtttgtacaacattccacataacgtaggaattaatcacgaagaatttctaatcaatactgttattgaaacagtaattgatttgagcccaattgcagacgatcaaatagaaaatagctgcatgtattgcaaatctgttttccattgctcaattaactgcaaaaagaaaccaaatagggaacttaggcctgactcgaccaatttctcaaaaacctattatctacaaggtgcacagagacaacaacaacttaagtccagtgcaaaacgaacaaaagtcttggaacaagacacaaaaaaagtcaaacaaagtgtacaacagcaaaaaactggtaattattgataccggttccggcgtaaacattaccaatgacaaaaccttactgcataattacgaagacagtaatcgcagtacacgattttttggtattgggaaaaacagttcagtgtctgttaaagggtatggctatataaaaatcaagaatggtcacaacaatactgacaataagtgtttattgacttactatgtaccggaagaagaatccactataatcagctgttatgacttagccaagaaaaccaaaatggttttaagtcgaaaatataccagattgggaaacaaaatcataaaaattaaaaccaagatagttaatggtgtcattcacgtaaaaatgaacgagttaattgaacgtccttccgatgattcaaaaataaatgcaataaaacctacttcttctcctggatttaaactaaataaaaggtctattaccttggaagatgctcataaaagaatgggccatacaggaattcaacaaattgaaaattccataaaacataatcattatgaagaatcccttgacttaatcaaagaaccaaatgaattttggtgtcaaacctgtaaaatctctaaagccacgaaaagaaatcattataccgggtctatgaataatcatagtactgatcatgaaccaggatcatcatggtgcatggatatatttggccctgtatcaagttcaaacgcggacactaaaaggtacatgcttattatggtggataacaacacgagatattgcatgacctccacacacttcaataagaatgctgaaactattttagctcaaatcagaaagaatattcagtacgtggaaacacaatttgacaggaaagtcagagaaattaattcagacagaggtactgaattcacaaatgatcagatagaagaatattttatttcaaaaggaatacatcacatacttacttctacacaagatcatgctgctaatggaagagcagaaagatacatcagaacaatagtaactgatgcaacaacactcctaagacaaagtaacttaagagtaaaattttgggaatacgcagtaacttctgctaccaatataagaaattgcctggaacacaaaagtacaggtaaactaccattgaaggcaatctcacgtcaacctgttacagtgagattaatgtcattcttaccatttggcgaaaaaggaataatttggaatcataatcacaaaaaattgaaaccatctggacttccttctataattctatgcaaagatccaaatagttatggatacaaattctttataccatccaaaaataaaattgtcacatctgataattatacaattcccaactatacgatggacggtagagtaagaaatactcagaatatttacaagagtcatcaattcagttcacataatgataatgaagaagatcaaatcgaaacggtcacaaacttatgtgaagctttggaaaactacgaagatgataataaaccaattactcgcctggaagatttgttcacagaggaagagttatctcaaatagactcaaacgcaaaatacccatctcctagtaataacctagaaggggacttggattacgtattttctgatgttgaggaatctggagattatgacgttgaatctgaactttcaacgacaaatacttcaatctcaactgataaaaacaaaattttgtcaaacaaggattttaattcagaacttgcatcgactgaaatatccatcagtgaaatcgataagaaaggattaataaatacaagtcatattgatgaagataagtatgatgaaaaagtccacagaattccatcgattatacaagagaaactggtaggaagtaaaaatactattaaaatcaatgacgaaaacagaatctccgacagaattcgtagtaaaaatattgggagtatcttaaacactggactcagtagatgtgtagatatcaccgatgaatctattactaacaaagatgagtcaatgcacaacgcaaaacccgaactaattcaggagcagttcaataaaacaaatcatgaaacttcgtttcctaaagaagggagcattggaacaaatgtaaaattccgaaatacagacaatgagatttctttaaaaacaggcgatacgagtttaccaataaaaactttagaaagcattaacaatcaccatagtaatgattattccacaaacaaagttgaaaagtttgagaaggaaaatcatcatccgcccccgattgaggacattgtggatatgagtgatcaaactgatatggaatcaaactgtcaggatggtaataacttaaaagaattaaaagtcaccgataaaaatgtaccaactgacaatggaacaaatgtgtcaccaaggttggaacaaaatattgaagcatctggatcaccagtacaaacagttaataaaagtgccttcttaaacaaagaattcagttctttgaacatgaaaagaaaacggaaaagacacgataaaaacaatagtctaacaagctatgaattagaaagagataagaagcgttcaaaaaggaatcgagtgaaattaattccagataatatggaaacagtttcagcacaaaaaattagagccatatattataatgaagctatttcaaaaaatcctgacctcaaagaaaaacatgaatacaaacaggcatatcataaagaattacagaatttaaaagatatgaaggtatttgatgtcgatgtgaagtacagtagatcagaaatccctgataatttaatagtacccaccaacacgatattcacaaagaaaagaaatgggatttataaggctaggatagtctgcagaggtgatactcagtcaccagacacttacagtgtaataactacagaatctttaaatcacaatcatattaagatattcttaatgattgcaaacaacagaaatatgtttatgaagaccctggatatcaatcatgcattcctatatgctaaattggaagaagaaatatacatcccacatccgcatgataggagatgtgtagtcaagctaaataaggcgttatatggtctaaaacagagtcctaaagaatggaatgatcatctaagacaatacttgaatggaattggactgaaagataactcttatactccgggattataccaaaccgaggataaaaatctaatgattgcagtctatgttgatgactgcgtaattgcggcaagcaatgaacagagattggatgaattcataaacaaattgaaaagtaattttgaactgaaaattacaggaacattaatagatgatgtactcgatacagatatattaggaatggatctagtatacaacaaaagacttggtactatcgatttaacattaaaatcattcataaatagaatggataaaaaatacaacgaggaattgaaaaagattagaaaaagttcaattccgcatatgtcaacttataaaatagatcctaagaaagacgtactgcaaatgtcagaagaagagtttagacaaggtgttctaaagctacaacaattactaggtgaactaaactatgtcagacacaaatgcagatacgacattaattttgctgttaagaaagtggctagactagtaaattacccacatgaaagagtcttttatatgatttacaaaataatccagtacttggttcggtataaagatattggaatacactatgaccgagactgtaataaagacaagaaggttattgctataactgatgcatcagttggatcagaatatgatgctcaatcaaggattggagttatattatggtacggtatgaatatttttaatgtttattctaacaagagcacaaacagatgtgtatcatcaacagaagcagagcttcatgccatttatgaaggctatgcagactcagaaacgttgaaggtaacattaaaggagctaggagaaggagacaataatgacattgtcatgatcactgactcaaagccagccattcaaggattaaatcgcagctatcaacaaccaaaagagaaattcacttggataaaaactgaaataataaaagaaaaaattaaagagaagagtataaaactgttaaaaattaccggcaaaggtaatattgctgatttactaacaaaaccagtatcagcatctgattttaaaagatttatacaagtattaaaaaataaaataacatcacaggatattttggcctcaacagactattgataattaattaatgaagttctaaacacacaatgaatatctgttgaagtacaataatatatctttaagggagcatgttggaacgagagtaattaatagtgacatgagttgctatggtaacaatctaatgcttacatcgtatattaatgtacaactcgtatacgtttaagtgtgattgcgcctattgcagaaggaatgttaaacgagaagctcagacaatactgaagctgtgttaaagacctattagttgaacatgatatggtaggtacatatatgaggaatatgagtcgtcacatcaatgtatagtaactaccggaaccactattatattggtcatgattaatatgaccaatcggcgtgtgttttatatacctctcttatttagtataagaagatcagtactcacttcttcattaatactaattttttacctctaattatcaacacatactgtagagtgggtgaattttgagataattgttgggattccatttttagtaaggcaataatattaggtatgtagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacatatatgatagctgatttttattccaacaatttatacgcttgggtggatatctaggcaagaagggccttgtgttttctcaatattatggtacatcacaaataaaattgagcagcgatatgttccgaacacatgccgttacctgatggaatgagaaataggtctattctatcgatctttatctatattactggtatattatgatgtatgacgtaaaaagatgtagcaaagaatggcaaaagctatcaaaaatttaatgaaacctaaaacgcaaggattgacagtgatgtaataatgaacgagggcatattgaagtttaagatttagtttagtgacactgcttaggcaaaatactattctaaaacagatatgattttcgttcacgatgcaaaaggtttatataagttatttaatagtaaataaaaaaacatgcagacgcataagtcaccattgactcatgcttattattatatccaatgatttatttttttttgttttcgttgatatcgcgggcatcttaactcttctggtcataactggggggatgtgtgacgattataaaagtttttgggctcagtaattttttgccgccttgtagtgctgtccaggtcctctttatttaggttaacaattccggctacattatttgctgtaattctagcattgcggtttatgccaacagcagccatttttttgagtaagtcatctgggctttctgcatccttgcttgagtgaaattctttcgacaccgccctaaacagtccgcccaacgtggtactgtttgctttacgtaatgaatgagcatcgtctgtgtatgctggagacgaggcgggagcgttatgaggaaaagtatcctgtgtcgttctaggtaatatcggaggcgtcacttccctagaagatacattttcagcaagatgggtaattattttttctagcctggtacctggtttattttccaaaatattataaccaccatttttttcgtactccttttgctcacgatcttcttcagttttcactagccttaacaggttatcatcctccttttttttattcttcacgtacgcggagttatgtgtttcggctcttcttaagaaaagctcattttccttagggtcgtaagttgcatcttcaatcgttttttctctttctagcggttcccccattccccttacaggaaagacaccaggcggcgatctcaaactgtggcgcttgttaatacggtgcctgttaatagatttgatcgagtgattgtgaggcagattgtgaggcaaccccaggtgtggagatcttgtcgtagagttacttttaggtatgaattgtacgggttctcccaagtccgattccattgtaacattgtcggaagttataactgatgaaggtatggatcgaagcgaatttagacttctgccggtgaaatagctcgagttatcgtgatttgtattataaatgcttgcaaagcccttttcagtaaggttttcaagatcttcaccggtttcagttgcatcatcgtcacactcatttttttgtattcttacaactcttgaatccatattcagttctggttgctcatctcttgcttcgtattctggtaaagataatctctttctatcacgttccacaaccaccaaatgtaagtagaagggaacgactgcactaaaaaagagtcctccaacgatgttacctaaagaagcgggaattagtagtttccatatatatttacccactgaaacatttgcaccgttaagcattgcaatgaaagatgcagacatatctccgactacatgtgtaaatccgataccaataaagtcaatgatagggaatgacattagaataaacttcacatgaataggttttgccattaactgtaaatatatggctaaacaaacaaaaaaattgcacgctattccttttaaaaaggtttggacgaatgaatatgaaactttttgttctatgatttgccgtgagcctattatccaaagcttctgagaactaataccagaaagatgaccaaaaagatatgaaacaaaaagtgagccagcaatattacctaaccaactgacaacccacgaaatcatcaaatcatagatagttactgcttttctcagaactccaacggagaaaaataggatattagagttgaagaggtcagcacccatcattactacatagaatagtcccatggcgaaattaacaccagtaataagattcacaatacccgggtttcgtgcgactatgtcaggatcttcggaatataccgctaccaataggaacgaaccactactaaacagaacgccaccaagtatggaatttattagcaatgtatctagttgcagtcttgctttcttcattgcagtggccaccaccgctaatgcagtttcatgtggtgtaagatagtttgagtcgtcaaccattttttctaacaatgcctttagaaaatcctttccgtcactgttccatgaaataatcttgttagtttatgaaaataaaaaacttcactcaactggaaaattctagaagacgagagaggatgttatatcggtaggaatttctcgtatatgtgggaaataagaaacaagcgtaattctctcagctgaacaagaactgactcccatggtatttttttttttctacttcttttcttttccctgaatttgcgggataatatagttcgtgcactaaggacaatattacggatatttccaaaattggataatacctctccttcgttacatagaacgcagacagatgttcgtgtaatggtacccgacactcgatgagactttgttatttttatacgcctgaaattaggaagaatttgagttggtttcaatattcctcagttttaagcaaaactgttgtcgtgatttatttaaatttcgttaatgaagttgtgaattagagtgggatgtgttataaaatgtccaaatatacacgataagatatatgaaaagaatttttatgccagtcacaactgtgtatatactttgtcgataataaggtgtaccctgcttgctacgtttacttttgtttatcatcttcagttacgtccaaatttacggtttctttgctatcgttattgtcgtcacaattgtttgtcttattaatatgctcgttgtcgttatcgtcgtcattatcttcatcagcatccatgttctcagctactttcttcaatcttgctaacttgactagcggggccaatgaggaattggcttcagctatctccgtgatatattcatcatgaagcaattccgtagcgcttgctctatcttcgggctccacacataaacaccaatcaaggaattttttcaagcttgacgatagattctcgggttcctttaacttgggtgtaccatttgtagcaattaaatacagtgctcttagcggggtttcatttaaatatggaggctccccctcgatcatttcaatgatcatgatacccaacgaccagatatctacttttgggccatattctttcctagaaaccacttcaggcgccatccaataaggcgttcccaccatagtagttcttttcaagttcaattcattgatttgagcgcaaaaaccgaaatccgttaacttaatatccccttccatggacaataggatgttatcggatttgatatctctgtgaagaacacctttagaatgtaaaaattccaacccactcaaagtttctctacaaacggcaccaatttgaccttctgtcaaaatacaatgggtgaccacatcagttaaggagccaccttccatgtattccataatgacccaaaggtcgccttttaaaacgtaagaatcaatgaaattaactatattagggtgtttgctacccttcatgaccagaatctcattgatgattagctccttttttggttgcttttcgagattcatttgcttaatggccactgagacattcgtacctatttcataagcagtataaacaccacctgatgcaccttgaccaatttttactaaattggcatattttgtacttgggtcaccgtctgagcaaatttcgttcaatttggcatatagttgttttttacgtctttccctttcctctctctttttctcatttaattctttagacaagcttcttgcttgagctggcttcgaagtaggtgtcgttaccgtctcttgcgccggcgcttttggcgattgagcaacttgctgtggtgtgtgagctgtggagatgattggagacgttttggatttggttggaggtattggtggtagtggctgctcctctttttttaaagtggcatttcttgatattgaggacctgtttgggctggtcctgttcggagttgtaggtgcatgagtctgcttcaagggcgaaacattggcggcagaattcatgacgggtgattttataattggagctgaagcggacgcagaagatgggggcttaggagccggtctacttggtatgaatttcccgtttgctgaactagaatctgtatttaaggttggagacatgacgtgattggacattggtgtacctgttctggaaccgtaattgtgcgaatcacttgtcgacggaggaaatttattgaatgagtttgcaggcggtgttgaaacttgaggacttcccggcaatcctgtggttgtgttgaaagtcttgaacattttatcttcaccgtttgtttccgtgacatcctgatagaatttgacaatatccatgactgcttgcatgttttgctgttgttctcttttggaaataccactagaagtcaacaatttttcccattcctccggcaaacctgtgtactcaccagtcttggagtccacgcccacatggtggatatgcttggcattgtatggcgtagatatcctcaaagcggtggttatagaagatgaggaagaattattggacgacgatgaggcccttttatcatcctgagaatttctctttatattctgtacaaaggacgtaaagacatctttcattcttagtgtaccactatttgaaccgcttttcctttttttcgaagaggaagaataatacgatttttctgtttgctttttaggtggagaggagttttttaaaggatttttcgaaggaaagctttttttcacagaaaccggtttactttttgcttcaggcttggacggtttaacttttggtttatgttgcttatgcttagggttcgaaagcgaatgggaagctgaattgatctgtcttggcgtggttgtcatcgatggtttagagataacgggagtggacactggtgtagcccttcgtatatcagtggagctcttattcgagtttactgtggaagatgcaactggctgctggtgcttcactgtcgcgttattttctatagtttctgtagaatctgttaacgacagttttgatagtaaagtgtcattaaactggtgatctgactcggacgcatttatggtagaaaatgtgttgtcagcagaatgatccggggttatattgctggtatttatgtttggagtgactgcttctagagatttggtttcatcgatgttagaatgaggactcatggatgaagacattccactgatgacagaggaggaagatactcgggtaaattgaataggatcatctagtgaaacgacattattgtcatcatcattggttgtctccgcgttcttcgcaggatccatggatttgtatccaccagcttcatgggcagcattagtgcctttttgtaaggcattgacgttcaaagttccagtggtccttggtaatcgtaatccatcgccgccatcgccattgccgcccatggccctttcattgtcattgctgataccgttatcaagactgtccttgtctggtagttccgatacagcagatggatcattgctcatttcttgtattagtcgaggatcttgtgggatatttaggatggggtgtgaggcagtgaagggaagaagtttgggttgcttgctacctcgctctaattgtacgtacggatgtatgtctttaagaaagtatgtaagtgtgtgtagtatgtgagtatctatgtaagcatgcgttgctaatgcgaatttacggatgcctctttttggtttcgtatttttcctctctggccaggtgactttctgaatttttcagctgccaaaagcggtagactttcgaattccctctcttggccgtgtttcgggccacgaggcgaaaattttttttttttaatcgaaaaaaaaaggaaaaaaagattaacgtttctttttcgttctatcgtcttctacgatatcgcatgtaacacaatgcagctatctgataatatggtcccagaatcgcaatagccgggcaggcacgctactagaaggcggttctggatagaattcaactttagatggcagactgaggcactgccgtaacacaaggctaagtagcgcagctgttgcggtccatcttgtgtcgcggtgagatcccacaatccatagacgagtacattagagtattgcggaccattcgcctgcgcttgcatccgggtgaggtacatgtataagtactttacccggcccaaaaaaactacggatacccgctcccggcttgccacgtgacctgccacagtgttcgtagtcacgtgctccttcagtcctcctaactctacgtacttcctggcagtgtctccaaggactatcaccagtacgtttgggcttgactgatccaggctccaatcgctttctactagctgttgcaaccgctcttcaaactgcatattgtatcctgctgctgctgttgttgcacccgttattgcacctgagcattaatatatgcgtatatgtatctatctatgtatatgtgtatgtgtaatatgtatacgtttatgttaatgcataaactgtaatgaaacgaatactcacccgcttgctctctctcacgtataacacacgcatactgccctattttcctgtttatctcggtaagaaaaggccgtgccgggtcagaaaagagtgcaagaaaaaaatcaattcggtaagtgaatccgagagatgaaatttgtatgtcgtaggtcactgctatatttgatggtaaataataatcagttctggcaagtgtacatacgctcgagagcctgattatcgcggggcacaaatacaggtgattcgagaaataaaaagtgagaaacgactcttttctcatgcagagacacgtttttgcgaggaatttcagacgtctttccttattgaggaacccttcccttaccaaaaggtttcagtcgtcagcatccggtgcggccaacacccctaacaataacgatgaggtgatgctgttgcaacagaaacttttgtatgatgaaattagatcagaattgaagtctctatctcaggtaccagaagatgaaatattacctgagttgaaaaagtcattagagcaagacaaactctctgacaaagaacagcagctggaggctgaattgagtgactttttcagaaattatgctctgttgaacaagttgtttgacagcaagacattagatggacaatcttctacaacgacagcagcagccacgccaaccaagccttaccctaaccttataccttcggccaatgacaaaccatattcctctcaagaacttttcttgcgtcaactaaaccattccatgcgtaccgctaaattgggtgccactatttcgaaggtttactatcctcataaggacattttctatccgcccctcccagaaaacattactgttgagagcttaatgtctgctggtgttcacttgggccagtctacctcactttggaggtcttccacacaatcctacatatacggtgaatataaaggtattcacataatagatctaaaccaaactttgtcctatttgaagagagccgccaaggtagtagagggcgtttcggaatccggtggcattatcctatttctgggtacaagacaaggccagaaaagagggctcgaggaagctgctaagaagacacatggttattatgtgtctaccagatggatcccgggtactttgacgaattctacagaaatttcaggtatctgggagaagcaggaaatcgactctaatgacaatcccaccgaaagagcgttatcaccgaatgaaacatcaaagcaggttaagcctgacttgctggtcgtattaaatcccacagaaaatagaaacgctttgttagaagcaattaaatcaagggtcccaactatcgcaatcatcgatactgactccgaaccttctttggtgacctaccctatcccaggtaacgatgattcattgagatctgtcaatttcttactaggagtcttggcgagagctggccaaagaggcttgcaaaatcgcttggccagaaataacgaaaaatgaacacttttattttcttttggcttgttaacctaaacttgtacatatgcccatatatccttaaatatatatatatagccaacccgaagacgctaaataaacgcatttttttttttttttacagaattattactttcgtacttgggtttatgcttcttataacaacaactatgagctataccatgttaacttggccttcatacaggggggaaatcatatgatgatacgtattctccttaagatacgtttattcacacttttccttagattcttcattttcagcgctctcatcagaatcactgtcacttctttcgtccttttggataccttgccatatcaatctgtacaagattctaagaattaaaaacagccaatacaggttaactaattgtaacgcagcaattagtacaaatacaattggcaacgaaatccaacatttgtattgttgtgtggcaaaattcaacacataattaccttcatgacggaattctgttaagactgaccataatattctgatattcacgacatggcgcagatagatccaaaagaacacgaacaagccgaacacaaagggagtaaatacagaattcagatagtttaatgtcttagacaaagaaaggaaaaaatctgacacatccatagtaatatagatagccaatcccattttggtaaaatggaaaacatatgatgaccaaattaataataatgtcacaatgtgatgaaaaaccaattccttgtaatcctttcttggcttttctaattgtagaacaagaacacaagcctgttgcgcccaaaatgccgcttgacccaagtaaaatatcttaaacaagaacggattggttataacaggatatgttctgtacattggttttgtcttgaacaaccacaaatcactatggtacataatataaagaccaaagggccctgaaactccgcaataaaatatggcatacatttgttctagcatacgcttttgacgatgctcggaagtaacatttaggtataccgtgaatggtcgaattacaacatccatcaaaaactcacgtaaaaatgtgaagaaaatcatgtagaaaaacacaaaactcaaatctttgataccttttgcatatgagtctgtgccatcaacttgatatgatatggctacgaacatgtgcagcgggtttgattctgttctattcccagataaaaagtacgcgctatacacgcatacaagtatgaagaatggtgtcaaccaactatgacggtaattcatttctctatatgaaaaccaaaccttccacagtaggtcactatcctttttagagtcaccagtcaaggctttcatcctttttttggcctcatttttagaggcagcactttcaggcatggctgcaaagccaggaactgtatcacctaaatcaattttacccacggaagagtttcgtcttcttgtttttgcattaacaactaacctatcgatagatttgtccgtagctgatgtcatgttgtcgttatttcttcagtttctctgtatcttggagttcactctcaacactgtctaatataccttgccactttagatagacaagcagtcagatcaattgagacaaccttacgaaatcgtttggcaaatatcttgaccttcttagtacagggctgcagttttccttgccttgtttgtcaagtgatagcgcgtaaaatgttgatgctgcaatttgcttttcccgctaaaaaaatggaattttttcatcgtttttcactacccctgggctgccctcggtcaagaaggatttcaaatggaagatgacgcattaggtaagtttaaagcgttaaattctctataaaagggatctctatttacctgtaatatactatcgatattagtcttgacggactggggtgtccctggtcataataccctaaaggaaaaacgactacgacctttgtcggtctagccgaaaggtgtttatatttatggaatcagcaagtgcaggaagatagcaggctctaagattgattcaaaagctaaaccctacattactgccgcagaacttcggtagcctttgtacgtaattatatacattattctaatggttaacctcatttaccgttattagtgattagttaagaaattcgaattacataaatgaaacgcaatggattctaactgttaaatataggggccatgcagaggcaatgcgtaaatctatctaaggaaaccgttgacaaaaatgtcatcatctgcgattaaaataaggaatgcactgttgaaggcaacagatcccaagttgagaagtgataactggcaatacattttagatgtttgcgatttggtgaaggaagatcccgaagataatggacaagaggttatgtctcttatagagaagaggctagaacaacaggatgctaacgtgatcttaagaaccctctctttgacggtatctttggcagaaaattgtggttcccgcttaagacaggaaattagttcaaaaaattttacctctttgttatatgcgctcatcgagagccattctgtacacattactctaaaaaaagcggtgactgatgttgtcaagcaactgtctgattcattcaaggatgacccatcattacgcgccatgggagatctatatgacaaaattaaaagaaaggctccatatttggtacagcctaatgtaccagagaagcataacatgagtacccaggcagacaactcagatgatgaggaattacaaaaagcactaaaaatgtctttgtttgagtacgaaaagcaaaaaaagctacaagaacaggaaaaagaaagtgccgaagtccttccgcagcaacagcagcagcatcagcagcagaatcaagctcctgctcacaaaataccggcacaaaccgttgtgagaagagttcgggctctatatgacttaaccacaaacgaaccggatgaattgtcctttaggaagggcgatgttattacagtgctggaacaagtatatagagattggtggaagggagctcttcgaggaaatatgggtatatttccattaaattatgtaacaccgattgttgagccatcgaaagaagaaattgagaaggaaaaaaataaggaagccatagtattctctcaaaaaactaccatagatcaacttcataattcgcttaatgcagcttctaaaacgggaaattcaaatgaagttttgcaagatcctcatattggagatatgtacggatctgtaacgcctttgagacctcaagttacgagaatgttaggtaaatatgctaaagaaaaagaagacatgttatccctgcgtcaagtcttagcaaatgcagaacgctcatataatcaactaatggatcgtgcagctaacgcacatatctcaccaccagttccaggccctgcactctacgcaggaatgactcatgctaataatactccagtaatgccacctcagaggcagagttaccaaagcaatgagtactcaccttacccttctaatttgccaatccaacatcctacgaatagcgcaaataataccccacaatacggttatgatcttggatattcagttgttagccaaccaccacctggttatgaacaatagcccttcaacttatatagcacctttacatatctttaatttttacgaagagcattttattcaacttttgtacctttaaagacggttttcagcccacacattttttgttattttacaccacacagtaaaactttcttgcttttttttcttgagactccccgaccattgttcgatattccaattttcgcaatcttcagaaaagggtatcctaacattctaaattaataataaagaagagaggctacaagcatttattagtgtgaagcatttaaagtaacttcaggaaataaacgcgcaaataaaccaaaaatgtccactgattctattgttaaagcctccaactggagattagtcgaagtcggccgtgtcgttttgatcaaaaagggtcaatccgcaggtaaattggctgctatcgttgaaattatcgaccaaaagaaggtatgttgaacctaaaacccaccgtggacaaactgaggaggaaattgtaaggaagagaaagtccccgtatgttcagggaccgccaacgacttcctgattcatgcctgaatagtgaaacatgttaaacaatgagtagatgctgaaatatgcaatgggacagagggccggagatgtttctattctttttttgcataaacaacagtgaaatttctacatattttgttactggcaaactccttccctggcagttaataactcccatacttaagaagataacttcagcacatgtagccatacctcctcaattgccaaataatcttttcctgttttcaaagtatttcaatttactaacaacttttatgaataattttttaaattattcgttataattactataggttttgattgatggtccaaaagctggtgtcccacgtcaagccatcaacttgggtcaagttgtcttaactccattgacctttgctctaccaagaggtgctagaactgctaccgtttctaagaagtgggctgctgctggtgtttgcgaaaagtgggctgcttcatcttgggctaagaagattgctcaacgtgaaagacgtgctgctttgactgactttgaaagattccaagttatggttttaagaaagcaaaagagatacactgtcaagaaggctttggctaaggcttaaaaaaagaagaataattctaaaatccataggtaagtactgaaagcaattttgcgttccgtcaatgcatattatatatattaatcttaaccatttatgtaaacaacatatcatttcattttgttctggccacattccctgttcctctcaatatagtgatgttttataagggatattctttgcggctccattataaatacactttaccatgagagtttcctcaccagctatattactcgcgccaactaccattcgacgcaaggaacaaaaaagcatctagataatagtagagaggtggtgatacaccctcaggttgctatgacgatatattctccgtaaattctttcttacgattattcctttagatcggcaagagatttgggcttgaggaagcgataaaattctttgttgacaaaactctcccttagtgcttgtgaaataaacatcaataatcatttttttatttttcgcgtttttaagataatgtcttaaccaattttctaagttcggaacacaaaacccaatgtttaatcatttttaataaacaatttagtatatatattattttaattttattaaattaattaaaattaaaagaattattagtcatgtgattaccatcctacttattatactaaatcgttttgtggatgtgtaattgttggagttcttcttatctactttttaacttgtgtgtaattagagctgtacattcaaggtaaggaatgtaatgcaccaatgattacctaaatcaaattcgaaatatgtatcagtatattataggaatgttaattcgctcgtgcgtactaatttttccgaggtcactcgcaaatccagaattctaaaggatgaaagtatattttctgaaatcgtcaacaaagaagggatgtgatatattcaaaatggaaagattcctccttctttcatttagaaataggaaactaaccagtaaattagaaacaaagaatggctctcaataaactaaagaatataccttctttaacaaacagttctcatagctcaattaacggcattgcatccaatgctgcaaattccaaaccaagcggagcagacacggatgatatcgatgagaatgatgaatctgggcaaagtattctattaaatattatttcccagctgaagccaggttgtgatttatctagaatcacacttccgacatttattctggaaaaaaaatcgatgttggagagaatcactaatcaattacaattcccagatgttcttttagaagcacactccaataaagacgggctgcaaaggttcgttaaagtggtagcatggtacctagcaggttggcacattgggcccagggctgtgaagaagcccctaaatcccattcttggagaacactttacagcttattgggatttgcctaacaagcaacaagccttttacattgcagaacaaacgagtcaccatcctcctgaatctgcgtatttttacatgattccagaatcgaatattagagttgatggagttgttgtgccaaaatcgaaatttttaggaaactcaagtgctgcaatgatggaggggttaactgtattgcaattccttgatatcaaggatgcaaatggtaaaccagagaaatatactctatcgcaaccaaatgtttacgcaaggggaattctgtttggcaagatgaggattgaattgggagatcacatggtcattatgggtcctaagtatcaagtggatattgagttcaaaacaaagggctttatttctggtacctatgatgcaattgaaggtacaattaaggattacgatggtaaggaatactaccaaattagtggtaagtggaatgatattatgtatatcaaagatttgagggaaaaaagctctaaaaagactgttctcttcgatactcatcagcattttcctctagctcctaaagtccgcccattggaggaacagggagaatacgaatcgagaaggctttggaagaaggttacggatgcgctggctgtacgtgaccatgaagtagctacagaagaaaagtttcagatagaaaaccgccaaagagagctggccaaaaagagggccgaagacggcgttgaatttcattcaaaactatttagaagggcagagccaggtgaggatttagattattatatttacaagcacatccctgaagggaccgacaagcatgaagaacagatcaggagcattttggaaactgccccgattttaccaggacagacattcactgaaaaattttctattccggcttataaaaagcatggaatccaaaagaattaggcttctcattctattttaattatactagtacgatttctcactctgtaatttaatatcagtgtaatatgcacctagttatgggtagtttttgctaacgttacgagccgcgaaactgtcctcaatcttcaccactacctctaatgactgaagaatgctatgcgatataacgctgtcgcactttgaatatatacttatatttacatagttttcaagtgcgtattactattgcaaagtagtattttgtcacgtgattttgatccaattaaaactaaatatggttcaacccgttgtttccgcatcaaaaaaccataccatttatcaaggggacgggatatatcacataacagtttgaatgcataatttgttatagatatcttctggaataatcttcacagcaaaagcgcaagtcgaataatatatcgataaatacaatccataagacttaaaactaacctcaatggcggtaagtatcctatcatattatgtgagctagaaccgaattagtatactaacatttataatacagtacacttctcatctgtcttcaaaaactggtctacatttcggtagactttctttaagaagtttaacagcttatgctccgaatttaatgttatggggtggtgctagcatgcttgggctatttgtattcacagaaggatggcctaagtttcaagatacgctatacaaaaagattccgttgttaggacctacattggaagatcatactccaccagaagataaacctaattgaagccaaaacatccaaccggctgagtgattttatttatttgttttacgttcttttctatcattttggaagaggaattaatgcaaaacacatttgtatttttttttatttttgcatattctcgattatctatacatatttttaaactggatcataaaaggtataaaaagtaattgatccatacaacatttttaaatatttacccctctattttcagaatatttactaaaacatcagttatcaaagagtagggaaaagttaactacaggtttgtttttcctctttttatgtatcttttgagctttgtaattgggcagcacatctctatgttttcagggaaacctatttcattcgccattttgatgatttaggcatacgccaatgctaacgccgtttcttgtaatttctattttttcaaatggagtactttaccttcctcccgcagctggaactttcaacccgccggaagaaaagaccaaataatattataattaatatttaaaacccttgaaagatcatctcttaaaataacctcaaatagtgtaaatccaagcacttgaaaactttgccgttttagaactcgttaaatcctttaagaaggacataacagccagagtaacaaaatagtttgctcgtgaaagcaccagtgaaatttctcgaggtaactgctaaaataaacacagttcttaagtatgacgcgagatagcccagattctaacgacagctataagcatataaacaagaatactacacaaaaaacctcgtttgatagaaattcattcgattatattgtacgatcgggattagctggaggtatatcaggttcatgtgcgaaaacactaatcgcacccttagatagaataaaaattttatttcaaacatcaaatccgcactacacaaagtacacaggctcactaataggattagtagaggcagccaagcatatatggatcaatgatggggtaagggggttttttcaaggccattcagcaacccttttaaggatttttccatatgctgctgtcaaatttgttgcttatgaacagattaggaataccttgattccctcaaaagaatttgagtcacattggagaaggttggtgagtggttcactggcaggattatgcagtgttttcataacatatccgttagatctcgtgagggttaggttagcatatgaaacagaacataagagagtaaagctaggaagaataatcaagaaaatatataaggaaccagcttcagccacgctaatcaaaaatgattatattcctaactggttttgtcattggtgtaatttttataggggttatgttccaactgtacttggcatgataccatatgcaggtgtttccttttttgctcacgatttacttcatgatgtgctgaagagtcctttctttgccccttattcagtattagaactttcagaagatgatgaattggaaagagtacagaaaaagcagagaaggcctttgcgtacgtgggctgaattgatctctggtggtctagctggtatggcctcccaaacggcagcatatccatttgaaattattaggagaaggctccaagtaagtgcactgtcaccaaaaactatgtatgatcataaatttcaatcgatatctgaaattgctcacataatatttaaagaacgtggagtacgtggattttttgttggtctaagcataggttatattaaagtaacacctatggttgcatgtagttttttcgtctatgaaagaatgaaatggaattttggcatttaattatgcatcgcattttgttttatttgcatatcgcaatgaaaccgtctattcgggttctataggaagtacactgcattacactatgatgtaaatagtattaataaatctatattcaatatgttgtatttttgatctcccattgctaagaatagtactcctcctctttaaaaagcctctcaataaaatcgagaacttcttcagagtatacagctgtcagtttctcaccatccagcaaaatccttttttcgtgaatttcttgctcttctttcgtcatcagaacaacattggttaaggagatttctttgttagcttcccattttgttagagctagtttcgtagagtatccgctaataggagacttgcctctaaacatttcttcaactatataaccgacctcttctaatccaagcaatgacgatcgctccttattttcattcaaccgcgccatctgcttttggaaagtctctaggatgctgtcataaaactttaacctatttttgacctcattttctttcattggatagcctgacactttggttaaaatccatgtcgcaatactcaaaccaaaaataccaggcatggtccctaattccggtaaatgtctgagagcctcatctctgacagcattgattgcacgatgttcgcaatctataggagagagtatgtcgtctcggcgtggatcgagcatttcattactaaaaacaacggaaatccccgtggcgatacccctcttcctcaattttcttcttacacaacgagatatagggtcaaattctgtcatggatatgtcatttatactcacacgggtaggatctgatttcgtggcaacacccatggaagaaataacatctattttattgtgatgggcgtactctaataggtctaccttagattctagattatctagacaatccacgataaaagttggggactcaccgtctgcaaaaattaaatcgtgtgagttttctttagtccaggccttggcccttgcttttatttcagaccaaggagcaattttagacaagtgttctttcaagcattgaactttgggctttccaatatctgataaaactgcgcaacagtgggtattcaaagagtcgatagatatgttttctggatctataatcataattttctgacagcctgaacgaattaacattgtgcatacccacgatcccacttctccagctccgactataactatatactgttctttgatcttcctcataccttcttcgccaagaaatgcatagttacgagccaattgttccctaaataagtggtcatcatattgacgaggtcgcgatacggttttattcttattagccgcacatgaaagtttgtattctttccatacacttttggcaagttgggttgaaaacaccgatataagagctgtagtagcaattaacttccacgtattatttgccatttgttcgttctgctatcctaactaattgcagtattaatactttactaacgctagaaaattttttcatagtcttgtctcttttcgctactgcataaaatatgaaaaagaaatcaaaaaacctgacagcaaaatgtaaagtaagatacgggcatttagcgtgtcactgctgaagataacgtaagactaaaaaaatttcaagattaattcccaacctatatatatatatatatatatatatactgtttagatcaagtatatcttcctgctaaataattaatatgctcgtatgtagaaaacaaaaaagaggtcttttctcttttttctcccgttacttttttccctgaatgcaataacctttccattaaatgagcagcaatggataggcgatttatcacctaaaattctcatcttttttggaaggacacaataacaattgtcagtttatgttgaatgccttctctccatgtttcaatgccagtatattcctgacatctgttgaatacctcatagcctccaagaaaggtaacaggttcagtaagtccgtatcagttggatcacttatccatccttctacttgaatagcgttatctacattcattgcgtaacttaccgggctgttatctataataatgacatcatccaaagaagaggagctgcctttcccgttttcttcggagtccttgacaatgctcaaatctttaatgtatccaacaccatcccttagaacgcaatcagaacggtaatatctttttgaaaaactggatgggaaggagctttctaaccaatctatcacaggatcagcgtattctttcatggatgctgtaaaaatgataaggtcgtaccatttgctaacttttgtcaaaaataaatcacagtaaggcctcttgtgaataaagtatagtgtacgaattccgctcaatccaaacttcacttccaccaagtgaccctgagaagaattactatgcgttgtacttcgagaagccgagtgaattaaggtctcatcgagatctataaccagtttctttttcttttgtgtgttaagcacggatttaggtatcagcttctttggaaataagaaccttcccattcgttttgtaccaaatacggtattagaacttgaatgattagaaagtgatagttctgatttggaataacttcttggccttgatttgacagattgagctctaagtaatgagcctttaacattatccctttgtagaattatctcatcactggcatttaagtcatcctcaactgcctcgggaatcgtatttagattgcaatttttaggatttgttttctcgctagaatcgttaatattgcttgaactgacaggcagctcattctcactagcatttgaacccctgtttctcttatcggtgtgttttacacgacgctcgatgacacttagtgggaaggtaaaaacaaaccataaagacatcaagggcttgattatcagataatacggaagaaaaagtagtagtgcccacaaaattgacgctattttctctattaggatggaacgtaaagcttttggttttttaggaacagaatttttgcgctcttgattttgatcagattcttttaagtggcttgaggagtggtcgtactgttggtccacctcactaacgcaatcattttcgctgtggctagtatatttgttcgaaacttcctttgaagggcctagtagatcttgattctttgtcacctcaacattgatttttttttgtttctttgtagttattaaatgatttgagaaatattttagggcattcattcaattaatgaaacaatgtccagaaattaacaacaataaagaaaagtgagaataggatgcaaaataggttctatatatcccgagtatttaccagggagaagaattcgagataataccctgtccttacgtagaagaatcaattgttttcaagagtttttcttctaaaaaagtgtctggaccttttttttctcatgcgattttattacccttgtttttcaattgaaaacccggaacgatttaacgagatcaagaactgttgaacaaaatggctttttcatttggcattccatcatagactctaatggagaagaaaaatagtaattttttctggtgctgctgctccttcttgcatcttcggaaacagaatttacgtatctaaacactactttaattatacagttccttcatataataccaatttttttaaggttttgctggatgattagatcggtgactgcactcaatacgaacttcatagtttgggtatcggtagcgcaggttcgtttcacgtagattggtttgtttgtcttattcaagctcaaaaatatcttctcaaaatattttagacccgcttctgcatcgccgacacgtccctggtaatcaggaaagtactttcttatgggcatgctttttaccttttcctcgaacaaatcaattttatttaaaaacaaaataaacggtgtatctttgaaccacttagagttcaataacgtgtcaaatagcattattgattcatgcattctgttcactctttcatcctcaaacaacatctggtcgtattcactcattgctaaaacaaataaaactgctgtaattccttcgaaacaatgaatccacttcttacgttcagaacgctgcccaccagcgtcgagaaccttgaatttggacgagccgatgttaaattcggtttctgtaatgcctgtagtctttatacggcccttcaaaatgtcttcatccgtacagacataattcggactagcaaatttctcaatgttatcaaagtagtatgcagctgagccctccaattgaaactcattagaacgtgcaaaacactgctttatacctttgtcgttattccaaagttgctttattgccttagcaatgtcttcgtgaataagatttcgtctattttgtccttgaatttcccttgatgtttttctaacaaacatctggtcatcgccttcttggttcaagtccttgcaaatatcctgtaggttaattctactactgttgtttctatcagcatcctcattttgcgtcaccgtttcagcatctctgtcagtgtcacttttgacattagaaatatttccgtcttcatcgaaagcagcttttgctcgtccggtactctgaacacgcctcctagtttcatacctttctgagtacttcagtacataatcatttagaaaatcagaaccaccggcaacactggcgttgatataatctaaagctttagcctttagcagtattctcttgcatgcaaacaaatctttattgttgatcggatcatcacagtcaagttgaatacctagttttctggcctgaataatcaaaattttcattgattgtatggcatctgcccatatcacttgagcatactgtaacctttcttgatgggagaaaccgccttgatgtaataattttaattgttttaaaaccgttgatttacctgactcaccggcacctaatagtaacagttttatttcattcttgtcacgttgtttctccagctgcaacgattgctcgatgacatcattggctcttttgttctgtagaaaaggatcactttcgtctcctattgtttgcgtactcactgtacaccccattatttcctaccttaatatatcaatttatacacctctggattattgatgtgatgctaaaataccaatttacagtatgaatagcttctactcagtttggtcttagaaatggtcaaaaatgttagaaacggagtgacaagaaaaaatgaataacagatcaaaagattacgaataatataaaacgtaaagaaattggtggaattctactatcctcttcattttagactattttttaatatttccctttaaggaaaacaatatgtaacaaaaaaatttctgctctccatttaattgcatttctacaaggaagaatacgcagaaggacgcgcagagccctaaattgatgtgctttttaacatgctgagccgagtgcgtttcggtgaaataacacgaagatgcgtttcaaattgaaactagtcagtgttatctgcatgaaaagggaatatcgttatgcattcagttttccaatagagacatttttttttttttagattcggcttgctttatccacctatgatcttgttttcaaacaacatgtgccatgtaagataaaaaggtaaagatgaagtacagaaaagagtataatgttacttgtatatacaggatatgaatcaataatactaattataacgttgagtcgagtaaaacagcttatggatttcttttcttattttcgtcttatcattactgctttaatgcacatttctaaaacttaccggctgcgttaaatgattggcccattttctgcatgttttcaccgacttgaacattggtctcaaaatatttggccacacatctgtctaggcacgaagattcattcttattcagctcaccctcggaataagaagtattgatacattttttataacagttattaaccaatttattgaacatgtctgtgaccaaatctagttcagcttccgcagcttgaatcttttgttgagatgataattgaggctgaccaccaccgaaacctaagaaagacatgtttttctaagtatgatagttccttcttttgcttgtttatctgttaaaagacatgagaggggaacgaggagagtaatagttctttagagagcttgctcttgtacgttcactgccagctctctcgctgaaaaaattaaagaaaaaaaatgtccgatagcttcagagggtgatcatcagctacgaattgggaaatcaatgcaaaaaatgcttccaatcggatttgaaccgatgatctccacattactagtgtggcgccttaccaacttggccatagaagctctaatagtgataggacccagattatatttagtgacttgttgataaatgttttaaaatattaccttcgtgtcgttatcgttactgaggaaagatttgcaaaaaataattacatacttgggctcttctgaacgaacaagttaaccaaaaaggtgtatattacttcctcttgttttgtttccgggctaatgcttacctttcctttgtttccaatgttcttctttaacaccaaaacatactatttgagaaatgggtgaatgttgagataattgttgggattccatttttgataaaggctataatattaggtatacagaatatactagaagttctcctcgaggatataggaatcctcaaaatggaatctatatttctatttactaatatcacgattattcctcattccgttttatatgtttcattatcctattacattatcaatccttgcacttcagcttcctctaacatcgatgacagcttctcataacttatgtcatcatcttaacaccgtatatgataatatattgataatataactattagttgatagacgatagtggatttttattccaacactatttgaggtttggcaactgttgaaattattgttaggacattgttaaaaaaggttcttttattaggtctacaaaaacaaaaaaagttttttcacgaggacagcgtgaatcacaaaggtgaggtcaatagttttacataataataaataacgttttttttttcttcctttcatgtgttgcctttctttatccaattacattgtcagcccttacatttcagtgcctattgaatttgttgaccacttcccatcagcaataccatcctcttacgcaatatatgataatatacccgcgacataaatattaggttaaaaacagacggcaaaatgtgccttgggcggcaaaatcatgagaagcgcacatgtcgtgatatcaatagcacggaattccagaagagagaaaataccagcacttataacaaatgatcacagtaagcgtgaaaaagaagagcctgttgctacaaagaacattgaaatgataaaatagtgaaagaattccaatgaatgggaatatggatggcattttggcaagaaattgggcggtaaattttcgtaaagctgattgatggtcagcaaaactctcttcagaagaaccagagaaatgggccaattctcacgaagaaaattcttatagtgtgtaagcataggtaacgatcacgataccattaattacctgcagtcaagaacgagatttattaactgaagaaaaaaaacagaccatttcccacaaaaattgtcgacgtttaacttgtgactgatagaaagttataaagtaagctattaatggaggttctgaacgcatgacatgctcctctaagggctagaatagagattataatgttatttgaagattgaaagtctgttacccttcttagagtcatccattcgaacgaagagtatctttttttagaattcttatcattttttttttctcttcacattccaatacgggcaaaaagcgagaaaaacgatgattaataaatgaaaaacagtgattaatcatccgacaaacagacaaatgcaagagagcaaaaagttggggaagtaaggaaatccattatcatgcctatcttatcactatcttcaacacggaacagcgtgttaacaaggatatatgactaccttaaagcattagtgcagcaagtgattgtgcccaatgtggaagacgacaaatcttcgaaaagtactcctttcgaaaagttagaacctgcgaaacagaaccatccacagaaagactgctgtgctaccgaaaaggacgatctggttgacgtgagcgaattatttcccaaacagaacaacaaacaattgagtctaacatcaaaatcttcagttgtaccctgtgctttaaatttggataacctagaaacacctttctcaattaaaattgataataatggtgcagtcactacacagttgaacttggacgaaccgattttacggggccctagccgcggcgagccagcaaagttacagaatgacttgataagttctcccccgctagaggaatcctatatcaataatgaccagtacaaagctcttttcccctctaatttccttccaatcacgcccgtaagtagcgtaatcactcctgcatcgaagaaaagtattgatgaatctcccctatccgatgaggttcaaggaattgctgatgagtcatccgaaactttaccatatatatgtcactattgcgatgctaggttccgaatcagaggttacttaacacgacacataaaaaagcatgcgaaaaggaaggcctatcactgtccattttttgataatagcatttcgcaagaattgcgatgccatacttctggggggtttagcagaagagatacctacaaaacacatttgaaatctagacatttcacttacccagaaggtgttaagcctcaggaccgtaataaatcacctggagtgtgcactcaatgtggggaacactttagcactagtgagagctgggtggaaaaccacattgaggctgggagttgcaaaggtttaccagaaggctattcagagggaatacgagagaagaaaaagacgtctaaaatgaaaatgataaagacttcggatggccaaacaaggttcatctcatccgacgaaagtgtttccgaaccagctttacaaaataagaattgtatagaagcgacagtaatgcagtccaaggaacgccctaatgacaagatcataccaaccaaaaccgaaaaaaacgattttggaataggcactcaatggtttgaacgcaaacaaatatcaagacctacacaaactacacaatcaagaggacctacagaagtccaaaatctcaaagagtggtcaataatatctcccccaattttgtcaccccaaaatgcatcttctgtaccacaagagtatcaatcatcaagatacacattgcatatggattctccagcattatcctctgcctcctcagcgctatctccactttcaggcgatccaataacaactacagaaacaaataagtcatacccattggattcagagcaatcgttgttggagccagacaaaaccgaggaggacgcaatcaatcagtcaaaggaaagcaatatgatttccattaatgagatgttacagaagcaaatggactttgaacttctgggtgagaatcatttgaaggagactcaagattatctggccctttacaaaaaagcttatgggatagaattttaaggttaattcaggtattatttttatggcggtttcaggtattttacgtaatattattattatatcatttttgtagcaatatattatttttagcggtgctttataaaacaatggatactaaggatggttcaattcactcatcatttggatttatcactataaaaagcagtaatgaatcttatatacatttatttcagtgaatccatatttaagagagcttcctcagtgacccctccccaaaactcctctcctcctgggccctctcttgattaatttaaattgcaaaaagatttacaagtttgcgaaaagactgctttatttccgcttggcctgtgagctgtgtgttctctcttctaatccagtaggcatgttgcataaataaaccttatatttgatgttgttttagaaatgtaatctatatataatttcgtagtataaatatttataaataaagaagtgaaaccataccactcataaataatgcgggatggttgtccaagtttgaaagtaactaaagaacataactcgatgtcatatcaaacgtactggcaaataaaataaatcattggagatggatgagtgtggcgataaggcccacgtgaatgtacaacttctctctttttctgttttttttttttttctcagttacaaaccttagatcttttgttctggatttctcttttcccagatgatcttggctggaccggttggaagagtaaccatagatgtaaagtcaggaggtggaacggtcttaccctctgggtaatgccattttaatgttctgataaaaatggacattagaacacctagctgacagtaagcaaagtgttcaccgatacatctgtgtctaccaccaccgaaaggtaagtatggagagctgacacccttagaaatggcaccgaaaccgtaatcgacttcttcaccgacggaataagaggaggcagaatctttgttccaacggtgaatgttgaattggtgagcattagggaagtattcgtctcttaaatgagtgtaacctggagaaaccaaaacgtgataacctgctgggatgacataagaagtgtttggaacgtgcatatctttcataaccttacggaacaaagagtgcaatggatggtgcattcttagagtttccttaatagtttggttcaacaatggcatttcttgtaataaatcgtaggtcaattccttcttaccaccatccaaaacacgcatttgttcttcgtacaattcttgttggacatctggtctttcagccaagtgcaacaaaatccaagcagaagtggcagcagaagtatgttgaccacccattaagacaccaattaacaagttagcgatttcttgatcagtcatcttcacaccatccttgtaggtagagttcttcatcaaggaatcgatcaaatctctgtcttgaatgtcgttgttctttcttctttccttaatcaaagacatgtaagtaccggagatagccttttgagcgtgatctctctttctatagtgttccaatggtaagttagggaagacgaagttgattggagtgaaacccttatccaaatcactgtacaagtaagcaaaatcggtatccaattttgctctcatttccttacccaataatgatcttgaagcggtgaaaatagtcatttcaggttgagtaaccatcacgtcaatagtaccagtagttctttcattcaaacggaagtttttggagtctctgaagtacttgtacacttcttcagcaatcaatggaacgtagctcttgaaggcttctttggttagagcacccttaacaaacttcttttgctccatcaatctagaatttggacaatcgtaaataacacctttaccgaaaactggagtagtcaaatgagcgtaagcagcttctgctgaaacatctgccaacttagcgttgaagacaaattcgtgaccctttggtcctaaatacacagtcatgactcttcctaacaaaacgaatgaaaaaatatcaccgtatttcttttgacattcttcgaaaaactcgtatggcttcataccgtacacaacagcactaccgacccatggaatccagtaaaacactagaggtggacggtcctttctcaaagaatatagtaattgccatacaatattgtaaatgaaaggaattattatgatcaaagagattctttgggccaatggtaaagccaagaaatgacttaaaccaatgtttacgtattccaatgcctctccaacgattgacttggtagcagacatccttgtattactcgtttgttctgtttctattcaagcctgctgcaattgtgaaggaaaaaaaattttttctggaaactattaattaatataatgaaaaattattacttcctatcgaaaatacacacgctgaacgatactgcttatcaatctttttataaataatttaccaataacgaaaagggaaaaaggaaaagggaaaaaaaaaaagacattgaaagagagaattaagagggaataagaaaactaagggaaaatacgctatcttatataatgaatacacatggagggcaatttttagaggcttttcgaatacatgcgagtacgtaaacgtcgttaactcgtggagatgcacaataggatgtgctcataccaagaaaaaaaaaaaattcaggcataaaatcgatgtctcctgcaagatacctaccacacttattgtgttctgcaagagactattgtcatctgaaaagcgattatcttgaaatcttagtttcgtttcgtttcgtttagggccagcgcttcgtttgtctcgtttttcgtggattatcggcctttaagattgtccaacccggcaaatcttgcacgcacattgtatgtgcgctgctcgtatagtatccacttcgtgtgacattactataatcgtacggcttagtcgggaataaaggctggcctcattttcgtacagagacattttgccggaaatttcgtattttgctgtgcccccggtaattcccgggcgcggcacaaaacctctctaaacaaccgcccattgttgcaattgttcgtctgtacgggacaggcggcgatcataacgtcgcacggtgcacagcaattgccgttttcggagatctccctgagtaagcagtcgtttacgaccttaatggctttacaattatcggttggaacaataacaagaacaattggttctctgcctggtggtgagttaatctggtgggaatgtagtgcacaggcgcgagtaacgtaggaagcgagagagaacaaggaaaaagaaaaagtggaggaaggttggttgtattgtctttttcggttcttttcttttctttttttctttttttacgatgcatgtatatgtattttaatagtaaaatatattattaaataggggagtgtggttgtgtgatttagtagagtagttagaataaaaacgacacagtggaaaaaaaaaggtattttctttctttctttcttcagatcttgccagcatcgaatcttctggatgcttctttccagttgaccacattccaaatggctttgaagtagtcggctttcttgttttggtactgcaagtagtaggcgtgttcccaggcgtcaatggcaactagaggaactagtgggcctgtgacggtatcctggttgtaggtttgaacaacgtccagcttgcctccattagagaggtttttcacaatgaaggcccatccggagccctgcacgcctgctagctttgtgttggtcaacttaatcagctcgtccagactgccaaactgctcgtcgattgcctttgccaaagcgccggtgggtggttcaccaccgccctgcgactctggagccaggttttcccagaatagacagtggtttgtgaaaccaccgccatggaacttgatgttttgttggatagcaatcatttttcttgcgtttgcgggagagggctccttggccagaagatctgagagttcttggaattggtcaacagcagtgttgaatccgttcacataagtttgatggtgcttggtgtaatgcaattcgttgatttgaccggagatataaggttccaatgcaccgaagtcccacttcaagtctggcaaggtgactttggttctccttgctgtggtggagagcaatgacaaaccacccttcttggttaaattagcagctgctgttttcgcgaacatcctggtacgtttttaggaggtatagttatcaattggggtttcgttcctgtagcagcaagtgaaaagcaatcgctgtagctagcttgtatattttggggatgcaacgctcttatatacaagttatagcttcttcatcaggggtgtctgctacggtcgcggaaatttttcggcacatccctacttttttttttgcgaagctagtggttcggcctgtgttattggtccaggtttaaggtcgcgccaacaatgataatagcaattagtaatcagctcaacctcaagtagaatactacacgtgcaatcggtagcatgcgcaagggcaaacaggatagacgccaagagagaaagagaaagagagagagagagagaaaaaaaaaaaagaaatatatagatttaggtattcgttaaatatatacacattaaatggcctcagaaattttaaatatataaataaataagctcttatatgtacaaatttgtgcatatacttttcttgacctttttactcctcggcttgattaagaaaggatggtggcgtcgaaatataactttggatccaaacttgagatttccgcagaggttgcttcgccatcaaggagaatctcagccattaatttacctgttgctggcgcattgttaataccccaacaagaatgtccacttgcaatataaagatccttgacatttgtctcaccaattaagggaccagaacttgtaggaacgtttaaaactggcaaaaaacaggcttgtttccgcaagagatggccctttgatagagttggcgataatttggatacgtaatggtacaattcatcacacttctccgaaactacctccacatcgtccgaactttcaggtatattgactaaagtgtcgccttcgccgcacacataaacttcatcttttctagcatacatttcaggggagaaaaattcacggtcgttaacttttagttcagcaagaatagcgtaaggtgaaactgtcttttcactaggcttaatggtgacagagtgggctctcaatccagaaattggacaatcttttagaatcttggaagtccagggtcccatactcaaaacaatctgctggatgtcattgatttcaatgggcttcgcgttctcatcgttgaagattgtacccagcttaatgtctggattttctgcatgccctctgctatttctgcgattcttgacgacagatggaaggtacttaagagaatgaacacaatccatctcgtcacactttagcccaactaccttacctaggagaagatcgacagcacctgtttccattgccttcgataagatgaaatgggtgaatttatagggatgaagctgcgctgtggtatcagtaccacctagtgatgaccaatcattaaccaattctcttcttatccaatctaaatcagcaggcaaaggattatggatattagtctctctcagttgctccacgggacttacagagtcaagatcagatgcgctatttgtgtggcttctcatgcgctcatttgttagagagtgtaaactgggtactgagctagaaacatgaatgtctgatccttcttcctcgttactagcggagtcgtttttcaaagaagagcccgaagaactcaaagatgaattagagtccccgatgttaaacttgttggatatgtagcccggtctcttctttggaggagggacattcagattatatgccttcttgctcagtctttcgtagttttcaatgacttcttcgcgaacatctgcttctaaggacacagtcgtcaatcttctgtagtcccagttgttttctccatcatattcatcactcaactcctgatgtagctggaaacttaaaggtacgatttggtgagggaaagcccaagatgcaagcaagccacctgctttaccagaagcccctccagcaatgcgcctcgattcaatgatggtaatatgatgcgtcgaagggctgaaacttggatgctgggtcaagtagtaagcagtacagcaaccgatgataccgccacctacaatgacaatatgttttttcccttcgctgttctttgaagggtacgtttgaaacggtgggtgcataaaatcttcacccatttataaacactattccttctgttgcttggttaaaatgctattgatacttagatggtgtattggagagcacgaaaatcttttgctgagtgacttgaactatcaaacagaattacttgttggctgattttttttaagtcttgatttaacaatagaaaaaaaaaaaaaaaaaaaaggaacaatataacttttgtagtacgtgtgccaggttacagatatggtttcacttctatgtcgtgcttttttcattcatacgtaatcttatgcatgtaggggatagacgcacaaaagcaccaaggctgcatgtattgataaattggcttacacgattccagctaaggggactcggacggaaccgtctcatattatacgttcagtgaatatttttcacggaagaatggaaagggcctcgaaagacgttaatgcatccgtacacctacatctttacattttttgctgttgcacctacactgtttttttttttttcaccttatgagtcctgtatttcttgaaagagccgataacaatattccaggtggagtcccgaggcagaatcaaggctgcggagagaagttcctctcaaactaatgggagtgatccgctcagttctcccatcacgacagaactgtctgagacaaagtctttccagcagagtccgcctacgctcttgctgcagagattcgcccgaaggcaggtttcctgaaattcttttcactagtaaagtgttcgttcatgtaaaacatactgccgtagttttgagctaaaattaaagatatattagatttttagaatttcttagatagtctcaacgtgttaaaacaaaagcataaccaaagaaaaaaatggctaagttcttgaaagctggtaaagttggtacgtatcattttcagtttttggacatcaacaaaaaaccgtgcaactgtggtattagaaatccaagttattagcagttgatgttgtataatttgagtttgaattcgagtattgtatcttcatatgggagtagggaggaaaaagcgtggagatgttagatctgggaaaaaacctttaaatttgaatgatagcttattaatagaaatattggacaaaaagatgaatgatttaggagcgaaactaacgattattcatattcattgagctatacgaggcagtggaagggttatcaaaaagttgtaatttaaaagaaaaaagcatcaatagccaccaaataagatggtgaaagttccgcgatatatttgctaagaccataggcacatgtacgcaggcgaccagggccttttatttactgtagttctttccatgccctattaaaaattcgtgggcctatgataatttttctctccctagtattgaagaacaaaattgagaattcgccaaactttaagaagggttcacatttactaactatttcttttccttcctttttttacacagctgtcgttgtccgtggtcgttacgccggtaagaaggttgttatcgttaaaccacatgatgaaggttccaagtctcacccatttggtcacgctttggttgccggtattgaaagatacccattgaaggtcaccaagaagcacggtgccaagaaggttgctaagagaaccaagatcaagcctttcatcaaggtcgtcaactacaaccatttattgccaaccagatacactttagatgttgaagctttcaaatccgttgtttctactgaaactttcgaacaaccttcccaacgtgaagaagctaagaaagtcgtcaagaaggctttcgaagaaagacaccaagctggtaagaaccaatggttcttctctaagttgagattttaagagaattgcattatggtcaaccaaaaatcaaaaaattattagtaatatcaacatatgtatatttaatgtatgtaaacaatgattaaatattaataaaatatatctacatataagtatacgcaaatggggtttttcttcaaaaaaattgtttgctggtgttttcaaccttaacgacaaaacgaatcataacgcggtaaaggggaacgataatatataatggaagcattaagcaaacagctttgtaatacgttttacagacactgaacaagacaagattttaaacagcaatgattataaggcgcttattttcaatttcaaatcgctcattcttcttgaagaaacctcaatttgatgtaaaaaaaataatagagatgattcctcagtaccaaacttctatccagaatagagagctgatagaggcggatagtattatacgaagcttacaactgttgggtgaacggtatcaaaatataaaagagattgataaagttattgcggatattcaaatacagaggaaatcaattgaggctcaaatcaaaaaggataaaacaaaaattacggaatactcagctgcgctgaaggccctgaaagaacagtacaacgatcaaaatagcaaatcgtcggagctgaaaaagaaaatcttggagacctgcaaatcacttccaaataccttggatcctacggtcccattagatgccccacagattgaacaatggataaaccctttaaaaacacataaaacttcagaagctcaggcgcatgttgatatcatgcttaaaaagaatatgttagacctacagactgcctcgaacgttacaggaatgtcatggtactatctattgaatgacggagcacgtctcgaacaagcattggtagcatatgcattgaaaaaggcaaacgaaaatgggttttcaagctgcgtaccgccaagcatcacgaagaaggagttaatagatgcatgtggatttaatccaagagatatgaataatgaaaggcaaatttacgctcttcaagacaccaatttaggattggtggctaccgcggagatacctttggcaggtctaggggcaaacaaagttctagagttaaactcgggagaatgttctaagaaactagttggagtaagtagatgttacagagctgaggcaggtgccaggggaaaagatacgaaaggtctctatcgcgttcatgagtttactaaagtagaattattttgctggagcaagccagaaaccagtgcaaaggtccttgaggaaataaagcaatttcagatttctgtagttgaggaattaggaataccggccaaagtactaaatatgccatcaaacgatcttggtaatcccgctttcaagaaatacgacatcgaagcttggatgccaggaagggggaaatttggcgagataagtagtgcctccaattgtaccgatttccaaagtagaagattaaatacaaagtacagggacgataacacaggaaagctagaatatgtgcacacgctgaatggcacagcaatggctatcccaagagtgatagtagcactagtagaaaatttctatgacccaagcaccggtaagatatctgttcctgaatgtttgagggagtttatgaatggccaacgatacatttaataagtaagaaaatcttgtaaatatgtaatcttatgttaaccgtagcatcattgtgttggacgaaatcctctgtgatgttctgtgtgattgaaattgtatggtattttcgatcatacgagtatttttcctaaagatgaaagagaactcgattcctaaacagttgtttgtagggcataacgttgtatcgtaaatacttaccatacgcttaggtatattcctttagatttccgtaacacctttcagttttactattccgcgtggcgaggtaaagatcataaaaatacaagtttgttatagcatttcctgcaaataattgctgtaactagtggcgaaaaggtcatagaattattcgcctaaattatgttgttgttagcattaagtgatgcacatattcctgatagagcaactgtatgtgttattctcctttcttctctggttagctgtagtggaacctataacggccattgcgccacaacttcctttaacattaatactaacatattgataacgacttcaattgcaagtaggatttacctgtaaaattcaaaaaattactaagcgttcctgataaaatatctcaggtcgctttattaggtaatagtacaaagtcttatgactttttgaaatttgtcaatcagatatctaacaatataacaatcgtaagaggagaatttgataatgggcacttaccaagcacgaagaaagataaagcatcagataactctagaccgatggaagaaattcctatgaatagtataataaggcaaggtgctttgaaaatcggctgttgtagcggttataccgttgtgccaaagaacgaccccttatctttgttagcattggcacgccagttggatgtagacattttattgtggggtggtactcataacgttgaagcttataccttagagggaaaatttttcgttaatccaggtagctgtacgggtgcttttaatacagattggccaattgtctttgatgttgaggatagcgatgaagctgtgacatcagaggtggacaagccgactaaggagaatcagtcggaggatgacgatgccaagggtggatcaacaggaaaggaacaacctgggtcttacacgcctaaagaaggcactgctggggaacgtgagaatgagaatgaaagcaacgttaagcctgaaaaccaatttaaggaagacgaggttgatatgtcagattcggatataaatgggtctaattcaccaagtttctgcctcttggatattcaaggcaatacctgcacgttatacatttatttatacgttaatggagaagtgaaggtcgataaagtggtttatgaaaaggaatagggtagccattttcatttttatgcatttctatgatgtctaaacattagatgcattcgtgaactttttcttgcagacgagatagatgtaattaagatatcctatctgccggatattacatatataaaaaaagaaagcttgcatgcacagtttccttactattcatgctcacacaattctaccgaattagcactgcagtgtttagaaccgtgctcaaaaagagctaacagagcttgtgaagaagcctggatgaaaatatactacgtttatataggttgatttaattatacaatgatatcatttacgccttgcttaatgatatcctctagtagatcgctttctagatcgtcttctagtttttcctcattctctttcaaacggcgatgggtgaagttgcttatctgcaactcctctaattttaaaaccttcttcatggcgtatgcatcttcaccatcctgatagtagcttttctcgatactcaacacctcaaacgccaatgtgtccctgtacaagtgtaaagctgctctattagattgtctcacatgcaaggaaacatattccgcttgatgaacttctctcaacgcaaataaagcttgtctcattaagttttcggcaatccccatccttctataggttctcatgacacttaaggaagtaatatgaccatttggtggctcgttttgctggtcggggtcgtcgttcatcttcacgagaacgtatccaactaatttttcgcccggagccaagtatgttggatccaacttgattgtcctgccgtcattggtcccatctaaggtcaattccaatttgtcgttctcatcttgttcatcactatcttcacagtccaaagtggtggtagtagcaacaaacgaagcctctggccacgagagaatatgatacatataatatttcatcatataattttcgggtaggttatgaaggttggcattttgcatacatataatgtcattgattgtcgctctgcgaatattaataggcatggttgacgaagtttattttggagcttgatcgtatgtatttaggtttcccttttcacttggcaattactcgttgctgacaaaaggtttcaaacttttcagacggtgctttttttttctgttcaaaaaaccaattgacgcgagaaagtgaggattgagcctagagatcaataaagacaaattagcattggatgcaatactactaaagcaagcgctttaagagaaaatatttgtcctggaagtctcatggagattatactttatgaattctttatctccgggcagaaggcacttcagcgtatcatttgttccatgatattttctgaataaacttcagaattataatacacagtatttacacatctaatttttgactacagtataatattcaagcttcttgatttacctgcagttatgcttaaattcacatttgaattctttagtatccgtttagctagttagtacctttgcacggaaatgtattaattaggagtatattgagaaatagccgccgacaaaaaggaagtctcataaaagtgtctaacagacaattagcgcaataagaagaaagaaaacggattgaagttgagtcgagaataattatggcacccagaaaacgctttaggctactcgaattagggtcaccaacacattctaaaaggaaagttcaaaaacctcttcaagagaagaccccaaacttgcgagtttctccacttgcttttaaaattggtaaagaaatcaagaataaggaaatcagaaaaacaaaaaaaacagaatcagaaaatatattcaattcgaaacatgtcgatttaagactagaaagcccacatccaggattaaattttgtaagtgatgctcaacagtactcaaaggctggagatgttcgatatttgaaaaataaatcaagcaataccttgaaaaacgaaagacaaacaatagagcgcccctcatttgataattccttaaggttcgaggacattgagcagcctccaaaatctacttcaacgccggttctttctcaatcttctcaaataaatgtagaaagagaagcacccatgtttccagttccttactatattgctccttctcctatgtataattttagcccgtatcaaaatttcgttggaaacccaacgttcctgacgccaagtcataacccaaacctaaactatgccattcccatccaacggccggagttgctttatccgaatgttaacgtatacgattcgccattgtttaagaaaacaagactgccccatcagaccaaaagtctagataaagaaaaaaattaccaatatcttccaatatatccggtctcgatttctaataacggagattttgttggccaagagacaccaagggcagcaccaaagttaagtaaaaagagactttcaaatacattggatgttaattgttccgattatgagtctagtggacaaaatgcaacttataatgatagtgagtcttcccttaattaaaaagattagtttactttttctgtagaatgttaattagtttattgcatagaaaatctttaatactgaatgacaaaatttccacaattttttttaaaaaaattatcgacaactgcaggactcgaacctgcgcgggcaaagcccaaaagatttctaatctttcgccttaaccactcggccaagttgccacttattatataagtcgtaagcataatatcaggatcttatgccttagtataagtcaattgaaattgcaatccttgtatgttttatattaaattttgggtgaataattggataattgtttgaaatccattgttgaagaaaggctataatattcgtacacagagtatactagaagttcttctcgagggtcttggaatccacaaaaaggcgtcgataaatctccataactatattactttatcctattacattatcaattcttgcttttagcttctattgtatttgataaaatatttcggcttcttttatgtgtatgcgattgcgtattactaaatataaatttatatttcctgcgaccatttgtccgtcagaaaaggctctcaaaaaaacaacactacccttttaccggaaatcacaaactaaatgttaaaataagaatttaacatcatccattgattatgaatattgagtgaatgatttaatgattgttgcgatttccttgttggtgaaggctatgatatcagctatgcagaatatactagtagttatccaccagaacataagaatcctcaaaatgtaattaaaaatccactatcgtctatcaaccaataattatactatcaatatattatcatatacggtgttagatgatgaaataagttatgagaagctgtcatcgaagttagaggaagctgaagtgcaaggattgataatgtaataagataatgaaacatataaaacggaatgaggaataatcgtaatattaggttgtagaaatatagattccattttgaggattcctaaatcctcgaggagaacttctagtatattgtgtatacctaatataatagcctttatcaaaaatggaatcccaacaattatctcaaaattcacctaattctcagaatctgtatttcgacataaggttattatgattatttctccttccgttctatatttttcattaccctattacattgtcaatccttgcatttctgctttcattagaattgatgactgtttctcaatgtttatgccatcttcttacaacttatttgacaataaactagtagcgtgagtactaataaacggatgatattttgaagtttcataacaacaatcaaaatttgatgtatttcattaaaaattgattgattttgggtaatgcaaggatgacgtattcgatcatgattttcagatcgaccagtaagttccggtcctatagtgtagtggttatcactttcggttttgatccggacaaccccggttcgaatccgggtaggacctttttttgctaaaatgaacttgtgtcacaaattccgttcgaaatggcggtccttttccaataagttttctttttatggcatttttagcaattagagcttacttaacataatgaattatccaagtcaataaaagcagaaatacgaaaaattccctaaaaaaagatgccaaactctcatggtaatgtattgaataatatctctttaaatagcaagcaaaatcccagatcgatttctaaaagttgcccaaatgataaagatgcaaggcagaaaagcttcaaaacgatatcagcccaagcactagtacgcgtgcaaggagctggatataagctcggtgatgtgaaattaaaggatgctgaagtcaaagaaaagaatagcctcaaaaaatacgattgtaaaaatgcaactcaagaaaagaaagaacaagagcaagtatttgaaaaaactgttgcaaagggaagcgtgcaaaaatatatcacgaaaacttcaaagacaaatagtttgtttataggaaatctgaaatcaactgtcactgaagaaatgctaaggaagatattcaaaaggtatcaatcttttgaatctgctaaagtgtgtcgtgattttctcaccaaaaaatcattgggttatggctatttgaatttcaaggataaaaacgatgcagaatctgcaaggaaagaatttaattatacggttttttttggtcaagaagttaaaataatgccatctatgaaaaatacattatttagaaaaaacatcggaacaaatgtttttttctctaacttaccactggaaaatccccaactgaccacaagatcattttatctaataatgatcgagtacggaaatgtactgtcatgtcttctagaaagaagaaaaaacattgggttcgtttatttcgataacgatatttctgctagaaatgtaatcaaaaaatacaataaccaagaattttttggaaataaaattatatgtggattgcattttgacaaagaagtaagaactagacctgaatttacaaaaagaaaaaaaatgattggctccgacatagttatcgaagacgaactattggctagcaataatttatcagataatgctcgttcgaaaacaatattagtcaaaaatttaccatctgacacaacacaagaagaggtcttggattacttcagcactattggccccataaaatctgtattcatctctgaaaagcaggcgaacacaccacataaagcgttcgtcacatataaaaatgaagaagaatctaaaaaggcacagaaatgtttgaataaaacaatttttaaaaaccataccatttgggttggtcctggtaaagataagcctgttcataatcaaattggaacgaacaagaaaacaaaggtttatctaaaaaatttaagcttcaattgcaataaggagtttatttctcaactatgtttacaagaaaaaataagattcagtgaaattaagatcacaaactataactcattaaattggacattttgtggacatgttgagtgtttttctcgtagtgatgctgagagattatttaatattttggataggagactaattggaagtagtttggttgaggcatcatggtcaaagaataatgataatatactaaatgagatagactatgacgatggtaacaacaatgaaaattataagaaattaatcaacattagttccatgatgcgtttccgcacacaagagttatcagctcatcaaaagggattaacgtcacagtttcaacaagtagtttccccattctcatcatattcaaattcctacacaaacatgaactctctcgtagctacgccgatgaaacctcatccagcatttaatttaattacaaatactgttgacgaaaaactgcatcagcctaagagaactaaacaggagaatgcagaaatacttgagtccttaaaaaaaattataaacagaaatttacaacgtataagtatttctggtttaaataaagaagaaaatctgcgcagcatttccgagtttatttttgacgtattttgggagcatgactcagaaaggctatcgcactttttattaatgacaaatacttcattagaatcacagaaaattctacaaaaacaagtcactagagctgctgaaagcctcggatttacagtttgattccttttaaaggaagaaggcaggttcatcaatatgcaattttcggtacaaaagtacgtatgtctataaaaatagagtattgttttctttgctatcttaatctacccagaattattccaaggagtttcagcctcgatttttttttagtttaatggcgtatagtccagtttcaagaaatactccacctactaagtgagtacttaagaagtggttcctcgaagctttccattgtgattatataactacaaacatttcgtaaacatagctgaataaggaacccatcctcaacttcataactctaaaaaaaaattctatatataggaacgagacatatggaggacgataatttaagaaactctaacgtagtttgcagggaatattccttcttttccgttagtcctgcctgtccaccaatcattttgagaatctgatttttttaagatagtaataacatcaccttttttgaaagccaagtcgcctggttgttctccagcaaaattgtagagagcaacagccgttggtgtcgccgaatttgtagcagtggattcattacctaaccctgtcttcgacattttatgtgataaatcatcgacattgctcatattgctggggtgagttgggccatgaccaaggctataacccctttctctaccataaccacgcctatttcctcgggtattatcataatccctaccggaatggttgggacgggagtattcagtatctctatcatacaaatcatcttcccatcgggtattcgcacgcggcttagtacccctatctatctgtgggcctctattgcggctgctgtttctatttggagatcttccgtaatcataatcttcatcttcgctatcaaaatctccatacccgcgaccacgtccgtaaccatcatcatcataatcatcatcataacgactgcgtgaccccagcgacattcctcttcttcttgatgatcttgtgtttggacgtgttgaggattcatcagtagaatcaaaggaatctggaatatcgtcgtaataatggcttgtgttgtcgctgtattgaccgtcatcataaaaatcatcaccgctagcgttgtcatcatggtcgtggcgtgtaaagttgaacgctcttgattccaagatacggagtagggggtctgctgctggtggaacttttactctacctgacaaaatcatctttgatgtacagttatcgccgtaaaactttcgattagcttcccttctctccaagatggctgaaccttccacagacacaccggcaaataaacctttgcttttggaataggcaaaaactgccgagacaccacctgtggatgcagaagctgcagcttctgcacttcttccaagaggacctgcggaaactgacacattaccacctaaagtaattgtaccaaattcagaaaaggacctcactgcctcttccgaatttaaaataaaaacaaaatctgtcaattcaacgccgaccataccacctgcaccagcacctgccatagcgatagcagagggagccgaccatgtaccgtcttttaacctggccacaatcaccccagaacctgctctccctgaaaacaagaagccagcctttaaaaccgtgataattgctagacctttagctctttttagcacatatggtggaataacttggtctgctccaaatacttgatttggtttaacaaaactccttagaactttcgcggccttcctgtagttaaaacattcgaaataaatcaatcataaagttgttagtacattacttttgaaaactcatgccccataagcaatggacacagactagagagctatcttgaacattttagctgcatccataagtttagaggaggggcagcaggaagcatatatatgaacatacttggtctcgcttttcaagcttcgaggaattggattattgatacccatttttggattttggatttgatattaccactactcttgaaaattttactgtgaagtgtaagatagtttcatgttatagataatgttaagaacagggtctagttagggggtagtcaactttaattcccttcaggtcgttttcggtcagcgtcggaacatgtaaaaatgttgtaggtggcatacaaacaggaaatataaaacagacaacagaagatatttgctctcaaaaaaacaaataaaaatggcttggtctggtggtaaggatatagtggatcagatatttgatgctgggtattggctcgtctcgaaaagcgctgtcttgagcgatgagatcaagaaccacgtcgaaaaatcaattgaatccatatctggaaagatatccaacaaggagactcctcgactacaggaaaacgacagtaacagatctaaagtatataaaactttgaggatcgggctccaggatcattggaagctaggcttgggaatttctgccacctccctgtgcttataccttgggtataggaccttttttaaactgccacctaatttacctgaagcagaatctcaagtggtattaatactgggcgatatgaatgatcctatcataaggaatcaagtgatggatttatatcgcagacggtttacagtatatatttgtactgaaaatgcagacgtctataagaagcacgaagaagatcaggatttcatatattacattgatcccacctgcgaaaaagacttcgagggtttttttgttgatgtaccaaggctagcatccatattgtttatgccaaggttatcatatcatccatccggagtaatttcatgtgactcattggaatctgaaattcattcaagtatatttgtgtattatcaagcattattaagcattataccccatttgaagagaaaaacccaactaattatgttcaatccatctttgactgcggacctgaacttagtccatcatagtacagaaattataacgtctggaataatcgactcactatttaaaattttcaaggaatatcaaaggttaaatgtttccacaatcaagcttggaatcctgcagattgggtcacaaccatcgaactataaatttttgagaatggccggttcagacattcacgaggccctacattatccagtttacaaaatgataatgagtgcgaatgggtataaactaagacaactgctaagttggttaacgactttgggaggttacaatagtgtgtattattgcggccgttttagttatttagtctcatggccatttgcttcacttatattcaaccatcacacacgtctttccctgaaacgcttgagaggaagattagccaaggtatatagcagcattatttcgtttttttgccggtcatcttctaaatcatccaaataatatccttgattagataacaattgcttatctacgtatatatatacatagcacaatctcgaaaatataatactaataacaaaataagtatttaaagaagggttgatgaagtcctagaagtaccagacctgatgaaattcttgcgcataacgtcgccatctgctaatttaattgggatttcaaattatccaattgcttcaatacagcagatttagcggttccaccagtagcatctcgtctttcaacgctttgttcaaagttaaaagtttcaaaaagatcttgtccgaatctcgaatcgatcttttgatactgctccaaggttaatttatcaataccgcttagaccaagtctttcagcagtagcgacacactcaccagatatgtgatgagtctctctgaatggaacaccctttctgaccaagtaatctgccaagtcggtagctagcatatccatcgtgagagcagcttccatcttttccttatttacagttaaggtagaaataacacctgtggcaatcagcatggagtgctctacagttgttaagcaatcgaatagtggctctttgtcttcttgcatgtctttatcataagtagatgggatacccttcaaactcatcaagaatcctgtcagatcaccaaatactctaccggatttacctcttaacaactctaacgagtctgcattcttcttctgaggcattaaagaagaacctgttgaataggcgtcgctcaactgtatgaaaccaaattctgctgtacaatatataatcaaatcttcagcaaaacgagaaatatggttcatgaacaaagttccccaaaacatcaactccacgatgaaatctctatcagaaacagcaaccaaggagttaccaattacactattgaaacccaaaccttcagccaaaaattctctatcaatgccgtaaggatgaccagcaagagcgcctgcacccagtggtgattgattcaatctgtgtagtatttgacccagtctcttgtaatcttcggtgaagtatgttgcataagagctcaaccaatgagaccatctaataggttgtgccctttgtaaatgtgtgtagcctggcattaagacatctatctcaccttcggccctcttaattagaacttcaaccaagccctttaaagctggaaagagggtgtcattgacaatgtcacgacagtatattctcaaatcggtaacaacttgatcattacgggatctaccggtgtggactttaccagcaatatcgcggccaattagttcaccaagacgtctttcattcgcagtatggatatcctcgtcgtttggatgacggacaaatttgtcagcgtcccattcttttttgatttcagccaaaccttcatggatctttgccaattctgtctccgttagaagacccaacttctgcaagcccgctgtgtatactttagttccttctaaatctgccttatacatcttataatcatacggaagagacgcattgtaaaggtgcatcaaaggatcggtttcaccagtgaatctcccaccccatagtttttgagtgccgtctgacatgtttgccttagtcttgttatatagttacctgcttttgagctcttcaattgcgaatattctcccctagctaaagaaaggtagtcttatctcagagttctgtgcttcgctgaccttttataatccttttttttttttttcacatgtttcaatttgcgccagcttatccaaaaagtgagtcattcatctactaatcatgattttcgggattctgccaatgagtaaccaccacaagaacgaacaaataatcgaaaaaaaaaaactgttctaggccagatatgatggagccttggcagatcaggttatttgattgtcgttaacagagggtttggaagagtaaagaaaaattaattgcctgcgccaaccatttattgttataacgctaattcttgaataaatcaatgaataattagagagagggaggaacgtaaatattaatcggtataaatatttgtatatatgtgagcgctcacgtactcttcagtaactaaagatcatggcttacatctaccgctgaaacgtggatacaaggaacagtctctgacagtgaatctgtcacacaaccaggctaaaatacgttcggtaccgataccgtaaccaccatgtgggcaagtaccgtattttctttggtcaatgaaccagtagtaggcgtcggtatcaataccctcacgcttaaaccctgccattagttcgtccatgtcgtcgattctcatagaaccaccagtgatttcaccaacgtttggcatcaaaacgtcgacggattcagtgacgcgggggtcgtcagaacaacgcttcatgtagaaagacttgatttctactgggaatctcgtcaaaaagattgggacgccgatggtatcggtcatctttctttcagcagcttctgcaatatcgtcaccaaatttaaagtcttcgccctcttcgttcttgatgtcgtgttcgttcaaccaggtaatggcatccttgtactgtaatctcatgaatggagcctttggagccttaaagtttggattcaattgttttacgagtgggccagcaattgggtcttccaaaacgtattgcacggatttgacgatcaaagtttcaatatgttgtaatagatcgtcgaaagtcaagaaggccaattcagcttcgatatgggtatattcggacaaatgtcttcttgtgtgggacttttcagctctgaaagattcttggatggtataaacatcacctagggaggccaaacaggtttctaaatataattgggaactttgggtcaagtaagcttcctcgccgtaatagttcatcttgaacaaagtggaaccaccttcgacttgagtttgcaccatacatggtggggtaacttctgtcaaatgttcttcatcataaacacgtctaacgcttttcagtagagcagcacggactttcatgactgcagacaaggcatctcctctcaaggccaaatgacgttggtccaacagtaaagaagggtctgagccctctgcgattttgtttgtaaaggagtcttcaccaccgggggccaaacctacaacttcgtaatagtcgacattcaattcaacaccacctggagcggttttaccctcaggcaatttgactatggtaccgtacagagtaacggtggattccaaagtcaggtccaaagtttgttgagccaatgccaaatcaccggacaagacacattgaatgaaaccagatccgtctctgaggacgacgaaaataaccttcttgttagaacgtaatctatggatccaaccggaaaccttaactctttgtccgaccttggaataagagtcataaattctagtcttaatggcagctggtagcgattcgtcctccttaatggtgatattcaaagcagacaattgcttggcagcattttctgcctctttttgttgtttcttcaactcctgttccttttgcttgactgcctttttcttcaaaccatcacagcccttacgagccttcttcaaagcagaagcactgatttcctggtactcgttgtcttctgtcttaaacacgaaaagcttaggttccgtggcatcgctcttctgttgagatgcgaacaaagcatatgctggggttttgaatggatggtcttgtgaaccggctgtggtcaattcgtctacaccggtagcctccttaatgtacaaagatgacatgtttgaaaaaaatgaggatatagattaccttgctacttgcgtgaggacccagcaccgactactactacgcacaatctgaggcccaaacgtaatttcttctacctttttgatcgtctttgatagctcgacagtatgactgatcgaactatcagggcattgatcaccatgcacgatggaaaatttttcacttttgcgtccgatgggaggacgcgccacggatttggtaaaaaatgaaaaattggataagcgatgcttgagtcactgaatgtcttggccctcgattggaaaaagtatgctcgttacttttgctagatagttgctggcggcctgaaaagctttcctataagagaatatagaggttggtgtacatccgtgcttcgacacattatataaaaaacataaccataaagtaagagagtagaagaacaaatcaaaatatgcctgtttcggaagcgtttgccaagttgtgtgtgaatgagaagcctcctgctgaatctgccgttgcggtgaagtctttggtcttcaaaccaaagactccaaagtccgccacccctgttcctatcgttgtggtggctttgcaatctactactactccttctgcgttgattgccaacgctacgtccagtaaggatccaagattggctcgcgatgatttggtcaagcaagcgttccaatctgaatccgctagagcttttatcttgggggatttggctaacgccacgtccaattttcacttgctaattgatcacgagttgggtactgttgacggtgacactatcttgcagttaaacgacagtacttatatgaagaaatctgacatgatgaaatttctaaacaattttgaggatagtcaaaaagtggttgatttctcccaagaggtgtctaaggaaaccgctacagaaggcaagaaacaacagaaaaagcagcaaccttctaaggcaggcactgcagcagcagcagcagcagcagctttggaagacgccaaacttattggtatcaccgtagacaaagcgttggatttcccaggctggtaccaacaaatcttgaccaagggtgaaatgttggactactacgatgtttctggctgttacatcttaagacctccttcttatgcgatctgggaaaacattcagaaatggttcgacgacaagatcaaggccattggtgtacaaaatgcctatttcccaatgtttgtttcctcacgtgtgttggaaaaggaaaaggaccatgttgaaggctttgctccagaagttgcctgggtcaccagagctggctcctctgaattggaagaaccaatcgccattagaccaacttctgaaactgtcatgtatccttactacgcaaaatgggtccagtcttacagagatttaccattgaaactaaaccaatggaattctgtggttagatgggaattcaagcatcctcagccctttttaagaaccagagaattcttgtggcaagaaggtcatactgctcacttgactgctaaggatgccgaagaggaggttttgcaaatcttagatttctacgctggggtttacgaagagttattagctgttccagtggttaagggtagaaagaccgaaaaggaaaaatttgctggtggtgacttcaccacaacttgtgaaggctatattccacaaaccggtcgtggtattcaaggtgccacctctcaccatttgggccaaaacttttctaagatgttcaatttgtctgtggagaacccactaggttctgatcatccaaagatctttgcgtaccaaaattcatggggtttatccactcgtgtcattggtgtcatggtcatgatccactctgacaacaagggtttggttatcccaccaagagtgtcccaattccaatccgttgtcattccagtgggcatcacaaagaagacctctgaggaacagcgtaaacacattcatgaaacagccagaagtgtggaatcccgtttgaaaaaggttggcattagagcctttggtgactataacgataattacacaccaggttggaaattttcccaatacgagctaaagggtattccaatccgtattgaattaggtcctaaggatattgaaaaaaaccaagtcgttgtcgttcgtagaaatgactccaagaaatacgtcgtttctttcgacgaattggaagcccgtatcccagaaatcttagaagaaatgcaaggagatttgttcaaaaaagccaaggagctattcgacacccacagagttatcgttaatgaatggagtggttttgttccagcattgaacaagaagaacgttatcttagcaccatggtgtggtgtgatggaatgtgaagaagatatcaaggaatcttctgcaaagaaagacgatggtgaagaattcgaggaagatgacaaggcaccaagtatgggtgccaaatctttatgtatcccattcgaccaacctgtattgaatgaaggtcaaaaatgtatcaagtgtgaacgtattgctgtcaattactgtatgttcggtcgttcttattagttgcatttcccacctataattttcatgtatagagtttttattttgtgctttttatctttctaaaaatcaaatatcatcattttcaaataatgtttccgctattaaatgtaccttaccatgttgacagcttatacattaacagacctttatagtactgttatggtaataacaaaaaagattggacgagtccggaatcgaaccggagacctctcccatgctaagggagcgcgctaccgactacgccacacgccctgatatttgttgaatgtgttgtattacgggctcgagtaataccggagtgtcttgacaatcctaatctgaacagtcttagggaagtaaccagttgtcaaaacggtttatcagattaattcacggaatgttacttatcttatatattatataaaatatgaatcatactaagtggtggaagcgcggaatctcggatctaaactaattgttcaggcatttatacttttgggtagttcagctagggaaggacgggttttgtctcatgttgttcgttttgttataaggttgtttcatatgtgttttatgaacgtttaggatgacgtattgtcatactgacgtatctcattttgagatacaacagaatgagtggtattaaagaaataaggaataccataaggttgatcaaaattaaatattggaaggaaggtaactagctttttgactttattattgttggaactaataatcattaatattcgacactttaaaaattttttataagattaatatcgttgcaattaatacaccgtttgttgctatgctaacaatgtgaatacgcacaccgtatatttatgttcatttcgtatatgtttttgcatgggtgtgccttttgcagaagacagaaatgttgttctggcaagggagacaatagttcagttgaggtaaggccctattagttgaacattagagtgcaagtcatatatatgagtaaaatgggtgtcacattaaatatatcgtgactacccaatcttctattgtattggtggtatttaaggtgaactaatccgcatgtgttttatataatttcagacagaaacaattatccttagtgaaaaaaataagaaaattctggttcggttattgagttattttaaaaccttattcctaacagcagctttcactatttccagtgacatttatgcccggtataatgaccattgcaataacatgtatacatgtaattccaggtgcatcatttatgcttctggcacttacagtatagattttaataccaaaaaatggtatcagtaatgttaccagcgatttctaaccaaatgtgactggtattactattagggtattcgatgtatcaaatgttactatcattatcactattgtggatatagtattgggctctatcacgatactccatttaactcctacaaagaggttacgctcggatgaaatgcctttgtttaacaccacagcagctaactgtggctacagggtcgaggactatatctgcacttttatggtcattactaagaatactagagaaacttactgtacgatacaattcaaatgacaaaacctcctctcctacggattgtgcctttgatcataagattaacaatgtcaagaatgttcctctccttttaaacatcattggaaaattcattatttaaatatataatgaacctgccgacctacttcaacatcgcctccttagcgtatcctttccgattctaaaaggttaatttaattgattaaaagtaaatttatatttatatatttagataaaagaagatgattttaactacacaaaaaaataaattaacttactttcttctgaaagaagtaccttcagataatttggccttaccaccggttggagtacataagacagtagagcatgattcacaagtgacagcagtttgagcatgagaaaaaacagtggtgatgttcaaacaacctgggcatttgacatccaagaagtaggatcttgggccttgaaccaaagtctttaacttgtgctttctggcttcagaagcagcagttgggtgcaacaaatcttgaactaaaacctgtaatgaaataaatagaaacgaaaacgaaagtcgtttcacaaaaaaattgatgttagtaatttgaaaactgtagggttgggtaggatacatcagaaaagttagaggagacaggaaaaagtgagcatttgtgctccaaaaaaagaaggataaatcattacccagcagtatccggcatcatgatccgccatcttcaactgctataagtttctattattgttagattacccataactcaacaccatatgcttatctccacagtagatctcaaattttctgctatacagagcctttcaattccctatctaaaaattaattgctttctttgcacgtctttaaagtctccgttaccagtttaatgcatgatttgttgattttgcggaaacgcatactcctatcaaatgtcagaggttgattactgctttattttcctttctttctttttattttaggcttttttcttctactagaatttcatccgaattcattcctcaaatattgttctcttctgtttccttcacatcttatgtttaatatctctttcacataccatattgatctaatatatatgcactaattatctggtgtgttttcgtattctctaaataaaagcaaatgctatatagaacttttaacgtctaatatcaattatagatagtgttaatgacttgcaagttacagcacacatgaaagatgagagcatacttactaaactgggcccaagaaaggtcagcgggaagcagaggggaattgctgcatttcccaccacgtcctggtgggagtttcctttccgagagccacattgcctagctagaggaagagagccttgggcggggcggatcccgtctagatgggtggcaaacaaaagtttatggtggcccgtgttaaatgcgaacacaccttccttttttcttctgaaatttccccggcagatttttattaaatttttttctttataatccaatggtgcatgggtgaaaatgtatgggctaaatacaagaaaggatgtcaatatttcttttttacgcggaaggttataatagacgtaagtaatatggaaagaatttatgggatttataaaatagataataagtagatagctgtcacaatgaacagatcttttcactttctaataaagtacatatatatacatgttcttcttgttttttattttcacattaagcagcaggctattatgcctttttttatttttttcttttcatcattcgacggactttcatttgaccttcgagtggtagcgtttttagccaagcacgttttcgttggcgtttgttcacccttttttgttgtaggtttttttggttcatctagagtagttgttactgaatggctttcgaagcttgtattacctcctcctccagtttcaataacacaggtcttctctttgtcacgtaagagaggcgaattctccagcggatacatcttgattataaacccttacaaaagtttcctgcgatcacttttagatttttcaattttcaataatactgccaagaacaaatcttcaacatttacattgaacttggaggatgtctcaaaatagtctaaattgcctggcgagaaacccagctcttggataaatgttaaaaccttttcatgagtaattgttctttccgaatcaagatcacatttcgtacacgctataataattggaatatccaattcacattccaaacgtacgtggtgaataatacaaatataagactctaagctggcaagagagctgtcattagtagaatcgaaacataatataattgcatcagactgcctaatttgaagagtagttagctccgaaaggtacgaaacctccatttgattggtatcaaaaacttgaacatcaatactggtgcgtctttgagcagtcgatttattggcattgatcaggcgctcttctaggaaattgccacaactttcataaattgtgccagagtttttagctttgaaacccgcataattcggcaactgtccttttacgccaaaggtacgatagtattttaccaaagtatcaaattggattgtcttgtggtagaggtccgaaaccctataacgattagcatctgatatttgaaatgaactacctagccaactgcgaaccagagaagtttttccagaatgatcatcccccattacagtaatcttcgaagatttcaagtcgaaacatcttgggattgacgcaaggcttgcgccgtatgataagcgaacactcatagcgtttgacctaatacggtataattaaaagaaaaaaagacaaaaaaataggatagccaacacagagcagaaccttaacaatttctctagatacaatttacatgctcagcgtttctttatatacattctccctgtatatattcctttgaaaatttcttagatttttttgaaattaaataataagtaacgagccaagatcgttaaggtaagtacttgaaaaggatttttcaaagaaggcaagcatagacgatctctacgacatttttttttgcccttgatgttcttatgaaaaacaacttctacaagttgtacttatcagaagtgcaaaaaaaaaaaattgtttagacgacaaaaatagcgtttaataatcaaggtcatggcttttaaacaaagcgttaatcttaatccctatatctcctctaaaatggacgtagcttttacaaagggatattacgcttgagtatcccttttgaagatcgttgcaccattacgtattaaagcattttttttcctccgtcaagatcttacccgaatactgctgcaggacatacaaagcgcactgacatgacgcaggaagattgattagaaccgtccgcaaaattttctttgttacagcattagtaacgcatcacctccttctcaagctagggcacttttaactcataaagcgacacattgccttttcaaatattgtagcttttcaaatcacgcaatggaatatttgcagcattcattgttccgtcaaaagtaaaatttatttttagtacttcaacgtggaaggcaaaccttgccttatacctttacatggatggttttatgctattgtgaaacgaagtcaaaaggctaaacaaaaagataaaggaggggcatattatcggaccacctcgtatagcaagaaagggtacttatcaaaagaaaaggtcgctgaaaatcgagcccctcttgagaatttgattttcatacatatcccttttctcttccgggttaaagcctttacataaatgtgtcattgtatagcattactttttttttggtgtgaaaaaaaaatcggaaaaatattcacagggtaatgctgagatagcttttcttaccctccttggaatttggaatatttcgagatttcatcatttagcccaaaagggtaattgcgtaaacatttgtaatttcttggtgtatttgttttgattgttcattgtttatgaccagctactttattcatactcttccacactactttttttttcttgattacatctcgaatcctgcgaacttcgtggttagaagatcataacaaagttagacaggacaacaacagcaataatgaccggcgggcagtcttgcagttctaatatgatcgtctggataccagatgagaaagaagttttcgtaaaaggggagctgatgagtaccgatatcaacaagaataaatttacaggccaagaagaacaaataggaattgtccacccgttggattccacagaggtttctaatctagtgcaggtacgaatatccgatgtatttccagttaacccatcgacttttgacaaagtagagaatatgtctgagttaacccatttgaatgagccgtctgtgctttataacctagaaaagaggtacgattgtgatctaatatacacctattccggcttatttttagtggcgattaacccttatcacaatttgaatttatattctgaagaccatataaacttgtaccacaacaagcataacaggttatcaaagagcagattggatgaaaactcccatgaaaaactgccgccgcatatatttgcaattgcagaagaagcctatgagaatcttttatctgaaggaaaagatcaatctattttagtcactggtgaatccggtgcgggcaagacagaaaatacgaaaaagattctacaatatctagcatctataacttctggctctccttccaatatagctcctgttagtggtagttctattgtagaaagcttcgaaatgaaaattctacaaagtaaccctatcttagagtcttttggtaatgcacagactgtacgaaataacaactcttcaagattcggtaaattcataaagatagaatttaatgaacatggtatgatcaatggtgcgcatatcgagtggtaccttttagagaaatcaagaattgttcatcaaaattcgaaagaaagaaattatcatatattttaccaactattatccggtttagacgattctgagttgaaaaatctacgccttaaatctaggaacgtaaaagattacaaaattttatccaattctaaccaggatattataccaggaatcaacgacgtagagaattttaaagaactgctctcggcattgaatattattgggttttcaaaagatcaaataagatggatatttcaagtagtggcaattattttattaatcggtaacattgagttcgtatcagacagagcagaacaagcatctttcaaaaatgatgttagcgcaatttgtagcaatttaggcgtggacgaaaaagatttccaaactgccatattaaggcctagatcaaaagccggaaaagagtgggtttcacagtccaaaaactctcaacaagctaagttcatcttgaatgccttatcaagaaatctttatgagcggttgttcggatatattgtggatatgattaataaaaacttggaccatgggagtgcaactttgaattacattggattgttggatattgctggttttgaaatattcgaaaataattcctttgaacaattatgcatcaactatacaaatgaaaaattacagcagttctttaataaccatatgtttgttttagaacagagcgaatatttaaaggaaaacattcaatgggattatatagattacggaaaagatttgcaactgacgattgatttgatcgaaagcaaggggccaccgaccggtgtactaccgttgttggatgaggaagccgttttgcccaaatccactgatgagtcattctactctaaactgatctcaacttgggaccaaaactcttcaaagtttaaacgttcaagattaaaaaatgggttcattttgaaacactatgctggggatgtggaatacactgtggaaggctggttatccaaaaacaaagatcctttaaacgataatctcttgtctttgttgtcttcttcacaaaacgatatcatttcaaaactgttccagccagagggcgaaaaatcttctagtgctggtgtggaagccaacatctccaaccaagaagttaagaaatcagctaggacaagtaccttcaagactacatcatcacgccatagagaacagcagataacattactaaatcaactagcttctacccacccacattttgttcgttgtataattccaaacaacgtgaaaaaagtgaaaacatttaacagaaggttaatcttagatcaattacgttgtaatggtgtgctagagggtattagacttgccagagaaggttacccaaataggatagcattccaagaatttttccagcggtataggatcttgtatcctgaaaattcaaccaccacgactttcagttctaaattaaaagccagtaccaaacaaaactgtgagtttcttctaacgtctttgcaactggatacaaaagtttataaaattggtaatactaaactgtttttcaaagctggagtattggcagatttggaaaaacaaaaagatgttaagctgaataatattatgattaaactaacagcaactatacgaggttacacagtaagaaaagaaataacgtaccatctacaaaaattaaagaaaacaagggtgattggtaataccttcagattatacaatagactggtgaaggaagatccttggtttaatttatttatcaggatcaagccacttttaacatcatccaatgacatgaccagaaccaaaaaattcaacgagcaaattaataaactgaagaacgaccttcaagaaatggaatctaagaagaagtttttggaagaaaagaaccaaaaaactgtcaatgagttggaaaatacgcaggacttgctaaatcaggagaaagagaatttaagaaaaaatgagagcttattaaatagagttaaaaccagctcagaaacattacaaaaacaattcgatgaccttgtttctgaaaaggatgaaattagcagggaaaaactagaagttgcgcaaaatcttgaagaagctcatcaaaaaatccaaggccttcaagaaactattagagaacgggaggcgaccttagagaaattacactcaaaaaataacgaactaataaagcaaatatcagacttgaactgtgacatttctaaggaacagagctcccagtctttaatcaaagaatctaaattgaagctagaaaacgaaataaagagattaaaagatgtcataaactcgaaggaggaagaaataaaatcgttcaacgataagttaagttcctcagaagaagatcttgacataaaattggtcactttagagaaaaattgtaacattgcgatgtcaagactacaatcccttgtaacagaaaattcagatttgcgttcgaaaaatgagaatttcaagaaagaaaaggcagcactgaataaccagttgaaaaataaggaaagtgaactgttaaagatgaaagaaaaaatagataatcacaaaaaagagcttgctactttttccaagcaaagagatgacgcagttagcgaacatggtaaaattactgctgaactaaaagagacaagaatccaacttaccgagtataaatctaactatcaaaagattaaagaagaatattccaacttccaaagagaaacgaaggaacaggagcaaaagaaaagaaatagcctggttgagtctctgaacgatagtaaaattaaagaattggaagctcggttgtcacaggaaatatccttaaatcaatacttaaacaaaagaatatcaggaaattctgtagaaacgaatatttcgtctactagacgttccacatcgtattcagatgatccacttgacaaagaagatataataaaaaaatactatgaccttcaattagcgtttactgaaataactaggaatctagagaatgaaattgaagagaagaagaacttaatttctagattgagattcactgaaacaagactagcatcttcgtcttttgaggaccaaaagattaaggcacaaatgaagaaattaaaaaaattgatccaggatatggaccctagtattcctttggacagtattctaaatgagccgctagataactgccctgacaaagagtctgatattaacaaattaatgcttgaggtcgattatttaaaaagacaattggatatcgaaacaagagctcactacgatgcagaaaatgccatatctgctttacacagtaaatttagaaagatccaaggggaaagctccctgtcatcttctgatatttacaaactgaagttcgaagccagtgaagaaagagtcaaatccttggaagacaagctaaaaaccatgcctttacgtgatcgaacaaatttacctgtcggagatattataaagaaccgtgatagcatttcaaaatatgaagaagaaattcgctattataaacttgaaaactacaagctccaagaaatattaaatgaatcaaatggaaaattgagccaactcactcttgacttgaggcaatcaaaatccaaagaagccctacttagtgaacaattagacagattacagaaagaccttgaatctacggaacgccaaaaagaactactatcatccacaataaaacagcagaaacagcaatttgaaaactgcatggacgatctgcaagggaatgaactgcggctaagagaacatattcatgcactaaaacaagctgaagaggacgtaaagaatatggcgtctatcattgaaaaattgaaaactcaaaataagcaaaaggaaaagttaatctgggagcgcgaaatggaaagaaatgactcagatatgcaattacaggaaactctgctggagttgaagagagtccaagatgtaaagaaaatcctgagtgatgatttggcccatttaaaggagcgattgagcgctgtagaagatagatcccaatatacggatgagattaatagattaaaggaagaattgaactgctctttaaaagctgaaacaaacttaaaaaaagaatttgcaacccttaagtacaaactggaaacttcgactaatgattctgaagcaaaaatctccgatctgctgaagcagctcgatcattatacaaaagtggtggaaatgttgaacaacgaaaaagatgctatttctcttgcagaaaaagaactttatcagaaatacgaggcactcaatactgaatgcgagtctcttaaaggaaagatagtgtctttgactaaaatcaagcaggaactggaatctgacttaaatcaaaagactgatgcgctacagatatcaaacgcagcactctcaagttccacacaaaagaataaagagattactgaaaaaatcaaatatctggaggaaacactacaactgcaaatggaacaaaattcaaggaatggggagttggttaagacattacaggccagctgcaatggatataaagataagtttgatgatgagaagcagaagaatattgatttatatgaagaaaatcaaactttacaaaagctcaacaccgacttacagcttcaactaaaaaatttgcatgaaagattatcagacactactgaaaaaaacgcatggttatcaaagattcatgaattggaaaatatggtaagcctagaaacggacttgaaatatgaagaaatgaaaaagaacaagagtttggagagagcagtggaagagttacaaactaagaactcccaacaaacagatgtaatagaactagcgaataaaaatagaagcgaatttgaggaagctactttgaaatatgaggctcaaatctctgacttagaaaagtacatttctcaacaagagcttgagatgaaaaaatccattagagataattcttcttaccgcgacaaagtgcaggaaatggcccaagaaattgaattctggaaaagccgttatgaatctaccatgataggctcgaaaaatattgatagtaacaatgcacagagtaaaattttcagttaacgaacttttttttaaaaatttggaagactttatatcctttatttaaaaaaataatgatgagatgttttgtatatacagaatgagaatatgcattattaacagaaaaagacgacacgagcgttatatactaagtggcatgaactctttcaccccgtatccttcgatagtagtcttaaaggtggtacataaaataaagaaaataaccgattcaatagataagcagcggaaataaagtctttttcctatcttgaaatctccaaaataaaagtaataaagtactgctaaagttgttcaaaaccaacccttcttcttgggactatcgtttttggaggaggagctgttacccaatccatatgccttcagtacattttccacatctccaaaggatcctctgtctccttgcattacaacagtagctctacccttaccattgccagcattatttacatttcccgtaaatatcatttcggcaacacgtgagatatcatctggcttcaaatcttcgatcttacttatcatttcgttgactgggattttgcgaccatgcatgagaacttgtctgcccatatcttccaattctaccagtttagactctaggttcattagtagtgaagacttcaactgattcttggccctggagacttcgtcttcagttaacctcaaatccttattagcaaatgtattatacatttgctgtgcaattacctcaaccgcttgaggagctgcctgcggtatacaagataatgaaataccgaaaataccagaatccgaataagaatggttgaacgcaacacaattttcaacaaagtaatactggttcaaaacgtgggtatacaaacgagaatacatcccctttcctggcccaccagcactgaaagaaccaccacctccaagtaaagtttgtaatgttgctaaagcataaatgtctggatgatctatagggagaccttcaaatccgatctggatgtggaataattctggtaaattcccaaacactggtgctggtggaatacaactttccccgcccgtatattgggcaacttttttggtgatcggagggtgtgtagattgccagtcaccgagatacttttctgtaagctctaatgccttttcgtgaggaacaccaacaaatgccgcaacagtattttctggggtgtagaatttatttctgtagtccaataagtagtatttagaaatagaaggaatgagctctctagggcagattaaaggggaccccaaagtttctccggagtatgctgctgtgtgcaacagctcaggtaataccaattctggcttcatccaaacttcatcgatttcatactctgccgacagcttctgttcttgcagttcttgctcagtaatcttagggaacctcacagtttctgacattaattgaagcattttacccacatcctggttgaacacagaagcctgatacatcaaattttctctagacgaggtacactggtaattcccacccagtaactccaacgtctctgccattgctcggccctcgacgtgttcggttgatttgaatgctagtctatccaagatatgtgtacaacccttcaaattcctaccttcaaaccgtgatcctgcgtcgatgtataggcctaaggcactaaagtgtccaggagtatttgatgtcgccactttcagtccattcgctagtgacgaaagcttaaaattatcggttctagcgatgttagagtacaacctctgaacgccgttccttagcatcttttgttattaatcagctctctgctttgcattaatttgaccacctgccctgaaacacctttcttctagtccacctgtgtaggctttttcacctgaattgttcattctcgatacgccctcacgccggatgaaaaatttgtgcaagagtcatcatctcgaaaagatatggtgataaaaacaagtgtacttctaacctgcctaatggttataacagtagcataaagtagatatacggactacagaaaatggttcgtgccttcaaaattaaagttccagcttcttccgccaatatcggccctggttatgatgttcttggtgtcggtctttctctattcttggagttagatgtcaccatcgactccagccaagctcaggaaacaaacgacgatcccaacaactgcaagctgtcttacactaaagaaagtgaaggctattctacggtcccattgcgttctgatgctaacctgattaccaggactgcgttatatgtgttgcgttgcaacaatattagaaacttcccctccggaaccaaagttcacgtctccaacccaatcccacttggccgtggattgggttcctctggtgcagcagttgtggcaggtgttattttaggtaacgaagtggcccaattgggtttctctaagcaacgtatgttggactactgtttgatgattgaacgtcatccagacaacataaccgctgctatgatgggaggcttttgcggttcattcctaagggacttgaccccacaagaggtggaaagacgtgagattccattggctgaggtgcttccagaaccttctggtggtgaagataccggtctggttcccccattacctcccaccgatatcggtagacatgtcaaataccaatggaaccccgccattaaatgtattgcgatcatcccacagttcgagttgtccaccgccgactccagaggcgttcttccaaaagcctacccaacccaggacttggttttcaatctacaaagattggccgtcttgaccacagctttgaccatggacccacctaatgccgacttaatctaccctgctatgcaagatcgtgtccaccaaccttatagaaagacattgatcccaggtctcacggaaatcttatcatgtgtcaccccatccacataccctggcctattgggtatctgcttgtcaggtgcaggcccaactatcttggctttggccactgagaatttcgaagaaatctctcaagaaattatcaacaggttcgccaaaaacggcatcaagtgctcctggaaactactggagcctgcctacgatggtgctagcgtcgaacagcaatgaaatgtcctttacccctagtatactgtgttaaatactattgtagaccatatacatactgtaattgaccgttaacggttattatgctgagtcttcttccgttacccgtcttttctatctatttcgaaaataaaaaataagtgaaaagaacgaaatttcacaaccattaacaatacagataatgaatcgaagttgttttcagtctcaattcaaaagactcatagccaaggccagttgattgatttagccacaagtatcattcaacgtaatatccacaggtgttttttttctcaccggaaggcgaataaaatacaggagctagagcgtgtaagataatgaacaaggaatctaaagatgatgatatgtccttggggaagttttccttctcccacttcctatattacttggtgctaatagtagtaatagtgtacggtttgtacaagcttttcactggacatggatccgacattaatttcgggaagttcttgttaaggacatccccttatatgtgggccaatcttggtattgccctttgtgtaggcttaagtgtcgtgggggcagcatggggtattttcattactggttcatccatgattggtgccggtgtgcgtgctccaaggattaccaccaagaatttaatttccattattttctgtgaagtggttgccatttacggtctgattattgccattgtcttttcttcgaaattgactgtggctactgctgagaacatgtactcgaaatcaaacctgtacactggttattctcttttctgggcaggtatcactgtcggtgcttccaatttgatttgtggtatcgctgtcggtatcaccggtgcgactgctgccatttccgatgctgctgattccgcattgtttgttaaaattttggtcattgaaattttcgggtccattttaggtttattaggtttgattgttggtttattgatggccggtaaagcttctgaatttcagtaagcgctcaaaccaggcttttcttttccgtttttacgagctagataagcgcatccatatttactaatagatataatgagatatctgagatacatgtgtatgtatatatgcacgttttcttttattatctaaaaatcatattatattaagtaagagaaaaaaatgtacaactatataaatatatatttatttaaaatggttttgaatttttcctattctggttgatattgcccaaaagctattcagtttactcctcttcacgatagtcagggttcttctttaaaattactacgccctcaatatggcttgtgtaactaatatattcatcagtttctagttctgctctttcgccatgatttagtaaaacaggagtggattgcgtaatccagccagtaatcttttttggtctgcctgcttggccgacagtttccactgcttgaccaacgcgcacattaacctttattggctctccctcatcgtttaatgctagaataaactttggccttataccggcattcaacatgtagaacaattgatgatgcttcaacatgaaacttggcgatactaaaccaactgcggtagttaatattgatgctaatgtcaccttattcaaaacatgtgcatcattgaacacatccattgtcatagtacctttaccaagatgcaataacccttgtgctaatctggtgataaacaaagcgtcttgttcacgtgaataataacttgccaactgtcttaatagttgagctaaccttgcattgttagtaccagcaccacatagacccatagcgaaaattgaattcattgaaacttctaaatcggcgtcatgtgaaaaacgagttaaggtatcgaacaccttcatttgtggatcagaaacggaaacaatacccatcgctaaaggaaccatacgacggatgtgttcattaccataatgcattaaatgaccaaaatgacgtaaagacatttccttgccaatatcttcaccaagggcaatcaaagcaatacccaaaactgcataagcaagttcatcgactatgcctgcttctttttcttcctcctcatcatcatttttcccgtccgtagtagcatccttatcggaagattttcccttcttttcttcggattttatctcttcaccttctaaactctcaccattcttcttctctgttatttctgctttaacttcaacttcctctccttcggcatcaacctccatttcgtccacttcgatctcagcttcctcgttcttggtaggttcattcacttgctcacccaaaaagtcacttatgctattagtctgtccttcggcagtttcttcttcatctgcatcttcttcaccttttacgtttttaggggtcaaacgatgtaacaaatcttgaattaacaaaacatcacccgtaccagtataagcacatgaaccaactaatacttcaatagctgatgtcattggatgttcaatagcactaatagtttctaaaacatcatccacctgttcaccttggcccatgtatagaatacctaaagcaagtgccaaaaaccttacccagtcggtcttcaactcgatggctgtacgctctaaaaagttgtccatgatagaagttgtaatgtcaccattacaagtaccaacgaaaacatgagccaaagctaaggaagccatagctgcagtttcaataggcaagtcagtggatgcggcaattggtaataacaaacccaacacttcgtcattcttgctaccagcaaatgcaatacccaggccaagaatagctgctgaactaattttagtgtctgggttagtaacataatcttgcaaaagtaacaaagctggttcaacttcaccatcatgcacaccggaagcggaaataccaatacctaataatgcaccagctttaacttctggctcatcaacgtagagatacttatccagttgttgcaaaccatcgagattccactggtatatagatccaatactagctaccgcggaagtcataccgtcacctttggttttatatacccaattatcattatccacaattaatttatcgttacaataacctaagtttaagaacccgttgacaaatgacgaagctagattttgttgagcagaatctaggccggcgcttgagaacacagatttagagttatccaaatggctcttataaatgtcttctgggacttttggcccagttagattcaattctttagcaagatataaaaagtgttcagacaatttaccatttccaattatatcctgaacaccttcatactcaaacgatgtcttttgtgcggctaaaatatatgctaattgtttatgcatcactggatcgctagtagcatcgaaaacggatctgatcatatcctcttcccctagtctaactgccaaagcaattgcatctgtaagttcgttctgagatagataaatagaatatgcggtttttaaaaaggcaacgtcttcaggaggtggcaaaagtggaacacatgcaaccatatattgacaaactctttggaaggtattctcatcgacaaattgaggtagcttgtcaatagattcaatttccaaaagcaaatctaccgcgtcttcttcaccgttgtgtttcaaaaagtatgggacaatgtctaaacatagacgaagagtatcttccttggaaaattcgaacccggaagtagccgcagatccatcgcttttagatccatcagatgatgtttcatcttcagcatctttttccacttgatcattatatacttcaccgatctccaaagctaaatgacggatgtactcatgtccccacccttcaaaatcagaaacgtcggagagtaatctatatctcaatgaatcgtgtttaccattttcagagtatgtcatggctaaaatggacaagacatccgctaaagaggatttcaagtttggatctgtccatttgtcgtagatagaacataggtctggatatgtcggacgaaggaatttcaaaggtttgggaacggcggtcatagaactcgtagaatttttgatcgattcctttaaggcattcaaagacgcttcatataaagatgaatcgtcttctttcagcctttcaaccaatagctctaaatctgttttaagctttgcatcttcttcggatagctgctcctcttcctccttttttttatccttcttatttggtgtctgcttttcaggacttatctgcgattgttcatcaatagtctgttgtttcttatcactttcgtctaccattttcttgcaattgtcttccaaatttatacgaatcgcaccttatgtagaccaatgggcaagtttgttagtgaagaattatagatttgaccaaatttgcttaattacttataccctttgccaaatttcgtgctcgccttttgccaccgtaaaacacatcatcttctacgaacattaatctgttatattaccaattttatatatacatagtatgtaaatatgaaaatgttttatgaatgtctctatgagatgagctgtaaatagtcaactcatttgacaaattgcccatcgaaagcacgctttgcccaatccaatagcttgtcaaaaacgattacattcgcattatggtatcttatactatgatctgagtcaggaaagacgtggacgtcataattttccacaccatttagatccaaaaggtccagaaactttagggaattttgaaagtgaacgttatcatctcctgttccgtgcatcaacaaaaatctatttgcttgtgccaaagcagtgacattatgaacgcttgattctacgtatccatcaaagttttcttgaggagtatgcatgtacctctcagtataaacagaatcgtaaaatctccagtcggttactggcgcaactgacatcccgtatttgaaatgtcttccgccatctttctccaaagtttttagtgtcaggtaccccccgtatgaccaaccaaataaggaaatcttttgcggatcaacaaaagttaaagaaccatataaggaagccgcagatatttggtcgcgggcctcgtaatcaccgagcctatcgcgaacaagggatctaaagtcttgacctttgaagccagtaccacgaccgtcaacaacaactacaattgcgtttaattgtgaagctaccacttcattaaatcctacggaaaacgttttgacaacttgttgagaattcggtcccccatatgcaaagaaaaatacaggatagtggtcacttaacgtttcatcgaaatcatttggtaggatttcatacgagttcactagtatatcctttccaaattcgtcctttcctaggttcaattccctgaatgattttctgggtaccgcataatcttctaaaattttggtaagtacttcgttcttttccaaatggtatagtgatttgcctaaaacattacctttgtcgcatttttctgctttacgagaatggaagtccacaattttttgatatggaacttttggtcctttataggtgagtaaaccaaaccttctaccagaagaaaaggacacatcatagacaccatcctcagaagtatcagtaacttcaataatttcatttggtgaccgtaaatctatgtagtaaacgtggcgttcggttgaactctttcgtgtagaaatgaagtaaagacgattttccattgaatcaaaggcaagtgggccattcaccacttcccatttcccctctgtcaatgttttatagtgtgaactattactattttcgaaataagccaaatgattgtaaccaccaatcggaagaatatcaacataaccattatgaggcctatcaaatgtttcatttgccggaataaacagagtattatgagtaatctcccaccatcctccgttagaactttcgttccttaccacgtttgaagtctttgcaattgtatctatcaaaaacacagtcaatatgtccgaggatcgatcggtagttttaactaaaacgtttccatttcctacccatgtaacttcagtaattaacagacttccatcttttttatttccacttattcttggatggaacgatgttccatctttcatactgtaaacccatagctctgcatgaggatttggcgtgccactttttggatacttgatactgcgcatttcggggtatatatccttttcatcttggacataatatggaatgataaactcaccaacttctgattcatcaattttcaagaatgccaggtaatcaccagttggtgaccaccacgcagccttgtcgtcttcaaaaacttcttcctcgtaaacccaatctggcttaccgttaaaaagaaaggagcttccgtcgttggtcacagcccgtatggtctttttggaaatagcagaataaatatatatattgttatcttggacgtatgcaatatcattagaattaggggaccatattgctagagccacctcgtttccaatctcctcaaaggacgagctactcttatcgtagacaaaataagaaccaaacgttgagtgtctccaattttgtacgctatttgttctaattaataaccgcttcaggtcgggagacgcagttattgactccacagtgaggttttgaccgttatgaatgaaagtttttccctctaataaaacgctattatatgagtcatcgtagacagatttaacaacgtaactatcgttcataaatgtaacataaagacctagatcgttgctttcaattttattgtcactaatccattgcagctcgtgatatttgggttgaaatgtattgtttcttacaacagaaaacgacacctttaatttcccatcattggtgtaattagagttgggttcttgataatctggtgtgtttgaatggtgaggtatactttttagcaacaaaacagtgccccatatcaggagtacaaggattattccgacccttatgagcttatctaacaaatgcttcttttttgtatcgaaaagttcatcaggaatgcgctcaacttcttcttcgccaccttccatgagtaatttggcttattggtatgttgcaaaaatactctctgaaagaatacttcgaatttcggcacttcttatgtacactttgatggaagctttcttgataaggaattctccgtctatttccttcaataccgcctccggcggtattgaaggagaaaaatttgggcgggagcatattattgtaattaatatatacatatatatatatatatatacatcaaccttacaactatgcgtttagaatcctaaactttgatcttaccatcaataacggtagtggcatgacctgctatatagtaggaagtgctattatcagcttctttcttaattgaagctaacattaggccatttctttttaaccttccaccctcagaaatggtaatatccgtggttttctcaaacttataaacttcttgcaaatatcttgcaagggctacagaaccactaccacaaacaggatcttcataaacgtttatcaccggagcaaacgccctcatttcgtaggagtttttgatggcggcttcctttttagggcccgctaggataattcccacatggtcattctgttttgtctggtgtgcaagcatagcaaaatttgggtttgcattgaagcaagtttctgcatcttctactagcgccacgatccactctggcccagtatgtaaaagagcaggaggctttatgaatttcaaaccaatcgctttttcataatcagcaatcatctcactcgatatactttcgtaatcagccatcggagctttgaagctaattagtccctcattaattgttattggaacagcgcctattttacattcctggacgagagaagtcgcagtggtgtttttggtgaactcaaggaaagccttacatgaaccaatggttgggtgaccagcaaatggcaattcacttcttggagtaaagatcctcaacttgtaatcatactttttatcagatggtttaaataaaaacgttgtttctgataagtttgtccagttggcaattgcctgcaattcttcttgactgacttcattttcatcaatttccaagaagtttattactgctactggatttcccataaagggcttctcagtgaatacatcaacttgtttgaaaggtaccattaaagtcatattctaagcgcttggttttttttatcttatcttccttgtgtcatatttagacatttagtttagtattctaggtgcttaaataatgaatattgtctatagatgactaatcataaatgaacgaaaagaaagaattcaagaggcgataacaaacttccgcggagtacgattaagataagcgtcggaggaggaatttgatatacgagctacaacaagagcacgtatatatatatatatttgtatacgttcatatacatcatatatacacattgtctgtaagcttacatctatggtgattctatacttccccggttacttatagttttttgtcctaaaaatattttctatctaatccaaactccagctctttttcaaggtctagaagcgtgccgttatcattctgaggcggaatatctgcggtatttccagtggcaggtctcatctccatcatactctcttgaggtcgaggtgggaaatctgcatcatgccttggcaaattttgggagtgaataccaaatgattcttgttgtggcgcaacagaattagacgtggccatctgttttggataattttcttcactcgctgcggcgttgccattatccacatctgaaggctgctgttgctgttgctgttgctgttgctgctgctgttgctgctgctgtaattgtaattgcctttgctcttctaatagcggttgtctcacaaacagcctgaaatcttgcacttcttgtataaccatttgttttaagtcctccatatcattaaccgattcaaaactaaattcgaatttttcactacacacaggttcgtcagctggatcatgccatatagacaagtaaggatgctccagggcctcatccacggtaattctcttttgagggtcaaacgcgagcatttgctccaataagtctaatgcttgtgaattggcatttgggtataaattgacaaaaggtacttttggaatgaaacctaattgatgtatgtagtcctgaacatttttagaaccaatccttcttaaagtttcgtctgggggtgtccctaaaacttgtaatatttgattcaattgattaacgtaatcctttcctttgaagattggctttccaccaagaaactccgctaaaatacagccagctgaccatacgtcaatcgccttggtatatccttggtaactcaacattatttccggagctctataccatctagtggccacgtactccgtcaaaaattgactgttttcgacaggattctccgaataacctctagctaacccaaaatcacagattttcaattgacaatctgcattgacaagcaaattgccgggcttcaaatcacgatgcaagacatctgcagaatgaatatactttaaaccacataatatttggtatgtgaaactttgatagtgagcatccgtcaaaggttgaccggatttgatgatttggtgcatatcacattccataagttcctcataaagatatagtccattgatagacccgtctggataaaaaacaatatccatatcataaagacatgtaatatttttgtggcctctgaaatgtctcaaaagctttagctcacgtagggatcttttacatagtaaggtcttcgaaaaaacgtttgtcactttcttgatggcaactgtggtatcttcggcagcttctgcaaaccgcgctgaacacactatgccgtatgctccatgccctatttctttgataagttgaaacctcttatctacactgaaatcttgattgaagaccttgaaagtatgcctctctatcttatcagccatctcccagaattgttatacacgcccttcaattatttctactattttgatagcttcaataagaaaatctgtggcctagatttgctgactgaatgcacagttcgtctaatatatatatatatctggcagaccagggtcttcaattaaatctaaatatttgtgtaggatctgatttccctcactttttttttcgatatattcctggctagatctcctttttcagtttctatttttaacactgaaactttccattctgccaacatttcgcagtcttctataaaaaaaaaaaaagataatataaaaatcgccgcatacgtaggcttagctaaatagatggcttctagatgaatatttcgggattctgttaaattatacagataggctcacaagtattcgaacctgtatagaacaagaaaagaaaacttcaactagagtatatgcatttattcgttgcaagtcatttcaaagtttctaaacgtttatagaaatcttttactctttcattggtgcgaatctttcctggatcaaagtttaggacctgtaaggtgtccatagttaccgctcttgacagtgcaacataaacttggccggcttcgaaaattctcctcaagtcgacctttagtctttgaatagtttgaccctgtgccttatgaatggacagtgcccagcatagcattaatggaatctgagttctttctaacccgacattttctctgggaatatcaatgggaaagcgctctgggaccatgagctcatgtatgtacttgtttttacccactgtccacctcacataggggaatttttccttatgcggagagatcttaactgcatagtttatcaagattttcaaacgttccaatctagctaatggcctggcattcaaatcttgacgaaactcctttgattcctttaacaagggattaccaatgacccgactcactaatctcatgtccatgacaacttcgtcatccacaatcttgtaaatttccttcattttcaccaccagcgattctgtaacaaaaaacaaaacttttcccaatgatccattaactaattctacatcaggcttatttttcaacatcattacctgtgcatcttccttcaatgcgacaactttttccaccattaatgaagaatctagtatcgcttggtatctctcgggcgcgttatctacagctttaaactcatataaatcaccaggtagagactgtaatttctttacgttggatagttcaacttctcttcttgtggcatacagttctgtaggagcaattccatcggcatagtctatatccctatttaggttccttattgttttagcaatgtcgacagtcagctctccgtatcttatggcatttagaatatcaattagtttgttatcctgttgtctgaaaacctttgtcagtaaaatcgttttttgaatgcaccgtttccacatttcactttcaaaacaaaatttcacaacgttatgctcgtccttcttagcaactggtggtagttgaaaaaaatcgcctgtcaggaccaattgaataccaccaaagggatcgtcgttcttccgaattctccttgcgatttgctctaatttatccaacagattaccatcgaccatagaaatttcatcaattatcaaaacttttgtatacctccatgcggccaataagtccttttgtgattgtatttttttcaccaattggtcgatagttttgttcccgattcctataccagaccacttatgcaatgtggaaccaccaatagtcactgccgctagcccagttgaggcggtaattgcaattgattctttcccatacaaagagctcaattgtcttatgatcgtttgcaaaatgaccgacttacctgtacccgcactaccggtgtaaaagacatttgttctttttttgacgattaaattaaccactctctcttgctccattgtaagtaccactggcgaagacgcacttcggtggttcattgagtccatatttgatactgtctttcttagcagtggttttattttctttggtactgtgagctttaaaccttgaaactccatagaaggtttagacctcttggctggtctttctgaatcagtagaaagtttcatgctagaatcttcaatattaattgtactagtgaacgataattgtctagaattggatttcacgctagtaacctctcgcaaagtctcatcctcatcaaaatggtatgttttctgagtcgtggacgcagaggcagtcttatgaagagagctggtcatcgacagcgatctgctagactttttatagctattgagtctcggcacatctaccaattttttgaattctgcgtcgggatcatcatctccaaacgaaccttgactctgcgagaataaggaagacgaattattccgtattaatcttggcctaggaggtgctgttatattacggttaccttcgtcaccgctttccaaatcaattattgtcgtgctgttttttgaagcagcagcagattttttgccgcaacccataaagaacgaagacaacgtttgttgcctgtatgcgtgagagccagatgccgaagcagcaggtgtgctaccatttgaggatcttttagaccattgcttcttgttaccggaggcatgcgacctgaacatcgggatgtcttataagaacaaatctctcgacttttgagcttgttctcctctgcttattgttcgagatgatgtttatttacatattctttgacgtaataatatcggaataatgcatgcgcattcgggttagccccgttatagggaaaatgaaaaaaaaaaaaataataaaaaaaaaaaagactaaaaaaatagaagagcacggcaacttaaaaagaaaaaaaaaatttatgataactacaaaatagtaaagaaccctggcaaaagaaataaatccggtaagggaagatagaccggcttaaaaagtactttttcagatttgtcaagggtctgtgttagcggtgaagaagatagaagaagaagacgaaagaagactatgtctaaacaatttagtcataccaccaacgacagaagatcatcgattatctactccaccagtgtcgggaaggcagggcttttcacgcctgcagactacatcccacaggagtcagaagaaaacttaattgagggcgaagagcaagagggtagtgaagaagaaccttcctataccggcaatgacgatgagacggagagggaaggtgaataccattcgttgttagatgccaacaattcgcggacattgcaacaagaagcgtggcaacaaggttatgactctcacgaccgtaagcggttgcttgacgaagaacgggacctgctaatagacaacaaactgctctctcaacacggcaacggtgggggagatatagaaagtcacggacatggccaagcaattggaccggacgaggaagaaagaccagctgagattgcaaatacgtgggagagcgcgatcgagagtggtcagaaaatcagcacaacttttaagagagaaacgcaagtgatcacgatgaatgcgttgccgctaatcttcacctttatcttgcaaaattcgttgtcactagcatctattttctccgtctcacatttagggacgaaagagctaggtggtgttacactcggttctatgactgctaacatcacgggtcttgctgctattcaaggtctgtgtacatgtctggacacactgtgtgcgcaggcatacggtgccaaaaactaccacttggtgggtgtgctagtgcagagatgtgctgtgatcaccatcttggcgttcttgccaatgatgtatgtttggtttgtttggtcggaaaagatcctagcactaatgattccggagagagaactatgcgcgctagcggctaactatctacgtgtaaccgcattcggtgtgccaggattcatcctttttgaatgtggtaagaggttcctacaatgtcaaggtatattccatgcatccacaatcgtgctctttgtgtgcgcacccttgaacgcattgatgaactacttacttgtttggaatgacaagattgggattgggtaccttggtgcgccattatcggttgtgatcaactactggttgatgacgctcggattactaatatacgcaatgaccaccaagcacaaggagagaccactcaaatgctggaatggtatcatccctaaggaacaagcatttaagaactggcgtaagatgattaacctagctattcccggcgtggtgatggtggaggcagagttcctcggctttgaagtgttgacaattttcgcttcccatctgggcaccgatgccttgggcgctcagtcgattgtggctacgattgcgtctcttgcataccaagtgcctttctctatctccgtttctaccagtacacgtgtagccaattttatcggcgcgtcgctatacgacagctgcatgatcacgtgccgcgtgtccttattgttgtcctttgtgtgctcctcaatgaacatgttcgttatctgccgttataaggaacaaatcgcaagtctattttctactgagagcgctgtagtgaagatggtcgtggacacactacctcttcttgcgttcatgcaattattcgatgcctttaatgcgtccaccgccggatgcctacgtggtcaagggagacaaaaaaataggtgggtacatcaacctagtcgcattctactgcctaggtgtgcccatggcatatgtgttagcattcctgtatcatctgggtgtaggcggcttatggttgggtataactagcgcgttggtaatgatgagtgtgtgtcaaggatacgccgtttttcatggtgatagacgccgtattctcggagcggcacgcaagcgcaatgctgagacccatacatcatgaaactccttcagggtcgaatgacgtataggggagatgcacacccccacccccgcatcacacccagtcttctagccaattatgttggtaattttaagggtttcgccatgtggcatgccaccggcaaaataatacacgtgcccgtacggcaccaaacgggcatgcatttttgcatttgaaaaagtttgctgcccttcatgtgcttttatgtatgcatacacatacacattcgtgcatacattcatttatatatatatagagtgtgcatcgtgcatatgattattcattaccactttttttgtttttgattttgttcgtcaaaaggaagagaaaaggcatatcgaagggtgtaatgacaaaagcttatactatcgttatcaagctgggcagttcgtcgctcgtcgacgagagcacaaaagagccaaagttgtccatcatgacgttaatcgtcgagaccgtgacgaatcttaagcgcatgggccacaaagtgatcatcgtatccagcggcggcattgccgttggtttggacgctctcaacattccgcacaagcctaagcagttgtctgaagtgcaagcgattgccgctgtcggacaaggccgtctcatcgcgcgctggaacatgctgttttcccagtatggcgagcaaacagcgcagatcctgctcacgcgtaacgatatactgcgttggaaccagtacaataacgcacgcaatacaatcaacgaactgctggccatgggtgtcatccctatagtcaacgaaaacgatacgctatccattagcgagatcgagttcggcgataacgacacgctttctgccattaccgctgctcttgtaggggcggatttcctgttcttgctcacagatgtggactgcctatatacagacaatccgcgcactaatccggatgctcgtcctattgttctcgtgccagagctatcagagggccttccgggcgtcaacacttccagtggttcaggctccgaggttggcacgggcggaatgcgcaccaaactcatagccgccgacctcgcctctaatgccggtatcgagactattgtgatgaagagcgaccgtccagagtacgtcccgaagatcgttgactacattcagcatcacttccgccctccgcgccatatcggaaacggcacacagcagcagtttctcgatcttcaggatacggagctcgaacagttgcgtcgctacgatgttcccatgcacaccaagttcttagctaatgacaacaaacacaagcttaagaacagggaattttggattctgcacgggctcattaccaagggcgccattatcatcgacgagaacagctatgataaacttttgtcaaaggatatggctagtctgactccaaacgccgtgatcgaagtccgagacaacttccacgaacttgaatgcgttgatctcaaaataggccagcggttacccaatggcgaattggatatctcgaagccgattcagtctgttggatgcgtccgctccaattatacgagtctggagcttgcgaagatcaagggcttacccagtgagaagattcacgatgttttgggctacagtgtgagtgaatacgtagcacatagagaaaacatcgctttccctccgcaattttgagaatattcccttttttttaccggattaaaaaaaaaaaaaaaaattctgttatagatgcacatcatatctctctcctttttcccgcttttatatattcgttcgtattagtcacaacaaaaaccaaaagaatactcgaaatgttagtttatatatatatatatagtgtgcgttctttgcggatatggaaaatcttgatatctgctgcattcacgactatgtcgcgcggcaaaggtatgctcagcttaccgttaatgtataaaatattctctgcgaagttgtagctcggagagaaccggtccggcttcgagttcggagctttgttctcaataagaattcgcagcttgtaggcggcccctttgaacctcttcatctttacctcgtattccggcacgtcctcctgctgctcgtgcggtgcaggtgcaggtgcaggtgcctgtttcaggtttctgtgagcaatctcgttcttatcaatctcctctatcttggctccggagattttgttctcgatagggaacaatggtggtagtgttccatcgtcgggatcattattatcatcgccatcgtcattccttcctctcaatatactcatcgggtctccggcctcctcttctatgattttatgcatttttgccttgtaatcttgatgtaactcatcattcaatacctctagtgcaggaagctcagcgcccttcttcttcatcttggggaatgcaatgcgatctctgcacaataccaccgaatctcggatctcacatgactccaagcaccattcgaccagtatctctcgcagttggatatcatcgcatatccagcgcgagcaatcgctatttatgcagcaatcccacacatagcactcctgccccttcttgtcatggtccatgcggtagcaggatgtaataataggaatctcccattcgttttggatgatgagcgggaacactatccttgcattaaaatcgacctcaggtttgggcactaacggagagtgacaaacattgatgaacaccttcctgccatcttgcagtttttccggcccattagcggataatagttttgtcttaattacaaaatctgcgatgggctcaattttagacaccgatccgtctgcagcgtccaccgacacgtacttgtcctcgtttctatgacgttgcttaattggtctcaataagaaatcggccatcggttaaggtctgtttgttcgctttgaaaagtctgttccctgtattcctttttcttccatgcatatgaattcaagaattcctagtttttttctatcattattgtcttctgattttttttaaggaaaaaaaatatcaagagtaaaaatagtgatcaggtactgaatcctgtatttgtacaatactgcaatctagcaccaaatttggccaaggaagtgcctatgtgttctccaactaatttcttatatgagcccttttccagcgatgctgtgacgcagaactatgaccaaaatctaaaatgcaccaaatgtggcgcctattattcgatggcttgttccctacgagaacagaatgtttggacttgtctattctgcaaccaatcaaactcaaatgctgaattgccactggtaccttccaacacctatacattgacttctgcaaagaaagaaatactttcaagacggaccattatgattatagacgctatttgcgatcctcatgagctaaattatttagtttccattctatgtaataattacatcacaagacaacaagagccactatcaataattactattcagcaatcaggtcatgtgattttacacaatgctgtgaatcacagacgtgatgctgtattttcaataaatgaatttatgaccaaatataatcttgataaattaaatgccagttacttcgagaaaaaaatttcagaaatcaatcaagaatcatactggtttgataaatctactcagggttctttaagaaaattgctacgggaaatatgcaagattgcaaacaaagtgaatatcagttctaaaagggacaagcgttgcaccggattagcgctgttcgtttcatccgtactggcgtctcagtgcagtttgtcagcctactgtcatatagtttcattcctgaatggtccatgtactaagggtggcggcaaagttatgtcaagagaacgtggtgaaagcatgagacaaaaccaccattttgaatccaaaagttcacaattgcaactatcaaaaagtccgacaaaattttacaagaaaatgcttgaaaaatttgcaaaccaatcgttaatctatgaattctttatagcttcattggatcaaatcggtatactcgaaatgagtccattaataacttcgtcaatggcagtttctcagtttgattcattcaatgatgagagattcgcaatgtcttttcaaaagtacctgaacttgcgtgaccataatgccatttacaattgtcattcaaagataatgaccgcaaagaacgctattgtcgttaaggacttcccaaaatatagcttaaaccctaaaaacctttctctaccattagaaatctcactaggtcacaattcagctgaagctcctatacagtttcaaaccacttttgaaaatcaaacggaaaaatacataagaattgaaaccctcttattgccaaaagccaatagatcatttggggcacaaaatgaaattgtgttttcaatgaaaaagatagcctcacgaattatcgatagctttgcttactcatccaagcacactaaagaattgatgaagcaattgtttctattaccaaatcaaatccggggaaaagacgtagatatggtcaatctgatacagtggtgttatcatatatataggtctccaattctatcggttcggaatacttcacctgatgaaaggtacctttttcttcaccgaataataaacgcttctaaagacacatgcctttcattatgcaaacccttcatctggagttacagtgatttgaaacacgactggatcgtgttggatgtcccattaacaagagcccagatacttcaagatgataaaaccaccatttgtgtagatggtggctcgtacttagttttaagaaggggaaaacttttggaaaaagaaggtcgcgagctctgttgcaagcttttaaatgacttgcaaaggtttccgcagccattatatgttgaaactaaaaccggtggcagtcaggaccgtttcttgaaaagcaaaattattcccttggacatcactgacaaggaaactcttggtacagaggatatgacattcaatgaatatttcaacttgttcaccgatctaagtggaagcaaataactcgctaaatattcttgctgcactttgcgacgcctgtattggcgaaaacaaaaagtaaagaaaaaaaaactttagatgaaatagagcaaaattccctaagacaatagaagatacaaaagcaagttgggcccttaatttcatcaaaggtatagcatctcatcaaatagtcgcttgtttatcgcaatacttgcttattgagtagttgtattataacgttatataggatcttccatatggaaagttttgaaaatttgagcataagagacagtttcactagcggaatggaacacgttgacgaggagttaggaggcctctccgacctaagtatatctaagcaggggccaactttgtcaccacagcttatcaaccgatttatgccccattttccctcgagcccatcacctctgcgaaatacattggattttagtgctgctaaagctgatgaggaagaagatgaccgaatggaaatagatgaggttgatgatacaagttttgaagaagaatataataacgagccaatcgaaactcatactgaagcgactgagaatgccgtggtggaagaaatcgaggctaccccagaagaaagacaaaagcaagagaagaatgaaagccaagaccaaagtgtagaagaggtcgagaacattgtttcaccgcatcgttcaactgtcataaaggcattattatcaccgaccgatttaggtgtggccgcagctactaaagttgaaggtgttgtgccattaccaccatcggccaatcaagatgacaatgaaagttcgaataacaacgcagagggtgaagacataatcagaaatgaagaagtcgaagatgagatcaaatcatcacttggcaaccacaagtcaagccagtacgcaaatgcgttcgattcggaaataatcaagagggaattaagatcaagatcaaaatatcaaccaattcaggtttcattcaatacacacaactacttctattcagataaggacggcattaaaacttattctcttactaaaccaaatcacaataaaatagatgaattttacgaccaaaatgaagctttcaagttgcctaaaccatggtcacccaattcacatccggcatcaagagcgtcatatgccctaatgtcatatttacagttatttctcaatgcgatcactacagtagtgatttttagttttatactctcatttatcatagcgcttcaaaaggacttgaaatccacatgggaacaaagaaaacatgaactgcagtacgaatccagaatttgtcaagagcagtacctcacaaatcgttgtaaccagacgcctggcttgccggctctgggcgaacaatgtgctatatggaaacagtgtatggacagaaataacgatatctttttccgtgcaagatcaacgttgagcgcaaaattgttcggagacattatcaactcattcatagatccattaaactggaaaacactatttgttattttttgtggtgtgataacttggtgtttcagttcgaatttcttactgggttttgtaagagccaagagctactatggcaatggcatcaaaacatatcccttgccatcttcaccgaaatcgccgacatcagaagaaacacactcatctatgacagcatctggagaggactcacacctacttaagcaatagattgtgctatctgggacagtaacaatgcttatctacgccatcggacatctcgggaagccaactccgaagccgacaaaaattggataggcctactatataagggtgacaggacagctgactttactccagaagtatatccatggaaaatatgtaataatacaaacaagttaatataatctatattgtatagaaggccaattcaaattcacaggaattatgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaaggatatatgacaataatgaaagagcgcttttcccgcagactaaccctgcgaaccatcaacaagtactggcaaacgtcacacaagccacggaaaaagatgtcatgaatgctgtaaaagccgccaaggatgccaaaaaggattggtacaatctaccgttttatgacagatctgcaatttttttgaaagccgctgacttaatttccaccaagtatcgttatgacatgttagctgctacaatgctgggccagggaaaaaatgtgtatcaggcagaaatcgactgtatcacggaattatctgacttttttagatactatgtcaagtatgcatcagacttgtatgctcaacaacccgtagagtcagcggatggtacttggaataaagctgaatacagacctttagagggatttgtgtatgctgtttcaccattcaactttactgctattgctgcaaacttgattggggctccagctttgatgggtaatacagttgtctggaaaccttcacaaaccgctgccctttcaaattacttattgatgactgttttggaagaagcgggattgccaaagggtgtcataaatttcattccaggtgatccagttcaagttactgaccaggtattagctgataaagattttggtgccttgcattttaccggttctacaaatgtctttaagagtttgtatggcaaaatacaaagtggcgttgttgaagggaagtacagagattacccccgtattattggtgagacaggtggtaaaaatttccatctagttcacccaagtgcaaatatatcacatgcagtactctctactattagaggcactttcgagttccaaggccaaaagtgctctgccgcttccaggttatatcttccagagtcaaaaagtgaagaattcttatccgatatgtttggcatattgcagtcacagaatgttgtcccaatgaacacatccgcaagtccaatttctggtgggaatttgcggggatttatgggtcctgtcatccatgaacaaagtttcgacaaattagttaaagtaattgaagatgcaaagaaagaccccgagttggaaattctttacggtggacaatacgataaaagccaaggttggtttgtcggacccacagtcataaaagccaagagaccagatcatccatatatgtcaacagaattttttggccctatattaactgtttacgagtatccagatactgaatttaatgaaatctgtgatattatcgataatacgagtcaatacgccttaactggtgctatttttgccaaagatcgtaaagcaattgaatacgcagatgagaagttgaagtttagcgcaggaaatttctacataaatgataagtgtactggtgccgttgtttctcagcaatggtttggtggcgcaagaatgagtggtaccgacgataaggctggtggtccaaacattttaagcagatttgtcagtattagaaacacaaaggagaacttctacgagttgactgatttcaaatatccatcgaattatgaataaaaaaatttttgtggaatagaaccgcgaatgcagtcacttcatccatcaactcatgtaaatgttagattatcgaaaaaagggttttgattacttcattaggtttttttagttttacaattttaatttatctaggtaaatagtttaaaaatattcattgaaccaaccgtccaaattcccgttctatattctgtcatgacttacttattcacgttgctatttattcgccgcatattcattctgtttttggcataaggacccgtccggaaacagaacatcaatttattaaatacgtccattcgtaagcttaaagatggaaactttggcgagcagtccctgacaagaaaaataacagcaagaaataatgattttaaccacagctagattaaattgtagaccagtcaccgttcctcgtctatttaatcgttcttttagtcaatctttcataattttgaagaaaaaaagttctacccctactgagaaagtcgaagaagatgaaattgacgtgaatgaactgctgaaaaaggcagaaactcaattcaaaaaaactttagaaattcaaaaacagaaaatgaatgagataaaacagggaaattttaatcctaaggtattcaatagtttagtgttcaaaaataacagaaagtttacagatattgctaccacatccttgaaaggtaaaaatgcacttttaataacagttttcgaccccaaagatgtgaaaactgtgatcagtggggtgcttgctgcgaacctgaatttaactcctgaaagggtcccaaataacgatttgcaattgaaagtttcgttaccaccaccaactacagaatcccggttaaaagtagctaaagacttaaagagagtatttgaagaatataagcagtcatcgctaaaagactcattaggaactatcagaggcagtattctaaaggaattcaaaagtttcaaaaaggatgatgccgttcgaaaagctgagagggatttggaaaaactgcataaggattacgtgaacaagcttcatgaccaattccagaaagttgaaaaaagcattgtaaaatgaggaatttcgtaacgtgtatagaatcaaaaaatcataaatcttgtacataaaaagttcattttatataataataaataccaaattattgataagtttgttgcttcctctaaagtaaactagctggcttctttagctaaagagaacagtgactttattctttgccatgtggaatttgtataagctcctacgatgaaactctttacaaaattccaagccttagcattgttacgaatagggtagtctaatggttttggaatttgagtggagacaaaaggcaaagtatcaaaacagacacttttggcattgcacaaacccaaaagaccttcttcaccaccaaatttaccgtaacctgaaccattgataccaccaaatggtaattgacaaacatagaatgtagcaaaatcattaatggctacattaccagtttgtaggctatttgcgacgtaattgcattccttgatatccgcaccaaacacagaaccacctagaccaaatggcgcagagttggctagttgtacacaatggtcagtattcttagctttcatcatgactaaaattgggccaaacacttcgttttgtgctattttcatttctggagtgacatccaccaaaagagttggttggaaataatgaccttgtggatactttggatgtttgaagcgggaaccaccttgaagtaaacgagctccctttgcaacagcatctttaaccaaagcttctagttcatcgaatctgttgtcagatatcattgcccccatatcaacattttctaaatgatcaatatcagacccttggcgtagtggatttgcagtcatacggtcattcaaaatcttgactaaatcatcataattttccttactgacaataaccctctcaataccaatacaattttgaccggatgattggaaagtacccctcatgatgatagaagataaagcatctaaattcttagctgagtctaggacaataaacgcatccttaccaccaagctccacaactacgggtgtcaatgatttggcagcgcattttagaatatagtgcgctacgggctgactgccaataaaagtgatatgtttgaaaccaggatgagaggtgaaataatttgcggaatcatcattttcagttggaggtaaacaatagcacaactgaaccaaatctggatcttcatcacaagcttccaaacatttgcggatcagctcgacgaaaaattccgaagaccagacaacttgttctgaacattttactacaatggcattccctgtgaacaatgctgcaataattggacccaataagttatggaatggatagttccaggaaacgatagaactgatcacacccagtggttcataacggatttctgcacctttataccacttcatgaaaaaattagtggggcccggacgtctcgaaggttgcaacgctctttggccgtgctttatagtccattgaattttttctaaagtaaccaagatttcacccatcgatgcgtctaacattgtctttcctgaatccctgcacgctactctcgcaataagatcttgattatttagaatataatcatgcaaagaagccaaaactctcaatcttcttgagaaatcagaattgccccaagtagattgagctttgcctgccttagaaaccatttcatctatgtcagcttccgttttcgatggaaaagaacctagatattgacctgtggcgggacaatgacattgaataaagtttggttcttcaggattccatatgttagtggaaacagacctcttgcccttccaattattttgagcggcctctggtgcaggaagggagaatttgactggcttataggacgaggaacactttgctggggtggagattatcttgaccaaaacatacagagtgaaaattgaggcaactagcgttgtaatgcctatcagtttttggttatcttgaataatttggggttgagaacgcattattgcgttttgcttctccaaccataagttaaagtaagcttgaactgtggagttcaaatggttaatcatgtctgaattcagatagaccttggacatgatgaataaacgttcgataaaacagaggagaaactgaacgtgaactgtgaaaagaattctactattctgcaaatactattataattatatagtaatccccatcggcgtttagtatttttcgttaataaaataaaaatagagagaccatactttctcctttacaaccgatatactaaataacacatttttgattatactactactcgtttagcagatagagaaaaaaaaaaaaaaaaaaaaaaggctgaatggataaagcgagagtcgtaaagaccgaatgcaatgtcagtttatacatttttattctattggtattatattataaaaagatatatgattagaaaactagaatgtaatgcaatattacaaggcattgatatggacttcagcagaaggcttgatgacagtctcgatcaaaattttgacaacgtcatcctttttcttctctgcaattttcttaatctcagctaattcaccttgcacaccagcctctgctttcttttccaattcaccaacaccaccggcattcttttgttcaaactccttcaattccttgtctttttgaattttgtatgagtcgatttccttggctgcatcagtcttggcttgcttcaacttatcttgtctgtactttctagcctttgatactatttcgtgggcttccttttcagcttgtagtagggtggcaattccgtttttttgggactaaagagaatattacatagttctgagcaacaatgaaaaaaccaatacctttgtcacgaggtaccagtccaacaagagagcacagttttaaaaaagtttttcatgttagtaagaacgcttgttagagacagaagtgttgacacgtaatgtaatggcacataccattctgctttgtataccttgcacactttggagattgcaggaaaaaaaaaaatgtattgtttaaggtgtgattgctttatctatcacgctcccttttagagatgaaatttttgatacccaaggcagggtaacaaattgaaaaaaaaaaaaattcgcggtaataatagtggatgtcaaagttcatattcgatgagatgagctggaataggagtccagttaatagggaagggtgtggcaatttgcaagtatggcggtgttgtgtggtgtatgcggaataaaagagttcaaatacaagtgtccaagatgtttggtgcaaacttgctctttggagtgttccaagaagcacaagacaagggacaattgctcaggtcaaacacatgatcctaaggagtatatatcgagtgaggcgttgaaacaggcggacgacgacaagcacgaacgaaatgcttatgtccagagggactacaactatctgacgcagttgaagcgaatggtgcatgtacaaaagatggatgctagaatgaagaacaagcgggttctggggcctgtgggcggccacaactctaatttcaagaagagaagatacgatatagatgaggatgatcgtgatagcacggagtgtcagaggataattaggaggggggtgaactgtttgatgctacccaaggggatgcagcgatcatcgcaaaacaggagcaagtgggacaaaacgatggacctatttgtatggagcgtggagtggattctatgtcctatgcaggaaaagggtgagaaaaaggagcttttcaaacatgtcagccaccgtatcaaagagacagactttttggtgcaagggatgggcaagaacgttttccaaaaatgctgtgaattctatcgcttggctggaacaagctcttgcatagagggcgaagacggttcggagaccaaagaggaaagaacacagatcctacagaagagtgggctcaaattctacacgaaaacgttcccttacaacaccacgcatataatggattcaaaaaaactggtggagttggctatacatgagaaatgcatcggagaattgttgaagaacaccacagtgatcgagtttcccacgatattcgttgccatgacagaggctgacctaccagagggctacgaggtgctacaccaggaaccccgcccacttgagcatacgagtacactgaacaagtttattgacaatgcaagggaggaggaagacgctgaagaggactctcaaccgacagaagaacctgtacagaaggaaacacaggacgccagcgacagcgacagcgacagcgacgatgactacaatccgggcttatccatggatttcctcactgcatgagccgagatacataaggttgaagattactatttagactatctatctatacgtatacaccgcaatatacaaacagaaaaaaaaaaaaagaaaaagcattcgtaagaactcacagctccagagcacgaacatactggtacgccaaatcacatatttcgttgctggtgtccggccccaacgagtcggatgaggttttgtactccttggcccggatttcagctaggtgtccttcgatgcctgcaatcttggtctcaaactcgcccgcttcgtccgcctgcagttctatcaggagacccttgaacccagtggaggagaagaggttgacgagtcgcacggtgagcccgtccaagatcaacgtctcaccggcatcacccttgatgagctgcctctgcatccagatgttggacagcttggacgacaaaatagtgtctatggactcaggaacgcccgtagatgagccattgaacaccagcgccggagggatatccgccgctgcggcagtcgtcaccatcgctgagttgtccttgattagcacggtctgccggccatggtggtggaacgttatcgagtacatgagcttggagacatccgcgggtaggttcttgatagagcaccggtacgtccgaaagtctatcgaccaagggtctcgcacggacaggatactattcgagagagcatccttcagttccgttagtgtagcgggagtggctctttccacgaatataacgctatatacataaaagagagaaaaaaaaaactgttgttagcaacaggtagttcaattgaagaaattccgatgcgccacgaaggacgctccagctttacatacgctgattttcccatgatggattgctactgtgctttcgagcgccgacttacaagatttgctcttccagtaaaatttcactttgggaatcacaccgcgaaactggcatactaacgcataagaaaacacaagaagagaaacaacgataaaatcacgcggcgacatctacagtccacctgccccttccttcgctcaattgcactttcccatgcgcactacccatctatatagctatgtattctatatccacgcctgcaaacgcacactgttcgtcctcagcctctatgcgtacgagccagacccttgctcccagtagataacgcacgcaaaactcaaaagatggcacaccgggggaacaaaggagagtagagtctaccgaacgtcaccgctggtaccatgcagccatcactacatactagcatcatactaccacgatcacagttcacgacacatcacgtgtgtgctcgtttagcggtcaacccgctattgttctccagccagcttttatcgttttgcatttttttttcgggctgcttttcgttcttcgaggacaaacgcacctgtaaagctcagcgcgaggttatatatatagtataatatggtgaacaatgtagcttaagtttgcgttcctgtagtggtcaccgctacgctagacaacgaccgcggttttcaagtgatctactgtcgcacatatcatgccgtttggaatagacaacaccgacttcactgtcctggcggggctagtgcttgccgtgctactgtacgtaaagagaaactccatcaaggaactgctgatgtccgatgacggagatatcacagctgtcagctcgggcaacagagacattgctcaggtggtgaccgaaaacaacaagaactacttggtgttgtatgcgtcgcagactgggactgccgaggattacgccaaaaagttttccaaggagctggtggccaagttcaacctaaacgtgatgtgcgcagatgttgagaactacgactttgagtcgctaaacgatgtgcccgtcatagtctcgatttttatctctacatatggtgaaggagacttccccgacggggcggtcaactttgaagactttatttgtaatgcggaagcgggtgcactatcgaacctgaggtataatatgtttggtctgggaaattctacttatgaattctttaatggtgccgccaagaaggccgagaagcatctctccgccgcgggcgctatcagactaggcaagctcggtgaagctgatgatggtgcaggaactacagacgaagattacatggcctggaaggactccatcctggaggttttgaaagacgaactgcatttggacgaacaggaagccaagttcacctctcaattccagtacactgtgttgaacgaaatcactgactccatgtcgcttggtgaaccctctgctcactatttgccctcgcatcagttgaaccgcaacgcagacggcatccaattgggtcccttcgatttgtctcaaccgtatattgcacccatcgtgaaatctcgcgaactgttctcttccaatgaccgtaattgcatccactctgaatttgacttgtccggctctaacatcaagtactccactggtgaccatcttgctgtttggccttccaacccattggaaaaggtcgaacagttcttatccatattcaacctggaccctgaaaccatttttgacttgaagcccctggatcccaccgtcaaagtgcccttcccaacgccaactactattggcgctgctattaaacactatttggaaattacaggacctgtctccagacaattgttttcatctttgattcagttcgcccccaacgctgacgtcaaggaaaaattgactctgctttcgaaagacaaggaccaattcgccgtcgagataacctccaaatatttcaacatcgcagatgctctgaaatatttgtctgatggcgccaaatgggacaccgtacccatgcaattcttggtcgaatcagttccccaaatgactcctcgttactactctatctcttcctcttctctgtctgaaaagcaaaccgtccatgtcacctccattgtggaaaactttcctaacccagaattgcctgatgctcctccagttgttggtgttacgactaacttgttaagaaacattcaattggctcaaaacaatgttaacattgccgaaactaacctacctgttcactacgatttaaatggcccacgtaaacttttcgccaattacaaattgcccgtccacgttcgtcgttctaacttcagattgccttccaacccttccaccccagttatcatgatcggtccaggtaccggtgttgccccattccgtgggtttatcagagagcgtgtcgcgttcctcgaatcacaaaagaagggcggtaacaacgtttcgctaggtaagcatatactgttttatggatcccgtaacactgatgatttcttgtaccaggacgaatggccagaatacgccaaaaaattggatggttcgttcgaaatggtcgtggcccattccaggttgccaaacaccaaaaaagtttatgttcaagataaattaaaggattacgaagaccaagtatttgaaatgattaacaacggtgcatttatctacgtctgtggtgatgcaaagggtatggccaagggtgtgtcaaccgcattggttggcatcttatcccgtggtaaatccattaccactgatgaagcaacagagctaatcaagatgctcaagacttcaggtagataccaagaagatgtctggtaatcagcccactgatcaagccttcggcgcggttgttcaaccacacgatctgtatcaaagaaaaataagttagataaccaaaaaaaaaaaaaatttcatactcactataagaaatcatacgcagttcaacttttgcttttacatacaattttatctatatattcgtgcttctgcgatgtccttatttatttaatctctcgtcaaagggttgtttacctggataacgataccgttctcattgttcttaaccacggaaacctgtgtcaaatcacagaccacataatctgcacctgcgtcaaataaaacgctcttatcatacgaggatgttatacccacagtaattgcgcccattgctttgccggcctttatgcccacgggtgcatcttcaaagacaacatacttcagatcctgtttaccagttaattgcaaatcttgacgcaataaatcacgagctcttgagtaaccctcgggatcaggcttaccgttcttcacgtcaaatccagtaatgaaaactttgggctttccaacatttttcaatattgtctcgaaccatgaaaatgccaaatatggagaaccagaggtaacgatagcccatttcctttcaggtaactttttttgagtctcagtatctacatctaacgataacaataaattctctgcaccagggataaggcttactgtgtccaaataattatctgccatatccttttctaacgcaagaacacctttattatcggtattgtccaattttggaaaaaatttcttcatcatttcttgtgatcttgcaccatgggaatgcttgaataactcaacaggatcaaccccatgctgacggcataattttttccaggcactttccgctgcagttgttgtgctgacaatagtcccatctaggtcaaaaagacaaagatctactgaaaattgtggcattttttttttttatttttttgacgtaaattttttatgtatatagcagtaaatgtatcgataacgtgttggctaatactatagtgaataacaaaaagtactcttagtctccttttagcatttgttttcaccaaagaagatgttgccagcgcattttaagtttttgaaaaatcctcgagaattaccccttccccacatttaaaaataatgacggagcgtattcaatctacggaactattctctacgagaaataataagatcattacgtagttcttacatcctgacgcaattgtgattaaagataatgatacaaaactgaatacaaagcattccaacgaaatacagttgatggaagtgttttgcgctaaggaagattaacatataaccacacaaccatcttcgaagaaaaactcaaaaaaaatcttacctcttcagtacctaaaatgacatacataattcgactttttgcttgtccatatgttttacatctatatatattcgttcttttgtcacatttttgtttactcaggcccttgtcaaagggttgtttacctggatgacaataccgttttcattgttcttaaccacggaaacctgtgtcaaatcacagactacataatctgctcctgcgtcaaataaaacgctcttgtcatacgaggatgttatacccacagtaatggcgcccattgctttgccggcctttatgcccacgggtgcatcttcgaagacaacatacttcagatcctgtttaccagttaattgcaaatcttgacgcaataaatcacgagctcttgaataaccctcgggatcaggcttaccgttcttcacgtcaaacccagtaatgaaaactttgggctttccaacatttttcaatattgtctcgaaccatgaaaatgccaaatatggagaaccagaggtaacgatagcccatttcctttcaggtaactttttttgagtctcagtatctacatctaacgataacagtaagttctctgcaccaggaataaggcttactgtgtccaagtaactatgggcaatatctttttctagagcaagaacacctttattgtctgtatcatccaatttagggaaaaaccttctcaaaacctcttgtgttcttgcaccatgagaatgcttaaataactcggaaggatcaacaccgtattcgtaacacaacttggtccatgctttctctgcggccactgttgtactcactatggtaccatctaggtcaaaaagacatagatcagctgaaaattctgccattatcctttgaacttcttacgtgagtggcaacgtaaccaacaatctccatcagaacgttatttccaacagaataatcgcgatcattaaaaatgaaaataaaattaaataaaatacttgcaataaaaaagttccatgaaatttatatcattagatggtaccagagcctataatctcatagatatacgcttccttctatagctgaacaacggttgtttgaaatgtcggggttaatgtcggaatatataggaatactctgacgtgtctgtatcacggaacataaccgtgattgaaaattacaagaagccaagactctaaaggatatgcggtagaaggcgtgtgtagaagagcccagtgtatattttttcaccgataagatgaagtagataaacggaatttctggcaagttacttggcaaaaggatacatagcacgaattactttattataaatattgtaactgattgccttgaattgatgttaatgagaatcctaggacccttggtttggtcattagcttttcgtttttctttgcgcgtcgttaagaatgaaaaagttctaatatgtatcgtatcataaacgacagcaacttcgagaagtacattgaatggaaatcattctgcaacacctttatagcttcaacataggttaagttttaagcatttcaagtgcttttcaattaagctatagaaagttctttcgttagaaagaaagacagttaaacaagcggcaaaagttgatgagcaatgaattggtcttttctactacagctggtaataacaatattgttaattgtgctgggcgccaactggttgctaagctcttttctacttgattttaagagagatttaacaggggtggctttgtcacagcaatctagcatatccagtgttcgtaaagaaaatgaaacagcatattatcgaagcattttagtgcccacaggattcccattgacgacaggattagggctatctttaaaatacaaaataagaaatggcaatttcggtgatgtttggaatgccataatggaagtttccaagggaaaaaacataattaaatttacaggaagagaaaaaagttattcgttgagtgaacttaatggtatggccaagcgcatatttccgaaactttccaataagaatttcaaaaatatcggtatagctaattctattgctaccgtagagggttttactctctccttggcttccatgatgacctctataagaacaggttcaatacctcatttcttgccagctgttcctagacaacgactagaagatgttgatgtcctgatcatcgactcatggaagtcttttaagatgctaaacggcagcgaggattggtacaagcttattgttgtttgcgatgatcctatcgaatcactacaatttgatgcgaactgtgatgttatcacttggaaagaacttatcgacggttttaccaaggatacagagtaccaatacaccccgccagatgacaactctgatgataagaaactttttgcatacgtaacttcaccatggaatggaactaatagttttaatcaaatctgtctggtgagtaatatagcggaattcatcaaagggttccccttgggaaatgaattgaatagtaatgaatacctaaccatttcgacaaaattggcaaattctagtgcaagcctacaaatttggggaaagctttttgcagttttgctgcatggtgggtctgcatctttcatcaatcctacaacgatagattgcgagtcgttgcaagaaactacgttactgtttaccgaaacaaaggatgttgtcaaattaattgattctaattctagaagtgggctgctgaataaaatctacttatcctgggccacgaacttactgagcgagggtatttttacgaaaattgccagaatcgagccacattctcttgaaaaattaagatgtgtttatttggcagataatgtgaaagatgctgaggttatttcgacatttcctgaaaaaattcctcagctaaaaaagactaaccgaagaatcaccccaagcactgaacaattgaataaaataagagctcaattaggatcccgtgtagtcctcgagttatattgtccctacgctatcatgggacctgtggcacataccaatttttatgactatagggtttttggaaaatctgtggacgataacgttgtatgttatggaacactaagtacaacattagaaggaaaaatggtagaaacggaaacaaaccctcatttgaacatagagaagaagcagggtatgttatgtattcgtggttttagcataggtaaaccagtagagtccgatcgtttagagaaagctttgcatttagctgaaaggtttggaggaggtgaaggatggatgcctctagttggcgtttttggactatttggccaagacggttgcttatacatctataatcaatgagcattatctatcgctttattatttattatttattattatcattattattattatcattattattattactaccaataccttctatatccctgtgatcagctaaaatgattcaaataactgtcattttaatcgtacattttatattaggcctaatgtgctgacgatcagtcatatttcaaatggccatcaacacagttccaaaagtctgtgatatattttgtttgttcgtcactttcgttattaattgttcccctcacagccaaatatgtcctattgtcgacatcaatactccattcacctggattggcacctactacacgaccgcccacttctttcaaaatacaccatccagcacacacgtcccacgaatagcaaccaccatcccaataactatcaaggtaccccatagcaatatatgccattgtcattgcagatgatcctaaatttctgaatccatgaacaaaaccgtaatcacatgatagtaatttttcatatgtggccatttttgtctgaaaattctttccctctctagcggaacctggctgtaatgccactacggatttatttagtattagagaacccatagattccaattttgatttatagtcatagtccttgttgttaactctcatcccatttcctttagaagcggataccagaagattaatgtgaggattatatataacgcctactacgggctctttgtttactgtgagcccaagagaggtacagctaaatgggaaatcatgaacaaagtttgtagtcccatcaattggatcaataataaaggtaggatcatcagtaatcacggtctcccctttcacataactttcctctccaataaacttgaaagttggatattgggtttttaccgattcccaaattaacttttcgacctgtttatcgatagcagttacaatatcaacgctcctggagccagtcttcaagtcataatccttttgagtgccggacttggatttgatgattggtcctactttttcagtagccagttcacagaggaatttctcgatagaagctagatcaatggtcatggtatatgtgtatatgcgtgtaccagctgttgatttccttattcatccaaaaaaaagaaaacactggggttatttaacaagcagttaaatgtgaagtaagagataaaagacctatattaataccatttttggaaaagcaacgtgcgcaacaatgaaagtcactcgatgcatccattattcaaaaaaaagttttttttttttttccatacatcatcagatgaaaaaatctcgctatgacgcacgccagtcaatattcactcagttcttccgaaaggaagcagaagaaagttctctatacttggaaatgtgtcaatgaagatgttatcagattcattttctgctagctactatatttctacataagcaagtagtaatctctttattaattacacgtggttttgactcattggcatatgtatatatttgtgttgtaggtgctcgtgaaaaaaaaaagctattgatcatactcatgctcacgcaagtaggtagcaacgatttcacgatctctgctcacccattgcgccttggatctaatagtgtctaaggcttgagccagggtttgatcaaaacctttagtgacctttctactatagaacgcactaattttttcaagggcttcaaaagaggtaaaattagttaaacccaatgtcaacacgccacccaacacaggcgagcctggctgtaatctcttagcaatttcgtcccagtgttcttgcatccaagcccataacctttcaatacccttcttatgaactctaatgccttgcattgggatgtaaaaatcttgattcaaaactgtaccatctagcagataagacaatgtcctttctaaaagttctttgtcttcaaatctgcccaaagctctcaaagcgataatcttttcttctgacgaaacagggttttgatagatgttgaaaatcttttcgtaattgttttctccgccaagtctggcaacggtgttgaaaacaactgccttgaacagtgcaggtatggcctgtttgttcccattggcgtattcctcaaacatttctaccgcaatcgattgcattttttcattgccagaagtgcatgcggcactgaaaagggtcacttttaaacgttggatagcaaaggagtcgtcttcgccaatattccaccccaattcagaaagtttgttaagtactagatccaaagtaaatttatctagagcattcaatatatcctctggttcgaagacccaagtagatttcagagcggataaactattaatgatttgttcccaaacaacaaatgaatcctcgtttttccaattagaaattaaattcaagaagttagtagtagaggtatagccagatgcagaaagggcttttgcatctgcgactaagccaacacgatcctctacggataataaatttgcctgtttggatagcttagcccatctttcgtcagaataagaggtaatgaaaataccagattggtcaccattaatcttgaagaactcttcattctttaattcgaaagtagcagatttttcgttcaataccaatgtgttatcgatacctgtactgtctttcaaagctaacaaaatggggtatatggttgtatcttcctcttctttaacatcaccggtacttaaataacggtgttgagttaatgtgattttgttcttgtgttccttgacagataacactggaaaaccaacacgttttgtccagatgttcatcaccgaacaaacgtccttgccagaggcatctgctaaggcgtcccacaaatctccggtctttgcattaccgtatttgaatttattcaggtattgggacacacctttaataaaagtctcttcacccaaccatttggaaatcatcctcaataaagaagatcctttagaataagaaatagcatcaaaaatttgattgatttcgtccgcattattaacgggaacttcaattggatgggaagatcttaatgaatctaaatttagagcacgttgtaaattgtcagtaacatattgctcccaaactttccattctggttgaaacttgttgcaagagtaccaagacatccaagtggcaaaaccttcattcaaccataagccttcccaccaatccatggtgaccaagttgccgaaccattggtgggctagttcatgctgaataacctcagcaactctttgaatgcgatctaaactcgaattttctatgtctaataacaaatcaataactctataagtcactagcccccagttttccatagcaccagcagaaaactcatgaactgccaccatatccatctttggcaatggatattctatgttgaaggtgtcctcaaagaatctcaaggtcctagcagctaaattggctgcaaactgaccaaatttttcgtcccctggggtagaataaactcttactggaatacggaaattattgctttccacgtatctcaggtcagctacaataaatgctactaagtacgtagacatctttggagtcgtgttaaaagttgtatatttcttaccctctttgattgtttcattcctgacatccatgttggacaaatgagtcagaaacgattcagagaccaaagttactgcaaaagtcgccttcaaatttggttcgtcaaaacaaggaaaggctcttctagcatctgtggcttccatctgagtagtagccatgtacttcgtctcccctgtgactttatccgtatacttagccctgtaaaatcccgccatctgatcatttagaataccggaaaagataatttctaacttcgcagaaggtcctaggttttcaaaagttccattaggaaagacaagagtagctttttgttggttttcgtttttgttaacttcaatggcattgacaccctcaatacgtgcagaatggaaatctatttctaagtaatttatttgcacagagtttatcgaatgatcattaatctgcaggtcaatttttaatgacccttcaaacgtaaaagcacggaaattaggttctagtgtaatgtcataatgcaatggggtaacgttgtttggcagtacttcacgggacatggtattagctgagagggcaatttggcttgcttgaacaggaaccctcaaagaaaaatcacgaattgaataagcttccctgaagataattctaaatgattagctaagattactcataaagtcaaaagtttgatcgctaacaaaagggaaaaaaacggaaaaaaaataaaaaaatgtgtcaaactcccacagccaagtccaagagtacgaaaaaaaactttcacaacgagttcaaaaaatgtgggatgaagactcccgtttttcaccgcctagaaaacagcgtttgctgagaaaaaaaataaatcatcgagaagaagtatgtcatcataggatgttcccattgtaaggtgatgtgtaacatactcgaacaaagaatgtatagagctgaatatttctcctttaaatttcaaagaaaatgagaaggaaaatctcaaacagaaacttcgttctttttctcaagtaagcaaaagcttattgagacaaagcggaataactacgatattaataacgttgatgaagctcgaacaaagttagcgtcggttatgcttgcctatataaagatatatttgccttacattttcgttgaacgtagaatgatttttgcttttaataaattttttgttgttctttcagtgcttcttcaactttgatacgaaagcaagtgcattagtacaacaagaactggccacaactatactatactcattttttcttgcccgtgttttaaatgttttcatccacagcatttgatgggatgattggaagtgagacgttcgagaaaatccatattttgagtcaagaattcagataatatactgagatgattaggtatggctgggttctacaaaaacacaaatatccggctagcaatgatcactgagcaaattaaagcgttaactcactcattattgtagcttatgcgtttctcctcctctctttttttcctcgaaccggagtggaagatccaataacgtaatattactgatgttgttattaaagctggcaaaaataacatgaggcgtaaaaccgcactgcggtaagatgagggtataaggtggagatcaggcgaacaagctgttctaaatcatacatatgtacaatgagaacgtgtaacgatccaatgagcgtttcatgatgccattgtttaatcagagtgatgaaaaagaaatatttgcgaccttttttcgttacattgatcgtgaaattttaatcaaagataatataaggacgtgagatatttatctttttacttgaaattaacaatagaattgcgctaagcggaataagagctttcgtaaacctttctatttgcaccattgcgtcaacgtataaaatggtatgacctttacacaaacgcatgcttataatcttatgtttttcatagggtgtaatttggttgatgacgtagtctaaatttgatgctatctgcaattgaggtacatataagaggtcaatttcgggaccaacccttttaatcgaaaaaaacgtaattcactagggcaagggagaacttagcagctaatatcgtaaacctttcatactaaaaaaatgcacttaccatcaacaaaaaactcaggaccaatttccaagcttttctaggtgattgcctataacacaaaaagattcgctcatacatgagatttttacatgtaatagcaatttgttccgatcagttgaaggtcatcaacgcacggcaggtacatccacacctatcacaaagcccttcaataattcacctacgtaaagttataccgaaacatgcaaaatccatgaaaaattctgtatgataacgatcatatccttttgtattggtggtacgatgctcaaagatagttattgttgcacctgaggcaaaagcggaaatgaaaaatccagatggggccaaaagcagaagtattgtgtacaacaattgcttcagcagtttaccaaaccgtttcccagcaatcatcaaaagttgctttagccacatttccgcaagatatctttgtggctcaacgaagagggctattccaaatgcaatacaatactagccgctagtgatccatgcttataggcaatttgattgataactggccgttctattaaggagtcaatgctaaccacatataatgcatataggatttggcctctgctgaccgtaatactagacaaggaatataaaacaacaacgtaacccagcataaaaacgatataaataaaaaaagaaaccagatcataaagtttgagggcacatccctcatggtttcaaaatctcgtacattgactcaaacctcgagatcttgtttaaacgaacataagaacagcggtaccaagtgacacattgcgtactgtgtagtatgcgccgtatataactttttttttctgaaggtactttgaattacaatctattttttacagttcctatggcaggggttgaagatatttgggtctgaaccatagcaggattagtgttatagtaggtatgtgaatagaagctaacaaaatgagatgaacctcatacaaagtcgtagagaaaactgctaacagaagagctgcgccttgaaatcgtatctctaagcttataataaattgaaaggaaaaaatacgtggtaaatgcaagcgaccaaaaggctacggcccaacgctaacccgccgataggtgcataatctaatttacctccaccagcaggagccctttttctaagtaataagcaaaccagataacttacatcttgctgtaggaaacaaaagccggaataatggttcactcatattcttcgtgtgaaacacagaagaaatccaatatttgcttcagtatttatctctaaaaattggtcctacattggaaaccataaaccaattataaccggtgtacgaattgtaagctagttctggaaatgtcatgttgcgcaggtaaaagtggagctgaattgtatatctgttttgatcattattatccctctgggtgagtggaaatatcaataaaatgcaatggcacatttaatatccttctcttaattccgtgatttataacatcttgatgccagaaacacctttcggatccggcaataaagcggagattagcacgcttttcgccggtcctacggatttagtgttggctattgttgagattagtaatacgcagagaatttttctaccggtgaagcgaccatctcagattattaggtcaagcaataacacttgttattagatgcgttacgttcacctggaccctatataaaggcatatttgccttacatttggtgtatggtatcaccttgtatactaagaacatatatatgcagatataacaacaggatatggttgcagaatttcaaatagcgagtgcacagtcatcggcattgacatctactgaagaagagcattgttcaataaactcagacaaagccgcaaaactggatctggaattgaccagtgaacgaaaaaatgacggcaaacaatcgcatgaagtgaccttcaacgaggacatcgcggacccagaagatatagcacggcatatgagcaccgcccgccggtattatatttcctcgttaattacattcacatcgatggtaattacgatgatctcgtccagctggacgcttccttcaacgcacataatcgaacactttcatatttcgcacgaagtcagcactctgggaattacgctttatgtgtttgggctcggtataggacctttatttctgtctccactaagtgaactatatggacgaaggatcacatttttatacgcccttacgctcagtatcatatggcagtgtttgaccatttggtccaagaccattacgggtgtcatgtttggcagatttctatccgggttttttggttcagcctttctaagtgtggctggcggcgccattgccgatatattcgacaaagaccaaattggtattcctatggcaatatacactacatcggcctttttggggccctctttaggaccaatcattggtggagccttataccatcaaagttataaatggacatttatcacacttctcatcacttctggatgttgtctcgttatgatcatctttaccatacctgaaacctacaaaccaatgctgttaatacgtaaagctaagagattgaggaaagagaaaaatgatcaacggtattatgctgtcctggaagtcacccgcgaacagacttccttactttccgcaatctttctctcaaccaaaagaccctttggcctgttacttcgagaccgaatgatgggtgtgctttgcttctatactggattggaacttgccataatatatttatatttcgtagcgtttccttatgtgttcaagaaactttacaactttgggcccatggagattgcatgctcctatatcggtattatggtcggcatgatactctcggctcctacttgcttgttattccaaaaaacgtttgagtggagagtcaaaagaaataatggcgtcaagactcccgaaatgagattcgagcctctgttctacggcgcctttttgaccccagttgggctcttcatttttgcattcacctgctacaagcatgtccattggattgcaccaattataggcagtgcaattttcggttcaggtgtttatttcgtctttaccggtgtttttgcgtatacagtggatgcctatagaagatatgcagcttctggaatggcttgtaacacatttgtgagatgcataatggccggtgtcttccctcttttcggactccagatgtacaagtcaatgggagtgaattgggccggctttctcttggcaatggtgaccgtagcgatgattcctgtcccatttctgtttaccaaatacggtgcccgactgagagccaagtcgccgtatgcatgggatgattgatttttttgcatattttttcctttggatgttgcataatcttttcccgcttacgtcattggtgatagattgtttcggatcttcaaaaggcaacacgcataggccaaagaaaaaagaaattttgcattttttcatttttgcatattctcgcatgttttctttctttttctctagttttcgaatgtttttggctgcaatgtatattgtatataaaccataaaggtgcaaaatgccagatgtacgcggccaatcttaattttctagtaaaagtagcagctaaatctgaaactctctagcttgtaataaacgaaggatgactgtacaaattccaaaattattatttttacacggcttcttgcaaaacggtaaagttttctccgaaaaatcatctggtattagaaaattattgaagaaggctaatgtccaatgtgactatattgatgcaccagtccttttagaaaagaaggacttgccatttgaaatggatgatgaaaaatggcaagccaccctagatgcggatgttaacagagcctggttctatcacagcgaaatctctcacgaattggatatctcagaaggtttgaagtctgttgttgatcacatcaaggccaatggcccatacgacggcattgtcggtttctctcaaggtgccgcattgtcctctatcatcaccaacaagatctcagagttagttccagaccatccacaattcaaggtaagtgtagtcatttccggctattccttcaccgagccagacccagaacatcctggagaattgagaataaccgaaaaattcagagactcatttgcggtaaaaccagacatgaagaccaagatgatcttcatctatggtgcttctgaccaagccgtcccatccgtcagatccaagtacctgtacgatatttatttgaaggcgcaaaatggtaataaggaaaaggtgttggcttacgaacaccctggtggacatatggttccaaacaagaaggacattatcagaccaattgttgaacaaataacctcttccttacaagaagcttctgaataaatcgtaggttgttgcttacctgctttctagctttttactatcacacgcagggtgtgtggagtgaaatgctgatcgagtatgtatatatacatataagtactttgtatagaatgaaccacaagtttgtagcatcctttctcttctcttccatcctgcgtgctgctaaaccccgcccggcgcgaaaaatccacccggggtgctttagcgtggcttacgaagacctttttaaacatacttatactctttctcgaaggaagaaaataatgcagaagagaaacagcagaaaaaaaagaaatcatattaaatttcagaatcagtctccttttgcttctagtcatttaaccatcaaacgcgtttaaccgtttagaaaaccctcttcaacaactatttgttttgatactaatattagcacatctctattgccatttaaccactaattttccgtatagcgtttatgtttgatgacgtcccaagaatatgaacctattcaatggagcgatgaatcccaaacaaataatgatagtgtcaacgatgcgtatgccgacgtgaataccactcatgagtcgcgtcgaagaacaactttgcagccaaactcaacatcccagagcatgatcggaacattgagaaaatatgctaggttcatcggtcctggtttgatggtatctgtatcgtacatggatcctggtaactatagtacagctgtagcagcgggttctgctcatcggtacaagcttttattttctgtcttagtttctaatttcatggctgctttttggcagtacctctgcgccagattgggtgctgtcactggcctagatctggcacaaaattgtaagaaacatttgccctttggacttaacattactctttatattctggcggagatggcaattattgccacagatctggcagaagtggtaggaaccgctatttctttgaatatccttttccatatacctctcgccctaggtgtgatacttactgtggtagacgttttaattgttctgctagcttacaaacctaacggttccatgaagggtatcagaatatttgaagcttttgtttctttattggtggttcttaccgtagtttgctttactgttgaactgttttatgccaaactgggacctgccaaagaaatattttctgggttcttacccagtaaagccgtttttgaaggtgatgggttatacttaagtctggcaattctgggcgccacggtaatgcctcattcattatatttggggtcaggtgtggttcaaccaagattaagagagtatgatatcaaaaacggacattacttgccagacgcgaatgatatggataacaatcacgataattacaggccatcctatgaggccatcagtgaaactctgcactttactataacggaattactgatctcgctgttcacggtggcattatttgtcaattgtgccattcttatcgtgtctggcgctacactatacgggtccactcaaaatgctgaggaagctgacttattttctatttacaacttactctgtagtactctttccaagggagcgggaacggtattcgtgctggcattgttgttttcaggacagagtgccggtatcgtgtgtacgttgagtggacaaatggttagtgaagggttcttaaattggactgtttctccggcattgagaagatccgccacaagagcggtagccatcacgccttgtttgattttagtgcttgtagctggacgtagcggcctctctggtgcactaaatgcttcccaagtggtactttctctcttgctgccttttgtttctgcacctttactttacttcacttcaagcaagaagattatgcgtgtacagcttaaccgtaccaaagaactttcaagaactacagacaaaaaacccgtggccgaccgaaccgaagatgatgagaccattgagctcgaagaaatgggcataggcagcagctcacaggagcgcagcttagtttctcctgctccagaatacaaagacatgagcaatggaatgatcgtcaccgtgctcgcaatcatagtatggttgattatctccggactgaacttttatatgttactgggctttactacgggcaaagaagtacacctctaatataacaattctttagactagtataagtatacattttatccaagaataataacagaaaattccaatcaaaaagttggtgttaggctatactgatggccgtatcgctccatacgagccaatcagggccccgcgcgttatttccgccgcttacagctttctttgaatctccctatgaaaagggacctaattggtccggtcaaagcattaataaagatcaacaattgctcttgcttatcaaggtgccagatctcaaggttacctcatttctttacatttcatccacattttagcacacttatttattattacaatttgaaaaattgtatcacttctgagacttagtagcggagataaacagccgaacaattgtatttgacacataaactaataaatatacaacaatgttatcaagggccatattcagaaatccagttataaatagaactttattgagagccagacctggtgcttatcatgcaactagattgactaaaaatacgtttattcaaagtaggaagtattctgacgcacatgatgaagaaacctttgaggaattcaccgcaagatacgaaaaggagtttgatgaagcctatgatttgtttgaagtgcaaagagtgctcaacaactgtttttcctatgatttagttcctgctcctgctgttattgaaaaagctttgagggctgccagaagagtcaatgacttacctaccgcaattagagtatttgaggctttgaaatacaaggtggagaatgaagaccaatacaaggcctacttggatgaattgaaggatgtcagacaagaattgggcgttcccttaaaggaagagctatttccaagctcttcttaataataaggaaaaagctaccacacaacgtctgtaatttgttgtcctttttttatttgtggaaaattcctcaatttgaaataagattcgtatttattttgtaaaacgattttagtttttattttttttttttcttcccttttaccttattatttgttttaccctttatggatattcatccactcagaaactaatatatcaaaatcaacgataagatcacaagaggtgaaataagaaaagtaaaagaaaaatatttaaatttaaccattatgatttccactttgttttctctactctattacttgaacaaactttatttttggtaatgagggctggtcacagattacctttaatatcctttgttagtagcttttttgtgttctatttcaggaaagaagaatgggaaaaataataaaacaataaataactatataaaaaacaaaaacctagaatataccattaaagaattactattctattctgtgcttcaccgttgcgtcaataaatgtgaagttgatgtcacttcatactaaaaaaattaaagacaatttcctgaaaaaaatttttccactggagctcatcgcaaattttgaaaagtaacaaaaagcgtttgtatactgcataaagaatagtgtctgttttataagaaatattagacagcaggcagataaacctacgttccagactataaagtataaaatggctaaaaagagtaactcaaagaaatctacgcctgtaagtacaccaagcaaagaaaagaagaaggttattgaaaagaaatcttccacagccattcctagggaaagagttattaaagctgtcaacgagcttataaaattcacttccaagccacaagatgaaaataatgaagaaggaaataacggtaagaaaaacctattggaagatgatgaagaagaattgaagaaagatctgcaattaatcgtagtaaataataaatcattcaccggtacttccaaatcattcaaattgaaattactaaatgtcaaacattcgttttacaagccttggaaagaagccagtgcaacagcggttaaggatttcaaagttttattaattttgaaggattctgatattaagaaagtttcagaagatgatttatttgatcaattagattcagaaggaatcaaggttgatgaaatcatttgcgggaaagacttaaagaccgtttacaaggcatatgaggctagaaacgcttttatatctcagttttctttgattttggctgacgacagtatagttacatctttgccaaaacttatgggaggcaaagcctacaacaaagtagaaactactcctatatcaattagaacacatgcaaataaggaattttccttgaccactttgacgaacaatatcaaaaaggtttacatgaatcagttgcccgttaaacttccaagaggtaccacgttgaatgtccatttgggtaatttagaatggttaaggccagaagagtttgtagataacgttgaattaatttctgaacagttaatcaaagcataccaaatcagatccatttttatcaagaccaataggtcgcccgtattgccattatactataaccaggacgttcttgatgaacttgaagctaaaaaggacaaaatcgaagaaacccacgaagatgacatggtcaccattgatggtgtacaagttcatttgtctaccttcaacaagggtttgatggaaatcgccaatccttccgaattgggttcaattttctctaaacaaattaacaatgcaaaaaagagatcttctagcgagcttgaaaaagaatctagcgagtcagaagctgtcaagaaggctaaaagttaatttgtttcctccttatctatcttttctctcatttttttcttgtgaagaaaaaaatttgaatttcatagagtgcggtgcatatgtatatatctatatatgtttgaagtgtatattaaaaataaagtcattatttgaatattggtttctcggtctaagagcttatacgttttagactgatctgttgtactatccgcttcaaataaatagatcattgaaagtgacggggataacagcattttacctttaaaagacgttctcataatacattttaggattaatacatatagcttttttttttttttttattcgaaatctggggattctatacagagttgtaagttaggcaaactagaatttggtaataatattttattcttggggcgacatatggagatactttatttccttttcttaattattaacgtatacctataaattaacaaagtatctaaacaaaatacataagtgtactcaaactgagtagaatcgtcgattaaacttccttctccttttaaaaattaaaaacagcaaatagttagatgaatatattaaagactattcgtttcatttcccagagcagcatgacttcttggtttcttcagacttgttaccgcaggggcatttgtcgtcgctgttacaccccgttgggcagctacatgatttttggcattgttcattatttttgcagctaccacattggcattggcactcatgaccttcattttggaagttaattaattcgctgaacattttatgtgatgattgattgattgattgtacagtttgtttttcttaatatctatttcgatgacttctatatgatattgcactaacaagaagatattataatgcaattgatacaagacaaggagttatttgcttctcttttatatgattctgacaatccatattgcgttggtagtcttttttgctggaacggttcagcggaaaagacgcatcgctctttttgcttctagaagaaatgccagcaaaagaatctcttgacagtgactgacagcaaaaatgtctttttctaactagtaacaaggctaagatatcagcctgaaataaagggtggtgaagtaataattaaatcatccgtataaacctatacacatatatgaggaaaaataatacaaaagtgttttaaatacagatacatacatgaacatatgcacgtatagcgcccaaatgtcggtaatgggatcggcttactaattataaaatgcatcatagaaatcgttgaagtttgccgtagtaatacccagattatcagattccaaatccttgtcaataattatactcctttggacaacttctctttccattaaaaaatctgaaatctccttaaattttaaatagattctgttcagttcactaacggggaatttcaagagaacatttttgttcttcgccgactgactataatctgtaacattattgttatcagagtttctcgcaaaattttgttttttcttgctaaatctcagcatatatttaatcagattcaaaaccttgttgaaacctttaatagatttgaaacttccgttgctattcatttcatctcgtaaaaaggatacgataatttctattttttttaaaatttccaaaatcttgtcatgaatcaatagcaattgaacattaatctcctcatttgaaagatttttgtaaaattcgtcatataatattacttcacaacgttggaaaatagcaaatgtgattgctataaaattctgtaagatttcaataaaatgatttgcgaataaaaattctttaccattagaatgaaagcgattattgccgcttgaaaatgactttatcgactttatggggaagataaaattaaatgttattgagtaaaaaatgtgcatattagaaataattttcatcagatcctttgcacatctttcagagttcgaggtcttattgttgttagaagaatgttgaactgccatggacaaagaggattcgttttgaacaaaaaggaaaaaatttgtataaacaatggtattgataaaatttaaagtgtctttccattcttttctgacttcgttgtcatgaaaatataagtctactgtattactcacgcccatagtcaaggtttctaacagactttcaattttggttaaatttactggcaagtagaaaggaacaccttgcagaatatttatcaattttgcttgcgtttccagtaattttaaatcgttagcaattaaaggaatgtcgttcgtatcaatagaggcaggtatcggagataggttttcagcagcgggtaccatgaatagcttttttttttttttttattcgaaatctggggattctatacagagttgtaagttaggcaaactagaatttggtaataatattttattcttggggcgacatatggagatactttatttccttttcttaattattaacgtatacctataaattaacaaagtatctaaacaaaatacataagtgtactcaaactgagtagaatcgtcgattaaacttccttctccttttaaaaattaaaaacagcaaatagttagatgaatatattaaagactattcgtttcatttcccagagcagcatgacttcttggtttcttcagacttgttaccgcaggggcatttgtcgtcgctgttacaccccgttgggcagctacatgatttttggcattgttcattatttttgcagctaccacattggcattggcactcatgaccttcattttggaagttaattaattcgctgaacattttatgtgatgattgattgattgattgtacagtttgtttttcttaatatctatttcgatgacttctatatgatattgcactaacaagaagatattataatgcaattgatacaagacaaggagttatttgcttctcttttatatgattctgacaatccatattgcgttggtagtcttttttgctggaacggttcagcggaaaagacgcatcgctctttttgcttctagaagaaatgccagcaaaagaatctcttgacagtgactgacagcaaaaatgtctttttctaactagtaacaaggctaagatatcagcctgaaataaagggtggtgaagtaataattaaatcatccgtataaacctatacacatatatgaggaaaaataatacaaaagtgttttaaatacagatacatacatgaacatatgcacgtatagcgcccaaatgtcggtaatgggatcggcttactaattataaaatgcatcatagaaatcgttgaagtttgccgtagtaatacccagattatcagattccaaatccttgtcaataattatactcctttggacaacttctctttccattaaaaaatctgaaatctccttaaattttaaatagattctgttcagttcactaacggggaatttcaagagaacatttttgttcttcgccgactgactataatctgtaacattattgttatcagagtttctcgcaaaattttgttttttcttgctaaatctcagcatatatttaatcagattcaaaaccttgttgaaacctttaatagatttgaaacttccgttgctattcatttcatctcgtaaaaaggatacgataatttctattttttttaaaatttccaaaatcttgtcatgaatcaatagcaattgaacattaatctcctcatttgaaagatttttgtaaaattcgtcatataatattacttcacaacgttggaaaatagcaaatgtgattgctataaaattctgtaagatttcaataaaatgatttgcgaataaaaattctttaccattagaatgaaagcgattattgccgcttgaaaatgactttatcgactttatggggaagataaaattaaatgttattgagtaaaaaatgtgcatattagaaataattttcatcagatcctttgcacatctttcagagttcgaggtcttattgttgttagaagaatgttgaactgccatggacaaagaggattcgttttgaacaaaaaggaaaaaatttgtataaacaatggtattgataaaatttaaagtgtctttccattcttttctgacttcgttgtcatgaaaatataagtctactgtattactcacgcccatagtcaaggtttctaacagactttcaattttggttaaatttactggcaagtagaaaggaacaccttgcagaatatttatcaattttgcttgcgtttccagtaattttaaatcgttagcaattaaaggaatgtcgttcgtatcaatagaggcaggtatcggagataggttttcagcagcgggtaccatgaatgaagactgacctagaagcgaatgtcttgagtaatacatttttttcaaaaaatggaataacttgaaatcttttatctggaagcttaacagacagctcaaatcttcgtctaaacttgatttatgatcatcatgcatgtacagagattcataaaattttgtgatggcaataaatttgattgtctcttggtcataatattccaggtttatcaatgtgatttggcttcgaatcaacctcaaattattcattaatgccgaaacatggttattaatagcctgcttattgaatagggtcattgaatcgtttaacaacagtagaagcacagttaattcgcctagtttggtcagttgagataaaggaagatcgaccgttgagaatgaaggacaggtatcaccatttggaaaagagttatgaacaaattctagtaagagggttttgtcaaagattggcaaaaattcttcaatattcagattgttaagggattcagagtttagtgtctcaataattattgcttttggtgggaagttaactttgcaaacttccatatattgttggtgatttttattgttaggaggacttactttgaactgattaatatggcagatatcgtgcaaaatattatagaacttgaaaagataatgatctctaaaaatgatgaagtttttagtgaaaaggtagttgggggtatccttcaacggtttcacttggactaaactttgcacatctgttattgtgagcgctgtaaagtatttttgtgaggactgagaagtccttgaagtctgatgatcaaatccggctcttttaccgtcaaccttgcctttcttagaattctcacctgttttgttaattttgtttgccgtggtattgtcggcatttaaattcgatttttctttcaaacttttcagttgcaagctttgtaaatcaagcaatttgttttttaaaaagtctatctccttgattaatacttcctcttgagtaaacggagaagtcattagatcgaaaacggccgagtcttgattgataccaacattaaaagagtatgggttatctgtatagtcaaaactttgagcgttaaccagttgtaatcgtgtgttatattctctaatctgatccatggagggcacatctggactatcgcttctcacaatagtgtttccatgaacattactactaacggtactactattctgacgaggagcagtattattattggtgttattattctggtagctagcggccttggtccactgcatcgcagtatccacagaggggttgaacgagaagttgaatgcctctatcgacgtttgcataatcggatactgcgtttgaatcattacgtttttctgatttacaccgtttccctgactaaaatggttggaaccttggccattgccgtgcgtggacatcccggacgcagagggcacagcgaccatcttaccaggtccatctggataaaaacagtccggcttgttatacttgacgcaattcccacatatcggttttggccctgtcgcacccgatctttctcttcctgcattgggtgcaagcaggcggcttcctcacttttctcacttgcatgtccatcatgattaaaaacaaacggcaaagctacgcactagtcacagcagacaacgacaatgctcctctcataaattgctaagatacattaaaaacaacaactctcttcttgttcttcctctctttgcatcattcctgcaaaatatcacactacacgagctaggatgtataaccatccttagtaggacgccaaggttatattcaaaatgatatgatttccccaattaatacttgctgttgcattttgaatcggatgtaactgggactaatgctgcgctaaccagacgtacgttccggtggtcacagtgcggaactgttcccacgttctctagttaatttacctttaactatacatactgaaattgatatctatgtatatagtatgaaatattgcatatactcaagaagagagctcaggcgtccactcaccgcattttgcgatcttgaccgcctcgagaggtttgtcattcgcatctctggacacgtgctgtatgtagttcaccacatccatgccgtccacaacctgtccaaataccacatgctttccatcgagccacgacgcttcttccgtagtggtgatgaagaactgagatccattggtatctttaccacgattagccatcgatagtctgcccttgcgatcatgcttcaaagtaaagttttcgtcagggaaagtatctccatagatggatttgccaccaacgccagtgccgtctgtgaagtcccctccctgtaccatgaagttgggaatcaccctatggaaagtggacccgatgaacccctttttggaattagtggtggtgcttaacttgtagaagttcttcgccgtcttaggacatacctttccgtacaacccaataacgattctgccaactttctcttcaccatgttcaatatcgaaaaacaccttttgtgtaattacttcgtcgtcctgatcaatcaactcacccacatcagatgcaataacattaacgctaaggaataataacaaccaacaccacaagccactgaatttcattttgttttcccttcgtgtctttttcctctcatttctttccttttgggggaacttcttatgatgggtacatcgatttttgaagaaaactgaaaagttgatttcgcggggttttataatatagtacaaagatatatgcaattgccatggcagttctcatatgtagtttggggtggatcgaatgcttgtgaccattaatttgtccaacatctctgtagttatacccatgttaccgttgccagtacgaccggtaccgttgtctatagtttgtcctcctgtacccatagtgttgactgtcatgttgacatttgtggttgagggaacagtcgccatattggcaccgccggtaggtcgtacactgctcttgttactgccccctccagcgttgttcccgttggtggcagccgttgcagtcgtgctagtgtccgtaggtactttatagtgtactccttgggaaggttgaaactcaatcaagtcatacaagctctccaatgtgctatttagatggtagctcgtggacatcagcctactttgcacaattttaaaaattgttggcgattggtaaatgtttgcaccaattatgtagtagtcttgcaatggaataatctctggtcccttagcgcttcccacaccagaattgtttgttcgtctttgcttcctgataacccagaagtcaggctctcttacgctgctcaatacgtattcagtaccatctaacttcattaattcctcctccagttgcatatacataggatacttgaaaaggatttgtcttcttgccggatccacataggcaaactcctcttccaagtttccattcttcccatctggtaaggtcattatgttttgtgtcatattcacggcagcattaggatcatttaactgggaaaactgcctttgcattttaattacctgattattcgacgtcttatcgaaaaatggtgattctgcaaagtaatcaagaacattctcagttctcaaaccaaaaacttgaatccattctggagatttccattgcaattcatccaacggtgtcacgttcattttgcgaaatcctgctttgtttcactacttgcaactttatattcagaggtcttctcatcgttccacatttttccactcattatttataatacgctcattatgttaaccaaaaaaaataatgcagccaggcttgaaataattctgccatcttcaaacaagagctataaaaccaaagaaaacttgaccaaacaataacaaaccttcattcaacacacgttttactatgataccttcccggattagccacaaatttcctctattcttaaggagttcgctggccgctcctaaagctgcctatcgtttcagttcgaccatccccaaaccaagcgatcaggtacctgacgtagatgcatttctaaacaagatcggtcgaaattgcaacgaattgaaggatactttcgaaaataactggaacaaccttttccaatgggattctaagatattgaaggaaaaaggcgtgaatattcaacaaaggaaatatatactgaaacaagttcataactatcgtaacaataggccaattcatgaaattaaactgggcaagaagtcattttttggtggtgagaggaagagaaaggcatttactgctaaatggaaagctgaaaacaagcaatagacgctttcgcaagatctcaatatatacatgtatacgtatatgttcacattatactccatattcttgtaaatatataataaactcagaaattgttgtccttcattcatgttgatatttatatgaaacgctgactgggcctttcaaatcttcatcggtttgaaatttgaattgtaaatatgttttgaagatacgatgaaatgaaaaattgacggcttaacgagaagatgagtgaaacaaggatggcacagaacatggatactacagatgaacagtacctgagacttattgagctactctcaaactatgattccaccttagagcagttgcagaaggggttccaggatggctacatccaattgagcagatcgaactactataataaagactcattacgaggaaactatggtgaagattactgggatgaaacgtatataggtcaactaatggcaacagtggaagaaaaaaactccaaggtagttgtcgaaatcgtcaaaagaaaagctcaagataagcaagaaaagaaagaggaagaagataataaattgactcagagaaaaaaaggaacgaagccagaaaagcaaaaaactcagagtcacaaacttaaacaagactacgacccaattttgatgtttggtggagtactgtccgttccttcttcattgagacaatcgcagacaagtttcaaaggttgtattcccttaatagcccaattgattaattacaagaacgaaatattaacgttggttgaaacgttgtctgagcaggaataaagagttaagaatatagtaaaaagaaataatacatacgtgtatatttgaagaaagaaataatcattaaaagttgtcgtagattaattataataaagtccatggtttgaaaaagaaaaaaaaaaattaagaccaaaataaaagctcaatacccaaaagaaaaccgaacaccgtaataatacaaaatcccataaaacaccatgtgatggacttaaagacagaatttggaagcagttcaaagaagaggaggaaagaagaaaactagttcaggtatttcgaggagtactagtttcactacattgatagtagaattttagcacgtcatccacagatattctgttaccaggggaatttagcgactgatctacattgaaacaatttcctaattcgggcgtatgtagcgcactcaactctcttggcttgaatttgccagaaaatgatgaaacagagggagaggaaggattggtcttttcgctgacgctatctccaagaacagaaggaaatgtataatttctcaagtcttccaaggtcatttccaaatctgtaggcgagtctaattgcttattgccatttggggtattgttggtttcgttaccatcgtggtgagaatccatcgttgtagctattgtggaggaagacactattctgctcgaatcgttcatcacaacattggaatatttagaagagacgtttgaatctggtcggggttgcggtgccaaagacgtgaatttgactaatgattctacatcatgtttttcttcgtgcgactcaagagggttgtcttcccttttaccattagcatgcgaaatatggtgaaaatcaaatggtgtagatatacttgactgttttgcggttttggcagacccatgtctcctcgacaacaggtccttttttttgaacatgcccaggaaattcttctttttattagttaatgacttgtgattggaatttatgttagggttgatcgtcatgtaattgggcaaagggggcaatttgatgttgttcttgttcggcaaagccagctttttactgtcaacgagaacaattcctaaatcttcgtcggcgtcttcatcggaatccgtactaggtccattcatgaatcgttgccttacttggaatccatacaatttttccatttcctgatcctcgtcaatccaaatggatttcatttgaggaagctccatctgttgcagcctctttccttcagtcatcctttagaatttatcacacaattaataagcgagtattcagagtgaattataaacaataaacaatagaaataagtctttcttaaaaaaaagtagtgatagtccgtacgaagataattaattgcagaatagttttcaatggtttcagctctcagtaaatcctacaggtacaatgtaacagaatatgccttggatccccaaatttttttgtctattcgttgttttccttctctatggaaatcgtcgaaaaatttctttgttttttttttcctttattgttgttgtcttttcgcgaattcgcgtcgcgattcgtggattgtgatgataatagcgatgtctactacccgggtacgtatttaattatcatttatacattatatgttataggttagcgtatcgttttaaggcttgtgtcttttggaagcatggcctaattgttcagcatccatactccttttcactaccttgatggtctggacgtcgtcgatgccttgaacatcgttgaccacgtcatcgccgtttccgctaccaccaccggtaacaatggtctgtttgtggctcttattccttaagcggccatttaggaggacgagtgaagctaggtctcccatggccttcgaacacctatcgctcggaagacctaaattcttgattagacttgttactcctaatatgttgcggcactcaagtggtgacatggcaccactgccgataacaatgcctctggacctcgaactcctgatgacgcttcttacattggatacgaactgcctccgagcttgtacgtcacgcaaagcatagccataaacaatttcaagttttactcctctgttcacacagctgcatatgcttttatgcttaaggaaagtaggcaggcgcgacccgtactgaaaggtcaacaagtcaatatccagattggtagttgataaagtaaggcccttttcactgattggcaatgctgctacaatatcaaaggcctggcttatcttggaaagagactgtcccttcgatggatcgtcgataattagcgtgatcctgctgtataattttagccctgttcgatccatcaattctccaaaccttctcttgatatcgataggatttaacagcttaacatcgttggggaatttctcgctgtggtttactgtaaaatttatggcgatgtgtgtatatcccaacatatgcaatgtggataacgtttttattaaattgttgaccgcctgagaagtaactttgtctgcatagctgttctgtggccacggtacattcaaatctaccagcattctcggttctataatgctttcacttttgttttttgtgtctgtttaggttaagtattttctactggtaaaatgaaattttttcatttatgcgaggtaaaattctgggcatcgcacatacatttttcatgttttctggtagtagtaacaaaagagaggcacttgacaaattaatctgccttcagactgttaaggttcgctcgaataaagcattaagagtgtatatatatcagtatttataaatgtatatgttctggctgatatccgcgcattttcagtcctttctccagtcaccattgatacttctcgacctgttcaatgctaatctcatagtggccaattctccgatagttttattaaccttgcagcagtttgggtctagatttaagttatcagccaatttgacgacatagccattgatatactcaatttcaatgtctcttaagaacaaagtgtcttgtctcattgaactactgttcctagaattgatgtcacagccaattctagtgacttcggagaccatgttatcggttgtcagtactgcattgacatccatttctgggtattcttcattaccgctgtatttttcgtggtattgaaacaatggcctataagcaactctcaatatttgtaaacactcgtcaataatagatgtgaaaactggaccgcaactggccttcatctcaccattgacacaatctagaatagccgtaactggattcatgcatgcattaaccaaaaatttaaataattgaccaaagagcatttcttgataagtggaatgttctattccaaattccttggcaaattttggttctgttaataattttactaatgagttattggctgcatcgtcctcgactacggattttttttgaatcatttcttcctcagtccaaggcaatttggcaattttcataccagcccacccagcatgattgaaaactcctgctttatcctgataaacgccatgagaaatgacaccctgaaataaatgtggtctgttttttgaatctgtaaagatttcttctctcaatagttctaaaacgcccagtccattctgaatcaaaattaagtttgtatttttattaatataaggcaaataaggagctagtgcttctttggtttggtaagtctttgtagtgacgactaagttgtcaataggttttttagagaaagtttcagggcattcgcatttctccactggataagaaaatattggcgagccttccaaataaagtttgcgaatcgaaatgttgttcccatttgtcttctgaaattgtgcaagtctttcttgtgatctaaataagggcacaactagggcattggtaaatcttaaaaggtcaactgccaaaacggtacccatggcacccaacccaagaatatgaatagtacttctgtgtggtgcagtcatattgtacagactttatcgtatacgtatattatcgatttctcctatcgatcgtaacatacaaaggtgagtataaagtatcttgtttttttaatatatttgtattaagctgaatggcacgataagcctttctcgagaaaccgttagcggccgccaatctataaaaaaaagaaatcggaaacatgaaatatgaatttgaatagaacgtgactcaacagaaagtcacaaacctaaccataataaccttgctatagcattttttgacttaattttatatgttcttttttcaagggctgtatagttccatcatgtatgtatttttctatatacgtatacataccgtttttcttagagcgctctataattcaccctttacagcattaccagttttcaaatctctagcggtgactcttaaagcaccgtctttgttaatgttaaagataatttcaacaccgttagcgtttttaattcccaattccatcaacttggtacccaaagtgtatagtttttctctgacgacttcaggttcatcgtcggaccattcactttcatcgtcctcttcagcattttcttcttttggaattggctccaaagtcttttcctcgatgtgatggtcaccttcgtaaacaccaatcaagaaatcacccttggcttgtttcaaagtcaatttcttttgtacagggaacgaagtttcagccaacaatactgggtggaattcgcccttagcaccaatcaaaccaataggcttctttaaatgtggagtattgacgataactggttgtaaagcttcagccaattcgtcagcatcgtaatcgctaatcaatcttgcttgtaatgcggcaccggatgcagctaattcgtttggattgttagaagcgttcttgttctgtggaccaagaatttcgactgattctggtaaagtgtattccaagttagtggttaattttggagtaaatgatacaccaccagtcaaaagaacagcatcgatgtccaatgggtctaattcagccttggcaatgacagaatcaacgaaagaggaaaattgggcgaagaccttgttagctaccaattcgtacctcattctgttgatagaagcgtgatagtcgaaaccatcagctaaggaatcgatggaaatagtggcagaagttgcgttggacaaagtcttcttggtaattgaagagttagcctttaacttggccaaggatctagcgttctttcttggattggcttgatacttcttttggaactcactagcaaaatattcgactaattcagtatccaaattgtcaccacctaagctgaggtcatgagcagtggccaaaatagtgaaaataccgttacgaacggcaatgacagcagcgtcagatctaataccaccgaagtcagcaacaacaacgttaacatctttttcaaatgggaattgttcagcgtgggctaataaagcagcagaaggttcattgatgaattgaacaatttgcagaccaattttggcggcagaagcctttagtgcagtcttttgttcttcactgaagtttgttggaactgtcaatacagcttcctttacggcagaaccgatgtaatcttccgcggctaactttaatctgtttaaatgtctggagaccacttcatctacagtaagtttttcttccttaccttcgcctcttgaaataacaaatccaactttgccatcaacttcgacagctggggcaccgttagcgcacttgctgacatcacacttgtcaaatggcaaaccaatgaagtcacggaagttaatgatagtattcttaggatttctgattaattgttgcaaagcttgaccaccgtggtattcatcttcaccgacataggataaagcggatggaatggcacgctcaccatctgggttggcaatgacatcaacatcgttctttgggttgatgtaggcaatagaagaagaggtgttaccaaaggtgataccaatcactggagaggacatcttatttgtaattttaactgtgattgtggtagtagagatctcaatatatttatgtaatcttaaaacctcttgtataggcgagctgactaccatgtacttcatatattatccgacctcatcatctcttggaaaaaatttcaccatcacattcgacgaagaaaaagagctaaaatatgaatacttcgtaaatagttacttattttgcacatcttttaccgctcccattacgcggaatgagttatgaatggctcgagaaacaaataggaaacgaataagaaatgataggcaattttatgtgatattgatagatgtatatatgaacatatagataaatatttctaagttaaattgaacttttgggcgttaaaaggtaaaccatgcttacaaagcctacctttctcccatgtccatattctctcttgtcatcattcttcctcttcttcccttacctctggcaatcttctccttgtttcttctgttcatttccattacaacttccccattagccttatcgacggaatctcttagggtcaatataatgttcttgtccacactttccttcggtagttttttacctaaaacttcttcaattcttaagatcaattccagatcgtattgtgatactagtgagatagattttcctgatctaccagctcttgcggttcttcccacacgatgaatgtaggacttggaatccacaggaatatcgtagtttacaactatgtccactgatggaatatccaaccctctcgcagcgacatctgtagccacgagaatagacctcttacctgccttgaaaagatccaaagatcccattctctggttttgattcaaatcaccatgtagcgcagtggcactaaactcgagcaaattacataatcctgacaacctttccgcgttggccttggttcttgtaaaaatgatcatcgtctttccaataaattcatttaataaataaattaggtatgtgttcttaagaccacctggaacgaccatcagtgtttgcactaatgtatctacggtttggtatttgtttgacacggcacatttcacaggatttgtcaaacttgctctttgtaatttatcaattttggaagtcatagtagcggaaaaaagataagtggttctttcttgggttgggatgatctttaaaattctatcaagaacaggtccaaattccatgtctaataatctatcagcttcatccataaccaagaatttcagtttcctcagtgaaaaccctttggtattctctaaatggtccattaatctaccaggtgtagcaatgataatatgtggctttctcatcaggtctctggcctggtccatcatattcataccacccacaatacatgtcgatctcacgcccattaaggatcctaatgagtcaaatgtttctttgatctgttgtgctaattctcttgttggagctagaatgcacgcatagtatggttcctgatcatgccataaccgattcaaaatgggaatagcaaatgcagcagttttaccagaacctgtttgcgcaagtccaattatatcgtgaccttctaacgcgggaggaattgccttagattgaatgggagtgggtttggaataatttaagttcttacaagcttgaattaattcggggaccagattcagttcgctaaaggattcaaaagattcatcttcattagtattttcattttgggttgatactgtggatttgctttttgatttcaaaacctttttcttttcagcagtagcatcttcttcagaatcggactctgaaccaccttccttttctgcttctataagcttcttttgattttccaaagcttttgctctaatcttttctgctaaagaagttaattcatcgttagccttcttttcctttctcttaacaattttggacatttttatagctgattcagtgaagtacttaacagaatcttggtatatattgcttctaagatatgtcacaattctgtgtataccatgtacaattgctaaatgctcattgattaattttaaatttttcatttttatcgccttagacgaaattgaaatttttcactgaaaaaaaaaaaaaaaaaaaagtagacgaagaagctcatctcatcgcgatattagttcgatatctgggtttgagtgagtagtatgtttaataataaaagagtataatccagatatagcagacaataaaatttcaagatggccaagagaagacaaaagaaaagaacacatgcacagcttacacctgagcaggaacaaggtatacctaagtcaatggtaatcagagtgggtcaaacttctttggccaaccattctctgaaccaattagtaaaggacttccgccaaatcatgcaaccacatacggctataaaattgaaagagcgcaagtccaataaactgaaggatttcgttgttatgtgtggcccattaggtgttacgcatctttttatgttcactcaatctgaaaaaacaggaaatgtctccctaaagatagctagaactccgcaaggtcctactgttacttttcaagtattggactattctctgggtagagatatcaaaaaatttttgaagagacctaaatcgttgaataatgatgatgtattaaatcctccattgctagtgctaaacgggttttccacatccaaaagatctggtgaagacgaccaggatgtaaacgtggagaaggtcattgtttctatgtttcagaatattttcccacctctgaatcctgcgagaacttctttgaattctatcaaacgtgtatttatgatcaataaagacagggaaacaggggaaatttctatgcgccactattttattgacattcgagaagtagagatctctagaaacctaaaaaggctttataaagccaaaaataatctaagtaaaacagtgccgaatttgcatcgaaaagaagatatttcttctttgatattagatcacgacttaggcgcctatacatcagaatctgaaattgaagatgacgctatcgtgagagtagttgataatcaggacgtgaaggcaaagcattctcaaagtttgaagtcccaaagaacaccggtcgaaaagaaggataataaagagcgtgaaaaagaaacagaagaagaagatgtggaaatggaggaacctaagccttcagaaaacttgcaaccaaccccacgtaagaaagctatcaaactaactgaattaggaccaagattaactttaaaactggtcaagatagaagaaggtatttgttcaggtaaagtgttacatcatgaatttgttcaaaaatcaagcgaagaaatcaaagctttagaaaagagacacgctgcaaaaatgaggctgaaggaacaaagaaagaaggaacaagaagaaaacattgctaaaaagaaggctgttaaagacgctaaaaagcaacgtaaattggaaagaagaaaagctagagcagcagaaggaggtgaaggtcaaggaaaagatgatgcgatgagcgatgatgagtcttcatcaagtgacagcgaacattatggtagcgtaccagaggatctagatagtgacttatttagtgaggtcgaataaattgttctccggtaccaagaaaattttagttaagcctggctatccaccaacgcacgtatacttcttcactttagataaattgcatacttgatacatataaactctttgtcttttaaatcatagcccaaaggaaacgtagatctcagaaggcatgtgaaaaaaaattcgatcttaccttttttacgccattttaagctactgtttcgatacatgagcgtggctggtacattgaaggtgggcaatcgtccacttatctaaagacagcttatcagcatgaaatccaaaacgtggattttcagggatgtcttatctagtcaccgaaccaaagcgtttgatagtttactttgtaggagactccctgtatcaaaggcaacgaagcatcttcaactgggagaacatttcctgttcttcccaccatcattcgaaaaattggatagagatggttattttaactatcaaaatcctgcaagtttgctaggaaaccctgatttacgctaccgtagaaggatttggggacaaggagagcttgttcagtatttaccagtcaccttagaccaggagtatacatgccacgaatcaatcaaatacgtaaaaaaaatacgagatgaacatgttgtctgtattgaaagaacccttttacaagaaaggcccgaaaatgtgtcgagtccaatggacatttgcttattcgagagaagggtattaatgtacaccaattcacccgcaaacaagactgcagtcaagatgcccgtaggagaggagaactataagatcttaaaaaattttactgttactgatatggatattgtagcttatggtcagatgtctttgaatccgcaccgaattcattgggacaaagagtacagtcgctatgttgaaggctacgacgatattatcatgcaaggacccttctcggtccaattactacagaaatgcatccaaccttttctcgaacaaccaatcagacagttgcgataccgcaatttgaattatatatatccaaacactactttgagcatatgtcagtctttaagctcttcgagcggaatgtacacatttcaaattagggacctccagaaagccaacttagtctacatgaaagctgatgttttctgttgactaccagtaattgtctctctgcagataatcactacctgtgtgtttcttgtctcttgaaataatactagtagctgctgaacagtggaaggtcacgaacgagattaccataatatctcgccatcaccaggttgacggtaaacgcattacgggaagaactgaaaaaaaggtgggaaaaaaaaataaaaagtaaagtgaaaaattaaatgtaatgtatatttccattttgacgcaaagtacttccctctatcagttttgtatctaactgcagagtaaagtcgtgttttgcttagttaacttatatacaagtcaaagcaaaaaagatgtccgatatcaacgaaaaactcccagagttactacaagacgctgtcttgaaagcatctgttcctattccagatgacttcgttaaggttcaaggtattgattactcaaagcctgaagccactaatatgagagcaactgatttaattgaagctatgaagaccatgggtttccaagctagttctgttggtactgcctgtgagattattgatagtatgagatcatggagaggtaagcatattgacgaattggatgaccatgaaaagaaaggttgcttcgatgaggaagggtaccaaaagactactatcttcatgggttatacttctaacttgatcagttccggtgtacgtgaaactttacgttatttggtgcaacacaaaatggttgatgctgtcgttacttctgctggtggtgtggaagaagatttgatcaaatgtcttgctccaacttacttgggtgaatttgctttgaaaggtaaatctttgcgtgaccaaggtatgaatcgtattggtaacttgcttgttccaaatgataactactgtaagtttgaagaatggattgtcccaattttggataagatgttggaagaacaagatgaatacgtaaagaaacatggcgctgactgtttagaggctaaccaagacgtggattcaccaatctggaccccatctaagatgatagatcgttttggtaaggaaatcaacgacgaatcctccgtattgtactgggcccacaagaataaaattccaatcttttgtccatctttgactgatggttcaatcggtgacatgttgtttttccatacttttaaagcatctccaaaacaactaagagttgacattgtaggagatatccgcaaaatcaattcaatgtccatggccgcttacagagccggtatgatcatcttgggtggtggtttgatcaagcaccacattgccaatgcttgtttgatgagaaatggtgctgattatgccgtttacattaacactggtcaagaatacgatggttctgatgcaggtgcaagacctgacgaagctgtgtcttggggtaagatcaaggctgaagccaaatccgtcaaactttttgctgatgtcaccactgttcttccattgattgttgctgctacctttgccagtggtaaaccaatcaaaaaagttaagaattgatgagagaattttgagatgaaaaaaaaaaaaatgaatctgtactatttctttttttagtgcaaaagttttgttttaatatagagataaataaaaaaatgaacatattactataatatcaacaaaatatgatgtaatgtctgcaataaagatgagtcaattgcatttctatacgtactaatcgtgtgtacatagccatgacattatgtaagtttatacacataaattgcgttggagtctgctgtgtagtttataaatgtgtaaacagcggcttttgtattcctattagttgccgttacctctcattttttcggcggtaagaatgtcactgcctatggattccattacatttttctcaatcagttcacctacgtttgaataaaccatactagcttcgtaagcacttactatacgttgttgagtaatgcctatttcacagaacgctaacgctttgatcacgttcgcataccggcaaattgcttgtcgtatgttgttcgatatggaaggatcgttttcatccgaatatatttgccatgaagactcttcttccagtcttgttatggagggatttaatgataccgcaccagtgggtccagttgatttaattgaggaactgttatttgcagacggcgtatccctcgctaagtccatctgagatgttttccttaaccatatgtaaccattgactccgagaactacggttatgttgccgggcaaattatgagtatggttcttggctctcactattaatgaactcgggacttggcaaaacatcccgtttcttaacttcccgtactttagagaccttgtatgtaaagaggcactaccatcttgaaataatgattgaacttctgcattcaggaggtcaccttccttaaggaagcttctcatttgtagttcatcactttcagattttcttcttagaataccacccggtaaattcacagagcccaacataagtactgcatgttgcttaccgccaatgtctactttccatctcttgttacccacttcagcaattctccctacgacgtgatcaccagtttctggggcataacgacctttcaatggaattaccgatagcagcctattgacacgggatacagtaccagcaacagaggaatacgtcatattatcaagaaaatacgtaccgtgacctctcatccagatagggtcatcagtgaccagctcacctggcgtcacaatttgagaatcagactcacttttagaagctgagttaacatcgtgcatgtagatatcttcttcatcattttcatcatctgatatccctgtgttgttataggacaggttagatgaattttggaaggcaccgttccgcttggtaattgtgataacttcggacatatctgtttacgcttgtgtgactacgcaaagatttagaatgcaagcagtacttaaggaaggatatttttcttctacttttgttttagttttcttaatttttttttttttttcacctcatcgctcaatccatactgaggaagaaaaagaaaaaaaaagattcactgaggatatttgaacaaaccagtttaaaccataagtaaaggtaaggatatttttcattgcatgaaaatcgcactgccagtattccaaaaatttaatagattgatcagttcgtgcaagatgtcaggagtgttcccatacaacccacccgtgaatcgccaaatgcgagaattggataggtcatttttcatcaccaagataccaatgtgtgcagtcaagttccccgaacccaaaaatatcagtgtgttttctaaaaacttcaaaaattgcatcttgagggtgccccgtatcccgcacgttgttaagttaaactcatccaagccaaaggacgaactgacaagtgtacagaacaagaaactaaagactgcagatggcaataataccccagtcacgaaaggtgtgctgctacacgaatccatccacagcgtggaggatgcgtatggaaaattgcctgaggacgccttggcgtttcttaaggaaaacagtgcggaaattgtaccacacgaatacgtgctcgattatgatttctggaaagctgaggagattcttcgagccgtgctgcccgagcaattcctggaagaggttccaacgggttttacaatcacaggccacattgcccacttgaacttgcgcaccgagttcaaaccattcgactcgctcatcggacaagtcatccttgacaagaacaacaaaatcgaatgtgtcgtggacaaagtcagctccattgccacacagttcaggacttttcctatgaaagtcattgctgggaaaagcgatagtctagtggtagagcagaaggaatccaactgcactttcaaattcgactttagcaaggtgtactggaactcccgattgcacacagagcatgaaagactcgtcaaacagtacttccagcctggccaagtagtctgtgatgttttcgccggcgtggggccctttgctgtacctgcgggcaagaaggatgtcatcgttttggctaacgacttgaatcctgagagttacaaatacttgaaggagaacatcgcattgaacaaagtggccaagaccgtcaaatccttcaacatggatggcgctgacttcatccgccagtcgccacagttattacaacagtggattcaagatgaagagggcggcaagatcacgatccctctgcctttgaagaaacgacacagatcccagcaacacaatgaccaacaaccgccacaaccacgcaccaaagagctgatcattccgtcacatattagccactatgtcatgaatctaccagacagcgccatttctttcttaggaaacttccgtggcatctttgcagcacacactaaaggcgccactgataccatccaaatgccatgggtgcacgtgcactgttttgagaagtacccgcctggcgaccaagtcactgaggacgagttgcatgcacgcgttcatgcccgtattattgccgcgctcaaggtcactgcagacgatcttccgttgaatgccgtttcgttgcatttggtgcgcaaagttgcacccaccaaaccgatgtattgcgcgagtttccaacttccagctaacgtatgaagcgatctgctcttgcagtttgccgtgggaggaaaaaggcaaaaaggcgaccattagaaaaagaaacgagatgactaacacctttatcttcgagaaggcgcggggctgacagggcactgcgcgatgcgtcatactacttgaatacaacacaacccgtcttctgttatataaagaagaagaataaattaggaagtagggggaaaaggcttatagtgtaaaagtattttagtttgttgttgtaatttcgtcttttctctcactaccgtaacaacgtggtagttggcagaatatatatattcttggcaacctagttgttactcaaatagaagaaaaagcaagtttctccctatttatttggttctccctattcactcgcatttagcattggcatacttttttatatttttttcgttttgtttttggttttcctaggttcgatatagttataacaatgcactcttccgtcttctaagttttccttttattaaggatgcgcgcaatagaagacacaggcaataatagaatttattagggtattattgtaaggataggcattacaaagataaaataagtttttaaaaaaaaaaaaaaaaaaaaaaaaaaaaagaaaaataaaaataaatatggatggaaatcataggtttactccagattccaaagaatttaatactgttgtaaaaagtaaagagtcttccactggcagaaatccgtatcagactccgcccttagagcacaacggtactcatcatcagacaaattacagcagaaagaaaacaaatctagcaattatcatatcgaatttcttgtccgagatcagtcggcctctttcaaatggcaaaatcaataattctacccacaacattttaaaatttctaaatgaagtgcttaagagatcgaagtgcagtaaagaaaacgctgtgttagccactttctactttcaaaagattcaccaatccagaggtgtccgggatgagtcctcattgcctgaattctcgcactgttcccgcagaatttttctctgctgtcttattctatcgcacaaatttttgaacgacaacacttactcgatgaaaaattggcaaattataagtgggctccatgcaaaggatctatctctaatggaaagatggtgtctgggtaagctgaattatgagctggccattccatatgacgagtttttgctatgggaaacgaacactttaatgaaagcgaaattgcgcgtcggaactcccgccaacgctccggtgaagagacccagagaatcagacaatgattatgatgcaaattcttggaaacagattaaatcttgttaatttcgaaaatgttatatatctttcattcatcaataaattaacttttttttttttttttccttgctgagcttttgatctattcagctatgtgccctgtcatgttaggaaatacaaatattttttaaaaaaaaaaaatagtgtgtgtttacaaaaatgcgaattctgtggatcgaacacaggacctccagataacttgaccgaagttttttcttcagtctggcgctctcccaactgagctaaatccgcttactatttgttgaaattctgatgttaaaaagataactcatttgagtgtttattggcgtcaagattgagataagtcaccaaacccaatgaaagctgaaatgcaaggtttgataatataataggataatgaacgacagtatgtaaagataaaagggagataataccccttgaggagaatgtcttctatattatatacacctaaaatattatagcttttattatgacagaattttaagaattatctaaatacccattcatctttcattagatgtcactgtacctgctatcgaatgaaaaaaaatacagtagagcgggtataacagtaatgcaaggaaaggtgaaagaatcacatatataacggcaaattactgggattgctgttgtatggtgcacagttggtttgttttaacggtatgcgttttgtatacctctattatgtagtgcaagaaaatctgctgctattcgtgattactgttacaacctaacggtttaaatgaaacctggttctgaagggtcattttataacttcaagttcccttagcctttcgattcattttgattatgccatttctagaccgtgttataggcgctggcgtttaatttggtgtagcttggtttagtcaagagttgtattagtgttcctcgataaagtcgatgtttccggatattgtgttaaaatttcaagtatgctactaatggggtaaagttgcatgattagcagagacatatggcttgttatggttcggcttcctcatttttcatgcttagtttttgtccatctcattgtacatttctgaatcctaatgcatgactccctaacattactattaaattctcaatagtgaagaataagcaaaatgggaaccatgataatttctagctttctctccacccctattttaatttgcaatcatatatagtactttcaatagcatcttttctagatttgatatctgcggaaacttttcgtttataatcgtttaggtgaaaagtttttatatcggttatttacagatatacattttctcaaaaaaaaaaaaatataatacatgccctcagcttttaataaagccattgagcacaagcctctccagtaatgtactgctgtgcccaataaccttaccaataatcgtcgcccacaaagaaagtacaaaacagatgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtgacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaagttttatttataagtgttgttagaggctgcaacaattagaaactagtgcaaaactagtatatttatttgtatatgtagtagtaaaataataggtgaaaaattaacatgtgtttgaaattccagctaactattggttatggtgattacacgctaagtgtagagttctttcaaatataccatttatcctttagcacggcttcactatttttttcgtcttttttcaactaagcggaaggagaaaaaaatttcaagttatgctcatcactcttttattacattatggtagctataaagtggcttatgttagtgagttgacggaaaagagaaatactttcaatagaccaatacataacaaatccttttgaacaagatgcatttgatgtacactttgggcccagacggcaagagaatctatacattgaaaaaggtcaccgaaagtggtgaaatcacgaagtctgctcacccagctagattttctccagacgacaaatattcaagacaaagagtaactttgaagaagagatttggtttggtaccaggccaatagatttgggtagtttaagggaatattgtatagtacgtgattctggctagtatgaaaatgcagtgaattttcttgtttcattttcaattttctagacctacataaatttgataagtttttaggtgataaatactaattataattgatcgattatatgttttaatctcgaaggagcagtggccgttttcttatccagaaccagttcttttaagactcgccagtttctttttagctgtaataaggaaaaatagattgatattagttacagttgtgcttcacgttgttaaaacgtacaagaaaagtctttaactgtagcaaccaaaaaaggtacttgatgtcgatattaagccgcatctctagatctaaaggctccactctactgctccactttactgctccaaagagtcggcttacagataggctaccgctacattaataactgtgctggaaaaccttgtttccgggagcacaaaattgtaatgacatatttattttggttgtatcaagcgtttccaactgttgattcaaccaaaaagcctcatagcttttaatacggatattgcttagggtagggcgaaaaaaataaccaaatctttggaaaaagcagtttgacaccatacaaccagcaacgacatggttttttagtgaacctgttggggggagagtataactcgtgaaagtttcgacgtcctatttgctggagagtagtaaaacgagcttgaatagcagcctgcgaatcgaattatggaaacaattgatatacaaaatcgatcatttgttgttcgttgggtaaaatgtggccgtggcgatgtaatcaattatcagatcaagccattgaagaaatctattgaagtcggcatatacaaaaagttgaaatccagtgtagatgaccatgcttccgcagttcacattgcacctgacactaaaacattgctagactatactacgaaatctctattacataagggaagttcgagtaatattgaggagcatcacaggcgttcctcacagcactctcatagttcgagcaatggatcggataataagaggaaagagagatcatattcttcactgtccattagcggcatacagcagcaatcccaggaaatacccctacgtgaaaaactctctgcgtcaggattcactttggtcaagagggtcggcaacgtttccggtaacactatggtccaaggtgatcttgaagtgaaagatacagactactattatgcatttatactggacaactcgtcttccaagaatgcaaaaaagaaaattctttttaacgcaagtgtgataaacggcgataatcaatcgatgataagcacaagatccacccctcccgcaaggcctacagctttaagcagaacatctactcaacaggatatgttatttagagtaggacaaggtcgttacttgcaaggctacctgctgaaaaaaaggagaaagagactacaaggttttaagaaaaggtttttcaccttggactttcgatatggaaccctatcgtactatttaaacgaccataatcaaacttgtaggggtgaaattgtcataagcttgtcatctgttagtgccaataagaaggacaaaataatcataattgattctggtatggaagtttgggtcttgaaggctacaactaaggaaaattggcagtcgtgggtcgatgcgttacaaacttgttttgacgatcagttcgaagataaggacacgtccactttggaagaaaatcccgacattcttgacgatgacaaggaagtaattaataaaagctcacctcaagaccacgaccacctcacgcccacggctacgaccaaaagtgcactatcacatagacagcatactcagaaagacatggatgacatatatgtcccattgcccagcgaatcttacgctactttctccatgaatctacgtttgattcaacaacgactggagcagtgtaaaaaagactcgttatcttataaaccaactactttacatcaaagatcggaggggctaaatggaacacattcgtcatcttccgtctttaccaataatagagtgtcttcattcaatcattcttcttctggtatgacgtcatctgattctttagcctctgaagaggttccttccaacaaaacatatattgagcatgctttatataaccaattggcagatcttgaagtatttgttagccggttcgttacacagggagaggttttattcaaggaccaccagatcctgtgcaagaaagcaaaagacacgagagtttctttaacttcatatcttagcgagaatgatgaattttttgatgcagaagaggaaatcagtcggggagtcattatattacctgacacagaagatgatattaataatatagtcgaggaaactccccttcttggtaaaagtgaccaaaatgagttcacaaaagaggtccaattgtcgggatccgaacagatagcttcatcaagtgtggagagctatacaactaacgatgaaaatcatagccgtaaacacctcaaaaatcgtcacaaaaatcgtcgccgtggccaccctcatcatcaaaaaaccaaaagcgcccaatcctcaacagaaacatttacaagtaaggatttgtttgctctttcctatccaaagagtgttacacgccgtaatgacatacctgaagctgcagcttctccgccaagcctattatcttttttgagaaagaatgtaggcaaagatctgagctctattgccatgccagtaacctcaaatgagcctatttctattttgcagttgatatcagaaacatttgagtatgctccacttttaacgaaggctacccaacgtcctgatcctataacctttgtttctgcatttgctatttcctttctttccatatatagggataaaacaagaacgctaagaaagccttttaatcctttactggctgaaacatttgaacttatacgagaagatatggggtttaggcttatatcggaaaaggtctcacatcgtcctccagtatttgccttctttgcagagcatctcgactgggagtgtagttacactgtaacgccatcgcaaaagttttggggtaagtctattgaattgaataacgaaggtatactgagattgaagtttaagacaactggagaactatttgaatggacgcaaccaacaactattttaaaaaatttgatagcgggtgagagatatatggagcctgtcaacgaattcgaagtacattcttcgaagggagacaaatcacacatcctgttcgataaggcaggtatgtttagtggaagatctgaaggatttaaggtttcgataatcccaccaccttcgagcaatcgcaagaaggaaactctagctggtaaatggacacagagtttagctaatgaaactacacatgaaactatatgggaagtaggtgatttagttagcaatccgaagaagaaatatggctttactaaattcaccgcaaatttgaatgagataactgaaattgaaaagggcaatttaccacctacggactcaagattaagaccagatattagagcttacgaggagggaaatgttgataaggcggaagagtggaagctgaaattggaacaacttcaacgtgaaagacgtaataaagggcaagatgtggagcctaaatatttcgaaaaagtatctaagaatgaatggaaatacataactggaccgaagagttattgggaaagaagaaagaagcatgattggtctgatatttctcaactctggtgaatgccttgatgacatcaagtgaacttttttcccccctttgtactctatttattttccatctttaatgatcatccacacaaattacttgtatatgcgttcatgtatagtatactatatacaacatgaaggactttataaattcttgatcaatctttcacactaattttatattaacagttctacactatttttgtttgcttgactgtaaaaacattctattttatgattagttgcaaaacttgaaaaaaacaatagaatttcatcacataattgaaagataatgaactctttcagtcagttagatccatgttttttgaagaaaagtttacgaacacaggatcttacaaaaggtgcctaaatttggaattgaaagtctattgctatcaaaacttgtcaaagataacatagcttggaacatcttatcctttatatgtcctgctaagtcatatcaagaggccccaatagtttcgtcgaaaaagataaagaggaatatggaagggaaatataagattatcaactggttacctcaaaatagactatatgctcacatcatcaattgatattgcttgtaaaaatacccccaaataccctggcattctttttttgactccctgccagtaatgtcacatcttatcactttagctacatgcaacttgaatcaatgggccctagattttgaaggtaatagagaccgtatcctacagtccattaagattgccaaagagaggggtgccaggttacgtgtcggcccagaactggaaataactggctacggatgtttagatcattttttagaaaatgacgtttgccttcattcatgggaaatgtatgctcaaatcattaagaataaagaaacccatggattaatacttgacattggtatgcccgttctacacaagaatgttcgttataattgtcgtttgttatccttggatggtgagatattgttcataagacctaagatttggttagctaatgatggtaactatagggaaatgagatttttcacaccttggatgaaacctggcgtggtggaggactttatccttccacctgagattcagaaagttaccggccagagacttgtgccatttggggacgctgtgataaattcattggatacatgcattggtacagaaacttgtgaagaattgtttacacctcaatccccccacatcgccatgtctttagatggtgtggaaatcatgacaaactcatctggttctcatcatgaactgcgtaagttaaataaaaggttagacctaattttaaatgccactaaacgttgtggtggtgtttacttgtatgcaaatcaaagaggttgtgatggtgacagattatattatgatggctgtgcactaattgccatcaatggtacaattgtagcccaaggttcacaattttcgctagatgatgtggaagtagttactgctactgtggacctagaagaggtgaggagttatcgtgcagctgtcatgtctcgtggcctacaagcctccttggcagaaataaagttcaagcgtattgatattcctgtagaattggctttaatgacctccagatttgatcctacagtgtgtccaacaaaagtccgcgagcctttctatcactctcctgaggaagaaattgcactgggacctgcttgctggatgtgggattatttaagacgttgtaacggaacagggtttttccttcccttatctgggggcattgactcttgtgcaactgcaatgattgtccactctatgtgccgtttagtgaccgacgctgctcaaaatggaaatgagcaagttatcaaagacgttcgtaagataacacgtagcggcgatgattggattccagacagtccacaggatctagcctcaaaaatatttcactcctgtttcatgggtacggaaaattcatccaaggagacaagaaacagagcaaaggacctttccaatgcaattggatcttaccacgtggatttaaagatggactcattggtatccagtgtggtgtccttattcgaagtagccactggcaaaaaaccaatatacaaaatatttgggggatctcaaatcgagaacttggctttacaaaacatccaggcgcgtctaagaatggttctttcttatctttttgcgcaactgttgccgtgggttcgtggtatcccaaactcgggtggattgttagtacttggtagcgcaaatgttgatgagtgcttacgtgggtatctaacaaaatatgactgctcctccgcagatatcaaccctattgggggtatttcaaaaactgacttgaaaagattcattgcctacgcatcaaaacaatataacatgccaatcttgaatgactttttaaacgctacaccaactgcagaattagaacctatgactaaagattacgttcaatcggatgagatagatatggggatgacgtatgaagaattgggcgtgtttggttacctaagaaaggttgaaaaatgtggtccttattctatgttcttaaaacttcttcatcaatggtccccaaagttaacacctcgtcaaatatctgaaaaggtgaaaagatttttcttcttctatgccatcaacagacacaagcaaactgttttaactcctagttatcatgctgaacagtattcaccagaagacaacagatttgacttacgtcctttcttaatcaacccaagatttccatgggcttcaagaaaaattgatgaagttgtcgagcagtgtgaagcacataaaggctcaacgcttgacattatgtctattgattagcacagaagaagtgctcacagcaaaataagacttttccacgagttcatatattctgttatttattctatcataaataaagatataaaagtgatatttaacccttatgtattttgcacggttttgtgttgaccccaattagtcttgattactacattcctagaatcgttccgcttccagaaatcaattaaagtgattgctgtttttataggcgaatcttcttgaatgaaatgcccggaatcttggaaaactaccaactgatatttaccttgcatttgccccacaattaattctttatcgagattttcgtttcccgccaatattaataatttactaacaggtaagccaacaaaggagtgcgacagatcggtaaaccatgtgtcccagaaagggctaaaggtcttaaggtttgttatcctgacaactttccctgacttgagcggagcaaataaagctggtatagcaatttcggcgcttgacctcaatctcgataacgcgtgttgaacgtgccaatcgacagcgtcattaattgattcaaatacattgggtgtattctgcaaaaaatgttcaactttatttaaggccataatggcagcctcttctacaatatctaacatagtaataccaagaattttcttttgtagttctgttgataatttagggtacgcaaaagtacatatacttccaccaagggaatgaccaattagtataacagataccttctgaagtggctcttggcttattttagacttaaaccaataatttagcaggcttacaaaatctttgataaaagagtccctgtcaaagcatataggcgcatcagccttcttaaactttgtttctgcatgccccctagcatcaaatgcaaagcatccgcatcttccttctagtttagtatttaattccttggccaagtttgcaaatgataaacctgaggagcccgccccatggtggaaaataaagatgggaattgaagtggtatttgataacaatgaagtaggtaatgtatagtatgtatttacgtccagatctctatcaggaagacttaccaactccttattatcaaaaaaatcactccaagtgggtaaactactcttttccttacttgaaattctatcagtagtactaccggttttgcccgtatattttctgttcctatttgattgtccattaaatgatggcagggaacctaatgcatcaccatcgttttcatcatcctcgtatgcttcttggaatgtcgcatctagaacattcttggctctctcaaactgggataaagcaatttttcttctcaaatcgtcagacattgaaaatttgaaaatgtcctaccgttactaccagtttgttgccgtatttttgactctttgttgagcattagttgatcattaccgctgcagtcagttaatgatatccctaaataggcatattgtacaatttcaaatatattacccgaattacaagaacaatagggtcttctacaatattactatgaacaattcataggggaacatagtccacttcaatgtcggtgccaacgattctatttgttgtaagtatatatgctgtttcccggcaatactttatattgggggaattttctggaggtttaagggcatattactacgtcaaggctgggattgaccttctggtatatattacgttgcgcaggacattccttatacttgagcctttgtaaaaacttcttcgttctcctgaccaaccgttcaattatgttgtgaattttttgatccgagtttgaaacatccaaattcacaaacaaaccgttgtcatcctgagttggcgtcggccattgagcttcctctatgtgttttaaatctttcattttaagaaatctaagtaaggaaattgtttctccacatgtgtaccgtataaagttcttgttatgaattagaaggattatcacaaaagccctccatcaaatctgataatttcattacccaaagactgtaataccttgggtgtaaagatcgtattttttgatgtcttcgtgatattttgcagatctttccattttataaatttctgcaaatatcgtgcatcagctcatcttggaattggcacaatctgcgtaatttttttcttggttctcttctccttttgattttaagagcgctttctattcagtagcagattttcagtaaataaagccatctttctcaagtaaactcatgatcatgcagttgttcaaaattacaccaataacgatgttatctttaaaactttccccagaaagaagatggcacttttgcactaaatacttcaaactatttaactttgaagcaggacatattgccggttatttgaccatgctggcgccgttgacattcatgtaagcagtattagcttttaaactgccattaacgcacctatacgattgcggcggtgcgaaaacagtaactagcactcttacggctcattgtttcctctatccaaagttgcctatatcacaataaaattagaaattaatcattttaataagcttgctgccattcagtgactcgcaatctacgttttaaacgtaatttaaaaatccacttccacctacatattttgcaacagtcgtacgacagaaactgaggctctataaaatgagatgtgctaattgttctttcttggctggtttcagctacatctttctgtaatcaatctacaaatttacacgcgagcttcattttgacagtaaacaaatgtaaaagacacatgcaataaaagcggtccagaaaacaaacgacaaagccaccaaaaatgtttgcaaacgttggatttagaactttgagggtctcgagaggtcccctttatggtatgtttattgttttattcattggtgtgctaattgctaaatttgcgggacaaatgctaatcgactcagagactaacttttctcatatcataggatcctgcagtcaaatcatcagcttttccaagaggactttttactcaagtgccaagagtgggtatcaatcgaacaacagtcatggtgatgcgtatagttcaggtagccaatcaggcccgttcacctataaaaccgcggtagctttccaaccaaaagacagagacgatctgatataccaaaaactaaaggattctattagatcacctacaggagaagacaactattttgttacatcaaacaacgttcacgatatttttgccggtgtcgcagacggtgttggaggatgggctgagcatgggtatgactccagcgccatctcaagagaattgtgtaaaaaaatggacgaaataagcactgctttagcagaaaattcatccaaagaaacgcttttaacgccaaagaaaattattggtgctgcatacgcaaaaattagggatgagaaagtagtgaaggttggtgggacaacagccattgtggctcacttcccatctaatggaaaattggaagttgccaacttgggtgattcttggtgtggagtcttcagagattctaaacttgtattccagacaaagtttcaaactgttggatttaatgctccttaccaattgtcaatcattccagaagaaatgttgaaagaggccgaaagaaggggtagcaagtatattttaaacacccccagagacgctgatgaatatagcttccaattgaaaaaaaaggatattattatattggctaccgatggtgtaaccgataatattgccacagatgatattgagctttttctgaaggataacgctgcgagaacaaacgatgagttacagctattatcccagaagtttgtggacaatgttgtcagtttaagcaaggaccccaattaccccagtgtttttgcgcaagagatttctaagctaactggcaaaaactacagcggtggtaaagaagacgatataactgttgttgtcgtgagagttgactaacactccgctctttaatctcctggaaagcagtgtaaataaaaatacagcgtcataaacggtactatataaacacgtagccatttaatagagccaaacataagtgggcatatatagtaaaaatttaaagaactatattcgcaaaagaatctcagtcgaaagaacgttttaaaacaatctttttaatcttgtttcgctcggtttttagtttctcttcttcttcaaggacatcagagacaaatttcacatccgttggtaattgtaaaattcttgattgtgtcttcttaccgcttttagtcaagaacgtaaatgcaatcttctttggcttggataactcttcgtaggtctccttgcttgaagaaggttcttcactcttttttaataataaaggtttttgaacgctgactggcttcgaaattactggaattttactggcaacaaccttttcgcttttccttgcgtctatggattcttgcatcattttctgaaattgcctttccaattcttcttccgctttcctttcttcctcatcctttagttttctctcgtactcttcatacattcgtttcatttcaatatctctgtctgcgtcaagatcaccaccatactccaaatcagagtcgctgtcttcttcttcttcatcatcatcatcctcatcatcatcatcttcatcatcatcctcatcgccttcttctccatcatcatcatcatcgtcatcgtcatcgtcatcatcctcgtcatcgtcctcatcgtcttcatcttcactttcgtcttgctttgcctgatgttttcctggcgctgactctgtgttcggtgtacttatctccgcgtcttcatcttctcctagtaaatcgacaccatcgtcgttttcatcatcttcatcctcatcatcttcggtgattgactcgataggaacagcactctccttaccgttgtgaatgcttgcagaagatcccttcactctgtcgtctttactttttattgcgtttaatgatttcagtaaactttccaaccttgaggcactttctaccaaattttctgacctttcaaatttagtgtttccgaaaatattctcatattttttaaatgtgcttgaaactctgaattctgtttccttgggtaaaggttgttctttaataaaagtataatactcgaaaaacctcagcaaaagtttgcatttcttagtaaaagctgcaggggtcctgttgatatttaacagaattgtagtgactagttgaatcctgaaataattatccggtggatctgagtagtttaaataaaatggattgggttgattgttgatatgaccaaaccgaataatgtggtagatagtatctaacaaaacatcggattttatcatttcaaagttgaatatttcagttaagtatctgacatttgatattctatgcatgttttgtccataatcgttaatttctaagcctcgctcaatgttttccagtacttggtctatacatctgatgacgaaatcgcggcggtaactgtatagaccgcctagaacttttgttaataagggaatattttgatagctaatcttatgtggttttgaaaacagagaaaacagcactttctgaatagctacatcgtcccagtgagctttccgaaccaacttgacaatgtgtttgaagtctaggctacttagttcacttctaattaatatgcgataaaactgttgttcaggcgttattgtttttaccgtaacatttaatgattttacagaagggggataaagtaaagtaattatgttttctaaggcgcttttcatgttcatgttcaattgcctatcattttttttatccttgattagttggaccattttttccattaattccttatattctggcttatttagcagaaatttccctgagtgctccaacaaaaccgtcaaaatttctacgttatttggaacttgcatatacatgattaatgttctaatcttatgaaaaatcataaacgatggtattaattgaaatttaatcatttcactgaagaagatgatgtttttaacgttaatcttattagaatgtaattgactcctgaagccattgtctaggtagttaataaactcagaaacaatttccggcatatatttgctatttgttgcaataaatctggaatacactggcagtttgctccaatcttgtgtttccatgaaaaatttcaatattcgatttcttgtggctttgttgtccaaatatgatgaccaatatctatttgaaaggtcatcgattatatctttacaatctgccatttccaaatccgtaaagaatagattgatattttttgagttaacgtttgaatctttttctgttttagaagattgtgattcttctactgtttttgagatatctggtaagatttcataaaatttccttgtatcttcattttcccataatcgttggttgggtggcaatatctgattcgtgatcattggagaagctgtttctttcagatcatcattagaggcaccttcaagctccggaatttctaacttaaaaaattctcccaaagtaattgcagatgtcttgaacctaatgaatattggaagtaacttgtcgtactcctctacgtactcatctctcaattttcccgttcttatttggcatttctgatgttctctttgcagtttattgaccttcttatgcagttctgtggccctcgcaaaagtggcgtctataaaattcttaaacagagactgtaacgcaccttttaacttcgagtcatatattaaatcatcccaagaattatcatcgtcgcgaaacaaaggtgcaaatttcttaataaatgcggtcgcaatagtggtagtaaagcccaatttgaacttataattaagaatctctctgagaatactgaataacaacggatcctttcgcccagttttcttctgtaggaagtttggaatagcatctttcgactcaatatcatccaatgttctaaaaactccaactaaataaagctcggtaaatacccgaagattacctttaactctggttatcctttgaagctcatctctttcggattcaatgtcaacagaggggttctcaaaagcttgtaaaaaagctcctaaaagcggactagtaaatcggccattgaacctttgatgaagtccacttatgatctcaacagcggcaattacgtcatcatttttattcaaaacatttagcagacattctgttaccgtcactattatctctgataggtacttttccaaggacgcctcacttaaatctttcaataatgaagattctgaacctttcacaaaacccttctttagtttttttataaagccagtgtttctctttatactggaatccagttttttacttttcaggggaaagacttcttcgccattccaagctcgggtgttcaaatcatgcaattcttttttccgtccatcctgttgatacataattgttaccgtagtttacaacgatcaataaaagaagttagtataaaaccttagaagtactgaaaggccgatctggccacagtaagataaatcaaacatacgtccataatttctgtccaatgtattatcaatgcagatacaatattagattatttaagcatttaagttgattgttactgttcattgtaaagtaatatgggcctcattagtttctcaaacctgtattcgaatgcagtttttcagtgactgccaagaaagtgaaaaaaaaaaaaagaagcaggctccatcaattcgtatcaagtgataattatcacataaattatataattgtaaacctattaataaccctaatatcatcctcatgccctaagaaatattcaatataaccccctaacaatatcataatatcccgtagtgatcatagaaacgctatatgatggtgcataattaagataaaggtcattcaggcatgaaataatgaactttagtgaacgacttagtcatacagagtctattttagcttaaccattcggttttattttacagtctagactcaaacgagtgaaaaattgcgatatctgcgatgaccgagtcctgaacaataaaaattgaccagcagggaaagaaaaggaaaagatctcaactctggcggttgcctccaggacctgcactagaaaggactattgagtgtagactaagtggtggacgggatggaggcacttatcgtatttatagtgctttccgtatccggagcatttgcttacaaatgctcctatgaaaggctctggtttaaagtagggtctttgtttgacattatatcaacttcctcgaagaaaaatgtcattccgttggcaagcaaaatggaagttggctcgaatgaggatgtgtctagtatgggtaatttcataaataaattctacacagagtattctttaccctcacataaggtactgcaatcactgcgagtccttttttcattagcaatgatgacgtatacagtaaccatagagattattctatggcagattaaggttgctggaatggacaaggaagttactttcataacgacttgggtgtggcctctgactgcaatcatgctatccttcatactaattttatttcagccctttttcattataatatcgttactgaataaattctacaatgacaagttcgatatcgataggttgataatagtgacatgcataatcttgtccacacttattgcgctgttaagttacataaatattggaccgttccagtacacaaaaaatattctaactagattgtccatcggaggcgtcacagtcatggcttccctatctgggttagccactgtttctagtttatactacaactttttagtcatctggcacaagtttcgtaatacaccaatgtcagaccccagttttagaaacatcaacaacagcaacaataacagtaaatctctcttatggacaacagacgcctatatagaggaaaaaatccaagattatgaacacaacattgaacaaaatgtacaaatattaagaagtttagaagaagaggtcggagaaaactcaacttttaaagcagagttgatggaaaaaatcgcctggtatcaactggagcttgggaaattggaagcattattacaacagtcccctcaggtacgcacttttaagaaagcttttgaagtcgggtttatcatatactgtcttcataaactaataataactttcctgaaaagaatcccctatatcatataccactcgctcaaatatccagatgactacgattatgaaaattttagtgaaaatgcagcatccgatcctttagccattacgatagcaaatattttggatttttcgtttttcaggttcaattaccagcacgatctcgattcgttaacaaaacagatatcgttatttttgtcaatttctctctttctttgctgtctttctgctgtcaataccaccatctcctacgttgtgacccttttgcccataaagttccagattcttgcacttttcgccatgcagaatgatgacactgctaatgtacttccagagtacaccaataactcttcctataagggaaaaaagagaaactattctcaggaacaaaaaggaatatctttgataaaaaatctggtggtgtcagagttgactggcgtctacgttttggctacaacgctaatggttaggtcccatctcccttttgaagtatcacaaagattaaaggagctattgggtggaaagtttaccgtcccaaacattgtcatagattcttggtttgatgaagtctacgcttttgcatgtgtgtttacctttatttgcataagaattgcagaacgaaagctttccaccaaaaaagtcagtgttgaataactggagtagtatgtcgatgttcgatgtttatgagatatgtatttataaaattaaatgtctgtcgggtagtttatgtagggatgagaaaagtagtataggttcatgaagaagtacaactttttttcatttatgcaagggcgtaaaaattatggatggttactactaatgatcaaagtaacattaatgcaataatcaaccaagaagaagcagaggggcatgaacatgttatgaatacaaaaattcacgtaaaatttgatcgtcacttaaattttccttgacaatcatataaacacctattaataggtttggaaaacgcttggtgaagtaatcgtaaaatccatcgggtaccggccccattagttctgctatatcttcaggtaaatccataaaatgatgatatttattcctaagtgctcttaatagatccattaactttgatgaatggtattttctgtacctttcaaggttgtccatgaatgttttatcaaacttgacagtccaatctccactgggtattacaaagtcagaaccggcgtcaaatttcattaacagggcacttggagggtctctgttttcaatttcaagcctatcactaacttttaaaaggaactccaattttttcgactttggccaaaacaacggatgccttagaactttcatagcagtaggtctttttaacggatcgtgatcaatcatttgggagatcagatctgtagcttctgcaattaaggatctatcatgtagacatttcatttcatcaagactgaatattcctcttatgatattgctttcacgtgaatatttatctccaaatggatgcttccctttggataggatataatagaatacacatcccatagaaaaaatatcaatagatcttgttagcctcctcttggtgaacggatcataaaaagaatcagatgaaactactgtatgcctactagaagagtgttccgtttcgacttggcactgcaaattgtttgattcttcaagcagctctggggccctccaaccacttgtgccagaagggttattcaaatttgttctaaatgaagactgaccagagtctagttttttgcaaagaccaaagtctgatatcaaaattcgaagattttctgctcctgtttgctgatcggcagtaaacctactcgaagtagaaacgagaatattttgaggctttaaatctcgatggataatctttaaagaatgtaaatgtgctaccccggacgctatttgtctcaataacgaaattggattatactctttctgtaatttcaggttttcatctgatacattcttagactccaccaaatcttgaaggttcaaattgcagagctctaaagcaatatacaaaaatctgtctgttgtttctgaacagtagtatcgtatgacgttagggtgatcatcgctttcagtcaaaagttttatttccattaaagctatgtcacaaaaatcaattaacattctctttaccgcaacaggtcttccttgaaaacttccctgaaaaactactgttcctgatgaaccgtaacctaaaattttttcggatactaccaaattttttaaagattgctcaaagtttggtatatttgcaatgcgtgattttcggccctttttgcctcctctcgaacctcttttcctcttcttcttttctgtggttaaatctagtgatttttcatcatcttcatcagcatcatcgttatctttttcagattttagacttccatcgttcacagcaccttcaaaaacaacttgcttccctgatttcatatcgaatggcttggttacattttccgatgaagagggacaatttagcgatttcgactcaactatggggatttccttttcaggcataaatccaattttggataataatacatatagtggcggcaaaattttgaatctttgtagtattgcacaaaaaatgagaaataacaacagaaatactccagtctctataattcgatatactagacttccaaacttcagtagcaaagaattttggttcttttcatctaattctctcgatatttgctcgtgtatcttttttctatatgcctcaaggtcttctggtgacatgtattcctttagtgaattcatctcgttattctgatgtaaatcggttgtatcaacggacgaatcaatcatcagaggtggatatttgtgcgtagtgtccaaactattcgttttttcatagttttcataaaggtgatcatattcattattatatatctgatgaacacccatgattgcgttcttgaataaagtctcatcttcaaaaattgaagacaccctccaacggtcactggaagcgtatcttgatatgggagctgattcgactaaagatggaaaattctgactagataatgcaaaccaggagaggttcgaagtctgatccaagtaaactttgttactcgatatactttcatgatcaccaggattaaagggatgcggtaccagtatattttcattggtgcggagatcattaaacacatcgaaaagcccaacaataattccggggaatgtcggagaaacccatctagcaattctaaaatctaaatcgcttgctagcaatgatttatcacggaaaggcgctatgcacatgccgtcctttgaaaatgtattctgaagcgctaggggaacatctaaaacattttgctgccatgtagagtaagtgacattgtagcttgctccatcataagagtgaattcccagctcaaaaatagttttgcctattacaatcatattttcacattcctgaagttttatcttctcctcaggtgagcaatccacactctggctcccgaaatacccgttttttgaaccaggtccgaacgctgatataatttcaccattcaacatgtttatagtatacattatagttctcatcgatccagtgtagaccttttcatcttcaacaatttttccagagtcattaaccacaatatttgttttcaagtgcagcggggaagttgatacaagttgtcgtatggataaaggcagtttttgtaacccttgatgggcgttaaagtagtaaatgttcccatcaccgaaaggttctataatcaacgtttcatatgtttctaacctcgaaggttcttgtatttctatcagaggttgaaaattttctggttcgattgaccatatgatatgaccatttcttctatctacagcatgaagtccaccctcaacgtcggctgcgattagtatatctgataaactcagttcgttcaaggaacgattctccaaatagggtacacttatagaattggcagccctacgtccttttttgttagcacgtcgattatcagcagtattcaataagttaggagttggatatgagctgagtttcatatttggtaaaccttcagtggttcttggagcaggaatgggcgagtttatatttttatccacaccatagttgaaattgagctttttagtggaggcaacttcatcttccactatctgccgccttgaggtgcgagacgacaatgggattgagcatgaaatgatggatgaaaacacacaaacgagcagtgtcaatactaacatgtttcttcgaagtagacgcatttttcaaagtgctaaaatattaattcctcagatatgctgtttttttaatgtgtatgaagggtgatatggagaaaagtgataatggacgtggggaagaggaaaacgatgctttgtgaatgagaaaaaaaagttacttagcagattaccgattattaacagtgccagttatagtgtagatttaattgtgtaaaattaatattgttatagacttttcactgttagtttatgtgaagttggctcattgatctcctatgatatgtttttcgtttatttcttgttactatgtgattaatctctttttttaaattttattgttggaatagtcgaaggtattgcccgaagaggcttacgctccgtcttgattttcggcaataaaatagcgaaaacctattatataacagagggtaataaaacctcaaaactacaactatcaatatatttcacactacgcagcttaattagtaactgtataatagcatttaagttcattacttctttgtaattttatctttttttttttttatatagttttcagcgcgcagcagagtttcattggaacgcttcgcacgttggaagaatagaactgtccctaaaagcccattagtccttcattgaataaccgatctcttcaaaaacatccttaattttgcattgcttttcatcagcaattatttgggccaaccttaaaccggcatctctcaattcgttgtactcctttaactctttaatgtacgtcgaggaaattttttttggtgtctcatcactttgacaagttctgttaataacagaaactaaatattttttgtttgttataccgatttttgccgactggaaaaaatagctacatactttttcttttctttagacaattgctcaaacatctttatcaggttgccattcatactttcgtattcctgtatctgtttttgctttttatttaactgtgtttccaaatagttcatacttgcaagttgtcttctgtttatggcaaggataagaccattgcttttaatttaaaattattcttatactctgtctttgcatttatgaagcagaaatagaatagccgccattaggcagaacaattccgtctgatgtgataatgcaaagtgtgcctgtcatctaacttaaaaggaatcaggccaaccgctacaggatatgtactagatacaattactaaataatacaaacagaatatataaaatgctattaagatagatcatttgcgtccctctcaatgttgtccaacatagttttcatatgatttagttgcatttctgttattttgatactttctgataattgctgcaatttgtgttcgtcatcgtttctcaacatagcacgacctcgaggtgatattgcactccctctgttactgatccaatcccaaatatcgctttcccttcctacaataggactcttatcccttgcgtaatttacattttctctcttcttcttagatgatatggcgttttcatatgagttatacagtgtgccgaaactgggcacgtaattatattcttgaccatcaatcagcagccttcctggcttgatgatttgaagattatttttttcttgaaacacgtgaagccgaggagaccagaaaagcataatggtcaaccccaagatcaagaatagtttttgaggactcagcaatttgttcataaaaatttctgaactaaaattattctgaacgaaatccaaaatatgagttaaaatgtctttattatcatcgctcttacggctttcggaacttttctgttcaaccttactatggaaaggcctatgtttatcatgactcttcattactttcttcaccggttttttgctttttgccctgctaataatgtctcttaactcggatagcatgtaatcgacagaaaccttctgaccctcaacagatcctttctcaattgcacctttcaaaaatgatttacttgtccagttgatttttgttataacggtcatattcgtggtgtcatgctgcccccagaatagaaagattttactttctactgcaaaattgctaccagaggggacgtctggagttttagttgtttgtgtcaccaaaacatagttattgatatccatgtgttcaatagactcggttagtaaacattttgtttgcttaggtccgatagaattgttcaatttcttcgtgtactcatagtgtcttgaacctccttcaaccaacgaaggcgtgaattttggtatcgtttccacattgacattattcttatctctagtgataactttctgcatatactctgtattcgatccaaatagcaattggaccacggtccctaatggagctggtatattctcattttcccttataatagagtcatccttatccttttgaatatcaggctcggtaggtgcatgtgagctaggttccattttcggtaaagttgatactgtaacagtgttctccttcgaagaccttttccttttggtagcagatcttgttaaaatattaccaagctcctccaccaatatctttgttgcatccgttacaccatcaaatgtacccttttcaataggacttttgatcaagcttttacctgtccattcaacagagacatacagttttagttttgtttcattgttgtttgcccatgataaaagataaactgttctcacataaaatgaatttccagaaggaacatccggagtttttgttgtttgcaagacttgaacatactcctctaagttaaagtgttgaatggtttcagttatcatgcatttagttttaccgggtccaatggcacctggtgttgtttttacgtaggaataatctctctttttaccttcagaaaccgtgggtgaatcaacgagaacagggattggcgaaatatcactattcttttgcgcttttaaaatggccataatataactgacatctttcccgaataatatattgacaacccgccctaacgaagcgtgtattgttgattcgttaactaatttttcattgggcgctggtttgtatactgtttctgtgggtgagtgaatttttggacctagtggtggaattcctgttccataaggggtgtctgtttgtagaggcatgggtaaatcttccggctttcctatgctgacgcttgatgtcatgtcggtagaatcagatatgttattgctattatcgtaaagatcgtcatcatcatctccataatcatcgtaatcatcatcgtaatcgtcattttcatcatcactgatagaattggagctgctattagtgttattactgttgctacgaaacctctttcccaaaattatttgattccatacttcagtaattaaatcatatgtagcatctcttgaagtgaaagaggcaaacgtgtattttgtgtgtaaagtgtctataacgatcccattagggaatattcctgctgtggcccttttctctatttgaacgattgtcttgaacggtataaaaacggtacttacccaaccaaggatgttcgaataaaatccaatatgttgatcagaaatatacattctgccttgcaaaaggatatctcttgacaaagcacaactatggtctaaaatcaacctttcattggggctgacaccagagtccttgaatattgcatggaattctgcatctttcttttcgctcgcgtattcgactccctttattctaatgctggattgtctaccattttcctccgatggctcaatgatatttacgggggtagatgaaaagcttttactagaacttctcctcaatcccgaagatggacgaccgttggacatactaggtctcggtatgatggtcgatgcaatatcagtgctgttttttactttgtttagcgaatatttcagtgccgtcgaaggtagtactttcattcccatgctaatgcttccgggggaaaatgacctcctgttaagaaacttcttggacatttccctaggttcgcggtcttcatactccgggtcgttattcgttaggccattagaggagttgaaggacaatctttttttacaatcttgtaaaacgtcgctactggtgttttgtttatctgccattgcgctaatcattgatttggctcttcttctaggcttgactccatctgttgtagaggaactgactactgaccatttggaaggaacagtttttctttccaaattactttgttgtaccgggcctctgctgtcaaggtgatccgcctctggcagcgattctgctgacattgcctctaacccttcaagagtagcttgagaatcatcgaagtgctctaattttaagtttccaactccgggggtaggcttatcatgagagtgcctgatgggttcgaaaaccactttcctggccatatcatccgtcatctttctagtgtcatctaatgatgtatcatctcctgagatagcattagagcttgaatgtgagttcgagtgaatatggcctttcaaatttccaaatgccaatctagataatgatgatggtttacttttacttcctgcttccgttgtattaagctgttggttacttggagttgatgatttggatgctgcaagaatattgtctaaatttttcaaaaatgggccatcgctttcttttgtcgatgaagtgtttttattgttagtgctattttcggaaagggctcctgatatattagatgagttttttttcctgtcctttggttcattcctggaaattgttccattgtcagcgtcttgtacgtttattttgggaatgtggcttacggcattatgggcgaaggaaagaaacgtttcaaaggcggtatgttcatcatggccgtctggagttttttcctcagcttgattgctggacccttctcgtttcccactttgcagtttttccttttctaatgcctggacggataaacttggtacagaatttgaattcgagttaccatcctgaaagcgacccttcaatgaacctgccgtcaaattcgtgtttgtcttttcaagcctgtttgtttccatgggatctataacgattggaatattgaatacaccttggctatgcgctaaggaagatgccgccgccttttgagatccttttgcaggagattccgtgaaagtttcgggcttaagtaaagacggaatatccggatttcctcctactcttctgaatcgctcagcactggctgttgtgctaacattctctcctgtagtattatttaaaaaattacgatccttcttgtgcttacgtttgactccaattgtccttaaaaaggcagtgccccaatggtgcttcttttttgaatctctagtcattactgtatattttcaacactatccatggagagtaagaaccacacacagtagcaataatttaatatcaatggcaatagcaacgaaattacagtagataccgtgagccagcagaaacagattgatatttcgtatttcaagaaggcagaatcattcaaccacctaccgtcccccaggaggacagatcccaacgagggacctttgcgcccaattctactcctgcaagggtttcacttagaaatgcttttgccaaggtaaaggacccctaagactagaatgaactacgccggtccgtccggccgtcatactccgtggaaatttacttctaaaaggagaaacagcgatctttgccgcataaagccagccactactggcgtggaaagatttttagattagaagacaatacaaagcggcaacgtcataaccttggtatttattgggcaagcattttcatatcagcgtacatacaccagcaatgggaatgtaaagaagagtcgttactagcatattttctattcatgcgggtacccaacatgtcacgtttcacgaattctcgtgcagtttttcagcgatgagctaaggcagatggttatggactgtgccttctgtagtctgtggaagaaaaaactggttaacagcctacagtagaaatcgattaatataaacatatatctagcaacgtaacggagtattagatcagtaatggaagatatcgaaaagataaaaccatacgttaggagtttttcaaaggcgttagacgagctgaaaccagaaatagagaaactaacgtcgaagtcactggatgaacagctgttgctattatctgatgagagggctaaattagaactaattaatcgttacgcgtatgtattgagttctctgatgtttgctaatatgaaagtcctaggcgtcaaagatatgtctcctatactcggcgaactgaaaagagtaaaatcatacatggataaggctaaacaatacgataataggataaccaaatccaacgaaaaatcgcaggcagagcaagaaaaagctaagaatatcatttccaatgttttggacggtaataaaaaccaattcgagccctctataagcaggagcaactttcaagggaagcatacgaaatttgaaaacgatgaactggcagagagtacaacgactaagattattgacagtaccgatcatataaggaaagcaagtagtaagaaaagtaaaagattggataaagttggaaaaaagaaaggagggaagaagtagaggtcgacgtatactggtacatgagtgaaaaaatgattaaaggtgatgtgagagcacaaatgcaaaaatgcttatagggtttatatacttttataataacaataagaactcgttgaagtaactaatatgtgtatatgctattcttgtagttggcagtgaacacttttgtgtgaattgacgttatataagactgtagaaatatctaagaaaagagagttttcataaaacccttcaagcttaactaccaaaaagcattcatacttagaagttgaaatgcacgatgatgccaaattgatgaaaaaagctaaaaatgcatttcagaagggaagaaaataataagcaacataacagagggaataggtgcgcttagtcttgttgctgtaaaattaaccaattattcttgtattgttctaacgatccgaccatttcatcctgaatacttgtcttcctgccagctcctaattttttatcgtgagtggagccagcgaaagtttgagcataaatttcataaggaccgaaaatttgcctttcatccggggaggttgacgaggattcgttgtcaccaccttccattttgccatgtgccatcttgtcactttctccttcgtattcttcgtcttcgaaaattatggcgtcattgttagagtctgcgaatacgtcttcattttgcaacgcaatcgtagtgcttgaatgattacgaggtaataaaggtttagggaagccaacgaaggagcttttagctcctggtgaagaggacaacttctcgagtgctttattcatatgcagtgggttagattcattagcactggaacgcctggaattgtaagatccaccaaaattaacagaattatgcgaaactgacaacgtggcctcgttacttgtcttcatattcataggaggtacctgtgttcccaagttgaaactcttcctatgatgaggtggaacataaaccccatttttaaatttttgttccatactgagtctacgctcctgctctagctccttagagtcagatgagtgtgaatatcgattgccaatattacctgttaaaattggatcaattggtccagaagataaatttaaatgtgcttcagatgatgctggtgattttagtaaatctggtagttcattagattcattattgttattgttgatatgcaatgatgttgtcaaaggaggtggaatatattgtctatgatattgattagtggtactattggtgtcgatatggttgttgttgccattgttattgtgattagtgcttgcgtgaacaaatacttcattatggctacctaccgttgtatgcggtaagtgatcatttatagataagttgtccataccattgacgaaatcatgatcaccttcttcaagagtgaataaaacgtcgtctgaatcgtgatcgccctcagaatccatactatcctgagtgtagtgttcctggtatgaaggcttcccacctaaaacggtagagatatcaggagcagttgattgcggaactcttaaaaactgattcgttgggcttacgtgatggttcctggcatttggtggaatataagcgcctggtgaatgttgaactgtagtcgtagaaccacgccttgcataaccatttatagaactattgttgttatgattatagctcatgttgtaccttgaaagtggtgacttaccggtataactggaggaacttggtcttctgtatttgttaaagtttttgttccaaccctttatatagctattaccattgttaaaattattataattacttccatgattgttattgctgttgttgttattattgttgtaattacgattctgtctgtactgtttattgttgttgttggaaaacccctccatatacctgtgctggacacttggaggagtgaaaaaatctctggtgttgaattcatcccttgctttgtaatcgtggaaaaaattattcatgtgtgtattaggcgttggtatgccaagaggcttccttgattttttcaaaattttacttttctttctatcttcgatattgactggtttggaaaattgattatcagttcttccgtacttattgcgcttcttaaatttgaacttaggagcagatttagccctttcatgagtagatagtgttgtattataaccctggttgaaaaatttctgttgttgtgtagacggttttttaaagaagccgcttgcaacattttgattttgagagacatctgaccgtttcctttcattcacattattgaaattgaaatcctttttaaattcaggcatatgttgtttgttactagatgaaataggagtaggtaatgataccggtgctgaagatggaggaacaggctgaggtggcaaaccgtcaatcatagtttcttcatatccttcatccaagttattatagtattcatcgtctaatgtatactcagataagttctgtagttcagttctcatcattttcaagtctctattagccggatcgatggttaaactataccttaatacttgaaagaaatcataagccattgtcgaaaatacatcaaacaacgcttctctattagcagcaaaataacagaatgacttgtcggattgattggcaatactaaaaggattcttatggaaaacaatattaagaaacacaattcccatagcccataaatccactttggcacagtcataaggttcctttctttccttgatatccaaattactatcaaaaagttcaggggacatatatctttcactaccgacatttctatccatagacgtcttatctgtagtagccaatccccaatctgtaagcttaattgtccaatcaattccagaaattaaaatgttctcaggttttatatcacgatgataaatgcccttgttatgaacatattcaattgcatccatgatttgtgtgataatatgagtgatcgatttggttttcttaggcacagcatcggctttgatcgcctcatataggtcaccgccagagcaatattccatgatgatgtaagagtcgaagaaatctaatagagcagcaatattttggtgtctaccaatttttgtttgaatatcaacttcatacatggcttcgagacaaatgttattagatagtcttgatttaactttcgaagaaattagggactttttgtgtttgtagagattgtgtttcttctctctacttgacccgttattactggaggcattaccattttcattttcatggcgatccgtatcaactttcgtgtcttcatcatcatcacaatcgctactatcacaatcattttcgtcgtcctgaggcccatcgtactggccgtcatcttctaatttgaaaatgtatttgactgcaaccaatcttttctctctaacatctttagccaatgatacataaccatatgaaccttcactgatatcctctattttttgatatcgattattcaaaatacctccttctttgtaaatctcgtaatctaaagtcatcgagtttcaaaaaattgtaagaaaaaaatattgcactaactttacgtgtctttttgttttgtatttgaaatttctaagtttttggaagtttttaattttttttttccttttttattttaggttaaagtatagtgaaagaatagtagggttaacggagagaaagaatccggtaatatgcagtctataaggcctataagatttgatggcgggtatgaagcaggttttttttttttggctttttcttctaagaaaaaatttatagagaaaagatgtctttaattataacctattctttttttttttgccagctaataccagtaagttttgtttttttgcgacactagattggaagagtagaatcagaaaatgaaccttctgtaagtataaagaagtcttttttctctttgatactactgtattcgtggtgtcccttttcagaaaactatagctttgagcctgtatgctatttttctatttccttctttgcagttcttttttgagcagagaacaatatccgggtcacgtgaaagttagataagcatgcaaagatagccagagagatttcgaagttgaataaaacaagggaatgggtcacttgttatattctttacagattgagagtgcagtaatattctgcggacgccagtaagtactgtttgaggttgtatttttatagtagaggacacttgagactgtgtaaaatgcgctcaccaaaaaaaagggtctgtttgcgatcaacaaacaaataataagataagttagggaaaagaaaggtgaacactgttgcggaatgcgtggactgcttgtgtaaaaatgctagtaatgagggaagtgtggacttgatatggcctgttgtggaagcctgagagttctttcacgtgctgtgttcggcccgcctatatagggacaaattgttaaaaagataaataaatataatctgcctcggaaggggttgggaacgcccggcagtagcgatgagggtaacgggacgatatttagaagtgaatgctgaaataaatggtgtgaaggcctcttgtatgtcgtctcatatagggctaaaacgaagccatcgtgcacaatggtaagttcattcagtgttcccatgccagtaaaacggatatttgacacatttccgttacaaacatatgctgcgcagactgacaaggacgaggccgttgcattagaaatacagcggaggtcctacacattcacagaacgcggtggtggaagctctgagttgactgtggaggggacgtacaagctaggtgtttacaacgtttttttggaggcaaatacaggggcggcattggccacagatccatggtgtctgtttgttcagcttgcgctgtgtcaaaagaatggtctagtcttacccacgcactcgcaggaacaaaccccatcgcatacctgtaaccatgaaatgctcgttctgtcccgtctttctaaccccgatgaggccctacctattctagttgagggttacaagaagagaattataagatccaccgtggcaatcagcgaaattatgaggtctcggatacttgatgatgctgagcagttgatgtactatacgttgctggataccgtgctgtacgattgttggatcacgcaaataattttctgtgcctcagatgcgcaattcatggaattgtactcttgccagaagttaagtggttcgatagtcactccattggacgtagaaaactctttattacagaagttgtccgcaaagagtttgaagatatccctaacaaagcggaacaagttccagttccgccatcgagaaatcgtcaagagtatgcaaggagtttatcacaaccatcacaactccgttaatcaagagcaggtcttgaacgttttgttcgagaatagcaagcaagttcttttaggtttaaaagatatgttgaaaagcgacgggcaacccacttacttacatctgaaaattgcaagttacattctttgtataacgaacgttaaggaacccataaagctaaagacatttgttgaaaacgaatgtaaagaattggtccagtttgcacaagacaccctgaagaacttcgttcagtaatcactttcaagctgtagtatgtaaacgatatagatgaagttttcgtgtgtataaatatatgaactctagagtgttgcataatttgaaacacagcatttcttttcggagagctcgtttcaaaatgaaacaaacgccgttgtccgttttcgtctcaatagaaaaagtgaaacagataaaaattgttttaaaagaaacgaatttgcaacatcttaagatatatcaaaactaatacaaaacagcctaaaaaagattgaacaactcttcgcggtcaggtctcgacaccataaatcgaagtactcgtacgctagttttctcgcacatagtaccactacgttccttttacaattagattacttctttttagttgacttttttgagacgttcgtgccattcataaaataggaaaagataacaggtaagcactgaagacttgttttataagtgtcccaagcgagacctagagtggatattgatatttctcaaacaagactcgtcgaagaaaacacacttttatagcggaaccgctttctttatttgaattgtcttgttcaccaaggatgaaagtccaaataaccaatagtagaacagaggaaatcttaaaagttcaagctaataatgaaaacgatgaagtcagtaaagctactccgggcgaagttgaagaatcgctaaggttaatcggcgatctaaaattctttttagccacagcgccggtaaattggcaagaaaaccaaattataaggcgatactatctgaatagtggacaaggctttgtctcttgtgtattttggaacaatctatactatattacaggtactgatattgtcaaatgttgtctttacagaatgcaaaagtttgggagagaagtagttcaaaagaaaaaatttgaagagggtattttttcagatttaagaaatctcaaatgtggtatagatgcaactttagaacaaccaaagtccgaatttttgtcgtttctattcagaaatatgtgtctgaaaacccaaaaaaagcagaaagtatttttttggttcagtgtagcacatgataagttgtttgcggatgcgttggaaagagatttaaaaagagaaagtttgaatcagccttcaacgactaagcccgttaatgagcccgccttatctttttcatatgattcctcatctgataagcctctctacgatcagttacttcaacatttagattctagaagaccatctagtacaacaaaatcagataattcgcctccaaaattagaaagcgagaattttaaggataatgagttggtaacagtaactaatcagccgcttttaggcgttggcctcatggatgacgatgcgccagaatccccctctcaaattaatgattttattcctcagaaattgattatagaacccaatactctcgaattgaatggtctcacagaagaaacgcctcatgacttacccaagaataccgctaagggcagagacgaagaagattttcctctcgactattttcctgtatctgttgaataccctacggaggaaaatgcgtttgatccgttccctccacaggcttttacgccagctgccccttccatgcctatttcctatgataacgtgaatgaaagggattctatgcccgttaattctcttcttaatagatacccctatcagttatcagtggcacccactttcccagtgccaccatcatcatcgaggcaacattttatgacaaatcgggatttttattcatctaacaataacaaggaaaaattggtatctcctagcgaccctaccagctacatgaagtatgacgaaccagttatggattttgatgaatctcggccaaatgaaaactgtacaaatgcaaaatctcacaactctggccagcaaactaaacaacaccaattatattctaacaacttccagcaatcttacccaaacggaatggttccaggatactacccaaaaatgccgtataatcccatggggggggatcctctactcgatcaagccttttatggcgcggacgattttttctttccaccagaaggatgtgataacaatatgctgtatccacaaactgcaacttcatggaatgttttgccccctcaagctatgcaaccagctccaacctatgttgggagaccatacacaccgaattatagatcgacaccaggttccgcgatgttcccatacatgcaaagttcaaattccatgcagtggaacactgctgtttcaccttatagttcgagagcaccatctacaactgctaaaaactatcctcctagcacattttattctcaaaatataaatcaatacccacggcgaagaactgtgggaatgaagtcttcacaaggaaatgttccaacaggtaataaacaatctgtgggcaagtctgcaaaaatttcaaagcctctacatattaagacaagtgcttatcagaagcaatacaaaatcaacttggaaacgaaagccaggccaagtgctggtgacgaagattctgctcatcctgataagaacaaagaaatttcgatgcctactccggattccaatactttggtggtccagtcagaagaaggtggagctcattcacttgaggtagataccaatcgaaggtccgataaaaaccttccagatgcaacctgatataatataatttttgaatttatgatacaagaattaaaaatgcgggccagaatttaatattaaacaatactcagaagaaaacaacaaggacaatctgtttttataaataaaacaatcttatacaagactagagcaaacaaaaagcaagaaaaaaaggtaataaatgtaacaaatctattaacgttagaaaataacaaaaaaaaaaaaagaaaaagataatataatataatacctttatatatgtgatttatctagcgtcacagtatgtaatataaatatcaatgagtttcttaacatgacctccaaaactacatgatcgcttagtattacaatatgtgtttatccactattttgataccaacgtagtattgccttttatttttcagaatggcaaaggccatcggaaaatttttccaccagaaaaagcgagattcctaattataaggtgaaggcatcgatgttcataatagttaaaagttgtaatcaaaaaagaaaaaggtgcagagataaacaaagttaataaatgacaaaatcaagaaagcagaagcaaaaaaagcaggattttttgagaaaaaagttaaaagttggtaagccaaaggaaaaagcaaggaatgctaccgatacatctttcgtttccaagactatttctattagaaatcaacatttagaccaaaatccacatgatttaacaaaacggctaacgctcttaaagcatcataacatcaatgtgagaaaggaaacattaacaacattccaaaagtcaataccgtctataataaaatctcgacttatgacaccattacttactcaaagtataccgttgatttgcgatgaatcgcagcaagtacgtcagggacttattgatctcgtagatgaaataggtagtcacgatgcggagattttaaaattgcactgcaacatttttgtcttatacattaacatggcaatgacacatattgttacacaaattcaagcagattctactaaatttctctctcatctgttgaagtattgcggagatgaagtggttaggaaatcttgggtaaaacttttgaacggtgtctttggagtgctcggttggggacaggtagggaaaaatgatagcgctagcatagtgcaaacgaagaagcgaaacgccaaatatgtcactattcatctcaatgctctgtacactcttgttgaatacggatgtcaggatgaacgcgctagaagcgacggagacacggcagagactacagaggacagcggtacgctacgaaacccatatttaatcccagattatccgcagccgtttgagcacttgaaactatttaccagagaattgaaagttcaggatgctacctccagtggagtaaatgccacactactgtcattggcaacacaggatatcgatactcgaaaagcggtatttatcgaacaattcctgcctatagtacgtaagaaaatcgaagtaattatcaaggaaggtggtgaatgtggtaaaagtgcaaacaagcttaaaacgctgcttgcaaaaatctttgattgacgtttcataagaatacaatatataattgatagattgtacttttttttttgttaccctcaggagaggcagggcgaaaaatgcagaatcttggattttttttaagtagatctaagtttgtttatttttcaaatactattggcacaaagggaagggcttttcagggattattcagattcgagttggtggtgaaattgtgtgtgcgtacatccttatatcagagctttcctttagtgacaacatttaaatcgacgtgaccttattcgggtagtcaaacaccgaaccatattctttgcccttaggttactttcccttcattttatcagcttagtcgattaagttcgtgtctatatcccgtcaaaagttcctaatacattgcgggtacaaatgtcctataaacaaacaacatattatcctagcaggggtaatctggtaagaaacgactcatctccgtacactaatactatttcctcagaaaccaacaatagcagtacaagcgtattgagtcttcaaggcgcatctaacgtgagtttagggaccactggtaaccaattgtacatgggcgacttggatcctacatgggataagaataccgttaggcaaatttgggcatctctgggagaagcgaatattaatgtccggatgatgtggaataatacgcttaataatgggtcgagatcatcaatgggtccaaagaataatcaaggatattgctttgttgattttccctcatctactcatgcagcaaatgcacttttaaagaatggtatgcttatacccaattttccaaataaaaaattgaaattaaactgggctacatcctcatattcaaacagcaacaattctcttaacaacgtgaagagtggtaacaactgttctatatttgttggagacttagcaccaaatgttacagagtctcaattatttgaacttttcattaacagatatgcttctacttctcatgccaaaattgtgcacgaccaggttaccgggatgtctaagggctacggttttgtaaagtttaccaattctgatgaacaacagttagctctgtcagaaatgcaaggcgtatttttaaatggtagagccataaaagtaggacccacatctggtcagcagcagcatgtcagcggtaacaacgattacaaccgtagttcttcgtcactaaacaacgaaaatgtagactcgagatttctttccaagggtcaatcatttttaagcaatggaaataataacatgggctttaagagaaaccatatgtctcaattcatttatccagtccaacagcagccgtctttaaaccacttcactgatccgaataacaccactgtgtttatcggaggattgtcatcactggtgactgaagacgaattacgtgcttatttccaaccttttggcacgatagtctatgtcaaaattccggtaggcaaatgttgcgggtttgtccagtatgttgatcggctatcggctgaggctgccattgctgggatgcaagggttccccattgcaaattcaagagttagactgtcttggggcaggtctgctaagcaaacagcgttgcttcagcaagccatgttaagtaactctttacaggttcaacaacagcaaccaggtttacagcaacctaactacggatacattccatccagtacgtgtgaagcacctgttctgccagataataatgtttcatccacgatgcttcctggatgtcaaattctgaattattctaatccatacgctaatgcgaatggattaggctcgaacaatttcagtttctacagtaataataatgctacaaatacgcaagctactagtttactggctgacactagctctatggacctctcaggcacgggtggccaacaagttatcatgcaaggaagcgaagcggttgttaacagcactaatgcaatgttaaaccgtttggaacaaggcagtaatggttttatgtttgcttgagccacacgtgtatataaaaatgtttgttttccttttggccctttttctttcttggtattttctttacttcagtgttaaattgtatttggtcttaggctgacggtgatataacagcgctttattttctttttttcattgctttttatcgttttcaagattccatgtccttttattaagtcttttttgtatcgttatagttgcgtttttccttttgattttcatttctttcaaggttattgttattcttaattcaattcaagattgtacgcttttaagcatgtttatgattttcctttattacttccatttaccttctttccatcactactcattacggcctgtcaattccttttttgcgtcaccttcattttttcttctctgttcttttctgtatttgtcgaaaattttatattgatgtatcttaattttatttttagtattattatactgtaaatgtttcttactgtgtcaagatttcccgttgcgctatcttccaagactacgtaatgcgtttgtctctctattcatgttgtctctgtataggggcacggcgaattcctactccgtgtctcttctcctatatctttacaccaaatttggcccattttcattcccctttacgtagtagcggttttcggcctgccggtgctacgcgtttctatagctagtttcgttttctcacaaataaatcctagcaggaggaaaagaaagcgcaggttgaaactccgttcagaagaagaaagccactctttgaaaatactgcccacgcaattgtccctttctgacaataagaccccttactactagtaaatgtttttattctctaagcttcttttcctctaacttcgacgctagagcaggcactaccctgttgggccgtacgtaacaacaacgaccccttatttagtcgaagggatcgccagaaacagggagcaaaagatatttaagtgatgagaatcaatttcgatgatgatcacaagccaatgttctttaaactcaattcttgactaataaaaaagcagctatcaacaaattcatactttgaacaagctgataaaaataagaaaaccatcgcatacacaaaataaaatcaacatgtctactgtaaccaaatacttttacaagggtgaaaatacagatttgattgtcttcgctgcatccgaagagcttgtagacgaatatttgaaaaatccatcaattggtaagctatctgaagttgtcgaactcttcgaagttttcactcctcaggacggtaggggtgccgagggtgagttgggcgctgcctccaaggcccaagtggaaaatgagttcggtaagggcaagaagatcgaagaagttatcgatttgatattgagaaatggtaagccaaactctaccacctctagtctcaaaaccaaagggggtaacgccggaaccaaagcctacaattgagtagcttttccttctgtctggacagcctgcattgaaatatgcaataagttaaattggcgtgctgccctgtcataacgcatgcattcttcttttacagtagtagaaagaacaaaaaggtgtatatttcaatatacatatttacgatctatataacgttgtatacatttaattcagtgcatttttcattttcgcgttcgtcacacatgattatttatacaaaggaaaagtaaaatttttagcgatgagatgtaaaaagaaatgcgatgccataagctatactttacgattgaacacctaaggaagaggtaaagcaggcttaatatattgaaatactaaaaaatggctctcggtaatgagataaacatcacaaacaagctaaagaggcaagaaatttttgctgatataaaacatgaaaaaaataaagagcgccataccatgagaagaaagagagctaaggaagagagagagaatccggagctgcgggagcagagattaaaagagaacgtaacacagacgatagagaacactagagtgtacgatgagaccattaacaaggaagtggagggagatgaagacgatttgatgagatacttcaacagcaattctaatgagccaccaaagatctttctgaccacaaatgtaaacgctaagaagagcgcttatgaatttgctaacattttaatcgaaattttaccaaacgtcacatttgtgaaaagaaaatttggctacaaattgaaggaaatatctgatatttgtataaaaaggaatttcactgacatcgtgataatcaacgaggacaagaaaaaggttactggcctaacattcatacatctgccagagggcccaactttttattttaaattatcatcatttgttgaagtgaagaaaattgtcggtcatggtagaccaactagccatattccagaattgattctaaataatttccagaccagattgggtcaaacagtaggtaggttgtttcagtccattttacctcagaatcctgatattgaaggtcgacaagttatcaccctacataatcaaagagattacattttcttcagaaggcatcggtatgtcttcaaagataatgaaagggttggtttgcaagaactgggtccacaatttaccctcaagttgaaaagattgcaaaggggtattaaggaagaaactgaatgggagcataaacctgagatggacaaagaaaagaaaaagttttatttatagtgttccattcgtaaactttgtatggatataatattaagacaaccgtaagaaccgtggtcgtttgtttaactacggcggcttctggtattactgaatttctctttttttcattttaaatcaatttattacaggtaaatcaatcaaacaaatatatatatatatagtatacagaacaaacggtaatttctttttttttttttcgacgttagacgtgcttcggcagatatagtaagttggaagaaatgaagaattgtgaaagataaaggatggtttttttttttatttttttctagctagattatcttctacctcctctgaaaccaccacgagatccgccacgagatcctcctctaaatgatccgccacgagatccacctctgaaagaactgccaccacggcctcctctgaaagaactaccaccacggcctcctctgaaacctcctctgctaccaccgcgacccattgaagcaccaccacggccacctggggcaccacttctcttcttcttgttttttggttttggtgggcctaccaccttaggcttaggtaaaaatctttcaataggcaatagtttgtcagcggcaatgtagaatttatcaccttctttaaaactggttgcttggacaccgtcaccacacttgatagtgaaaaatacttcgtttaatggacccaatatttcgtcaactttaccgacttgagtcttgttttccaaatatattggcgcattgaaatatggaatcttagtgttgatagaacggcaaacaatatcaccctcacatggatgtagaaaagctcccatttctagaacagtgtctggtggtccttgttgaaatgatctagcactgcctgtacgtccaccacgaaagccgccacggaagccgccacggccacctctattacctcctctgaaactcattattttcttttggttaaaaattatcctcaggtgatcttttggtagaagagagcaatcagatactctatcgaaaaggtgctcacgttataaggctaacaaattaattttttcttcctttcctcatctcgaaaaatttttcactacaaaaaattccgacgtcaaagtttgaaaaaaagaccatctgatcacgtgacacctttttcctgctcataagttttaaaaaccgtatgacacatatgctaatgaaattaaaatatatagtatatacctgaatatgcaggaatcatatcttagtttgattcacaagtatttgaaagtacattcaaaaatgtcaatcgtatatgtccttgctagctgatgtctcgaaattacttctccttttcgaaaagcacattgtcagaatagcaatcaccgtttctggcttatggaatattattagtgtaaatgaggtcattcagtctcaaaaaggtatttttgttcagttacgttttcttttcagtttgtttttttccatctcaattttacattcgggacagtaccatgttcctttcggaggttcttttaaatttacacaatcataatgaaaccattcatatttacagttgggtccatcacatgcaaccatttctccaaacgaaactctttgacagaagcagtataaagttttgtcctcttcctcgttttcaggggaaccgttttggcctttaccatttctactgtttttgaattcttttgttcttgcaatcttcttttcaatgcttgggctcactggagtaacagacttttctcttgaagaaacgtcaatttcattttgcagtttagatgttcgactagtttttttctttttcaaagtgggtggaacggatcctgagcttgatgcagctcttctctttttcacgctactgttactcacaactgaactttctctagaggcttcagcagcgctatccatgtctccatcttcttccacgggggctagaacaccatcttcctccaataaagcgatgtttttttccaacttattcaagtgtctagcaattagaaacaaggcagtgttcgccagaacgcatttttctctttgcaaagactgacatttcaaaagtgattcttttatttctttgtcaagcccatcttcctgtggatgtttcggtattgagccttgctgtcttataaatttgtgtatttgtgattctttttgctcgtatttctttttttcttcgatgagcttcaaatcatttgaaccgatctcctctaagaggtaacgaaattctgatgggaggttggacacatcttgtatcgtttgctctaaaactaaacttggatccatcttctattggttatgttgtccaatataaacttgcatatccttcttctttgtttctatttcaactaacggtaggtgggttattcaagaatcaattaaaggaaaatcggaaaatatcacgttgtacgtaacaataaactttcttctatttacatgtttataaattggttaaacttaatctaaattaatctagcatttgctagcttattcatataattacattctatcaaccgggactagtcccaaaagcgacattgcattgtgtaacacttgtctacttgctgaatatacggcgagtcgcggtatggcaatatctgcaggttttccggaaacccatatttttttatagcacgaggagacctgatggcaaactttgaataaatatgttacaatcgtggccggctcttgagtttcgaatgctcgtctaaggacatctggatactgcgctagcaacctcacaagctcaactagttgtggttcatttaaatttgaaaaatctgcgtgtattagcatgtccgtcgtaaagtcgctggaggtcctttctaaagatctaagtctggaatgtgtgtattgtaaatagggccctgtgtcaccttcgaaagacaacattctgttccagttgaattcatagttattgatacgctttgatttcatatcttgaataatgatagcagatacgccaattaaatctgcaacacgctgtggattatctacctgagatattttcattttgttattttccataatttgcagagctttatcccttgcctcgtctagtatggtatctaagaataccacatttccttttctggtcgacatgccctgcaccataccaaaatttatatgctgcaagtcttttgcccattcaaaattcattttttttaatatcataaaaaactgggacatgtataaatcttgctgtgaggaaatcacgtacaccattttatcaaaatgtagattctttttacgctctatggctgcccctacatctcttgtcaagtacaaagttgttccgtctgatttttgtacaacaactctgcccaatcttttcgaccattgggttaaatcgatgacaagggcaccgtctatttctttaacaagattgtttttgcgaaatatatctaaggcttcattcatagattctttagacacttgtgattcaccggagaatatatcaaaattaatgttcaaacgtgaataagtttggatatagtggtggatggataacgagcgaaacctattccatatcttaatggcattctcatccccattttctaagtttttgaaaaaactacgggcctcaccgctaatcccacacttagagtttccgtttatctcttccttggcaaggtccatgttgattttaacgtagacgtcgaataaatgctgaattggctgcttttgtaacgtcttttcatcgccgtatctcttaaaaccgactgctaacaaaccaaactgtctgccccagtctcctaggtagttcatacgtgtaacggaccaccccattgcttcatataagtttgaaaggaatccacctattatagtcgatcttaaatggcctgcatggaatggtttggcaatatttggtgatgaaaattctactacaacttttttctgatgacgagattttttctgaccatatttccccttttgaagtaatatatttggtaccgttgattgtatcaaataccgctggtccaggaagaactgaagaaatggcccttttgcacaaacctttccaatacacccatgcgtgcttagttcaatggcccatcggttggcaacggccacagggtcagccacttttatctttggaagaggtagcagtagatcacctctatccatactatttgtcgactcaagcgcatttagtattagcgagtggtctattccggatatatcatgcagtgcttttgagatgtctaggcgtagtacatccaaaggataaattgggccttcgggttggtcagtatattttgtattcaaggtttttgagctgtatcttttccgtccaatattaatttctaatttacgaaattggttgctgaactgggtgtcgaacgagggcatgaagccataacgagggtaagaagaaaaggggttcttgcagagtaaactgcgattcttcagataaactatcccgaacatattgacccactttcaggtaggtcattcaaagctttttgattgacggtagatcaaagttgtgttctacgtatttacgtcttttttgtcgtatttattgatgaccttttgccatcgttaagtggagaattcggcctattcctaacctcttccagaactatgaaacaaaaaacataattcaaaattgtagtttgataaagtattatctataaactattaaatcataaatatatatttcataaagcgttaaaaattgaagatcaaatattatttttattccttgaaggaagtctatattatttaattaactgacctacttttttccgaacatcttcttgtaaaatgggttgatccatcatgcattagatcatcagcgttgtagtcagtacctctcttgtttggtggaaccaagaaggtgatttccatggcaaaacaccttcttcccataaggtgttaacttcttctaaagtcaaacctttagtttctggaacgaagaagaagacgtagaagtaagaaaagaccaaacagcccatgaaaacataaccgtagtagaaatcaatagcacctgaaataaatggagtaaagaaaccaatcaagaaaccccagatccagttacaagcttgagcaatagccatacacttggacttaactctcaatgggaaagtttcagagttaacaacaaatggaattggagcccaggtagtggcaaaacagaataagtagaaacatgtgaagacaatcatacagttaccagcacccttagaagacccgttcttcttaccatttggccacaatcttgtaacaccaacagaagcgaaaacaaccatacaagctgtcatggaagcagcaccccataataaacatctacgacgaccatatctttcgactaagaaaataccaacaaaggtggaagcaaagttgacaatacccaagacaatagaagtttcaaaagaatcttccaaaccgacagcagtgaaaacggtagtaccgtaatagaagaaatagttatcacctgtcaattgttgcaatgattgaatcatagcacccatgatcaaacgttggaaaaccttagtcttagtgctaaatatttcaccccaggaggcattaccagctaatttttcagcttcaactgtagcttgaacaacttcgacttcagccataacagctggatcgtctgcgctgaccttatttgaaagagcaatagaacgcttagcttcttcaattttaccgacttcaactaaataacgtggagattctggaacgaatgtcataccaccaatcataaacaaagcccaagcgaaacctagacctaatggaactctccattggacagaattggtgtaggtcttggtaccgtagtttgtacagtaacccaagaaaatacccaaagtaatcataagttggtaacatgaaaccaaagtacctctaatatgctttggagagacttcagaaatcaacataggagataaaacggcaataccaccgacacctaaaccagagataattctaccaatgaaatattggtaccacttgttgattgaggcaatttggataatgataccgataatgtagatgacaacaacgacaatcaaacccattttacgaccatacatatcacctaattttgctaaaataataccaccaatggcacaaccaatgttgaaaatggagacaattaaaccagttctaaccttagacaaataataagtaccatcgtggtgcttcataccaaatcttctgataaaatcagtttgagcaacaaaaccagaaatggtaccagtatcccaaccgaaaacaaaaccaccgaaagcaaccattaaacaacagatggaaactgtaacgtaggcggaggcgggcttctttggaatttcaacgtagttattagattcttcgtgattctcgtcgaaatctttcatgtcatctctttcagctttgttggatggagtagacaaagcggaattagaatcggattcaactggcgacaaagcatcagctggagtattttggactgctgtatcctcttgataggcagcttcttcagacatttttggcagattttattgtaaaagtgtttcaaaaccaaaccttgataagaggctttgaatatatcttttctttatggtttctattactcatgaagaggaattgaagtgaatgaatcgagaataatgaataaaacactgagtatttatataaaattttttctagatgacatattattcattccccagtgttgaagcttttcaccactaattgacttgaagattattttagttgcttttcttaccaccccaccttcataaacttaaaaatattatattagaatttgagttttcctccgttgtttcttaatcagaatcgttagacgccgaataatggactgtaaaatcaaagcagctggaaaaaactctggaatttttcatgaaggtggcactaaatcgtcgaagagcttcttgaccgtttttatccgaagtgtttttcctctttccccaagttttcctgcaggcgggggaatatggggccccatggaaaaaaaaccggggggggtgggaaaaaaaaaggggtcagaaaaaaaaactgctcagggaaatatcttcttctccacagaaagagacgcaggccaggaaaaatgtggaatattatataaacattgtttttccattttgtacggatttttttggaagaaagcggataaaccgaaagaaaaaacgggaaatggttccggtttgggcattgtttttcctattgggcaaaaaaaaatcccggaaccagctgactcggatatttttcttccttgtttccgctatgctgctgcaagtgactttacgaaggccaagcgtttcttggtggaaattactgcagtgtactgggtttcgttggaggcccagccttcatctgcgtcttgtttattcattctcatctgattattatatcttgatcggtgcaaaaaaattttgaggtacttaaaatttattttgcatagagatattcgcataaatggaaaacctaagcttttcaggtacgactatttggcaacatcgttgaacctggcttttcggtcctaactttgcaccatctaggatgagactatcttgactgttttacttttacgcatcgctagaaaatacgtgcgcgttgccaaatcaaaattcccgcaaattgatgcggtagcgtagttctgttccaaaatgaaagtgaaacaacataatgttccttctagttttcgtgtctgaaagctaaacctcaaagttgaaactaaagcatgattccccacctccttcctattagtcttttttcccgtaaaagttggaaaatatctggggtacttgcgtcagctgttcagatcttctcttaccgctgtcgtgtcttgtctacaatgtcaggttggcagcctaagttttggatttaataaccctagggcttttcattcttttatcaatcagaacatttacatgaagagggctggaataaaaaaaaaatattcggttctcctccatgcataatgacgtagtattcttattggcgccaaacatagtgtcataatgctttttcaacgattttaaagtaactcttagtggattggaaaggtcgccttttcgatggtagcgtgcattttctcgtcattttttttttacttgtcgtcttttctttactgcttcacctcttatcaagcaagtgtttttcgtgtctccctgtgccagtcagaaaatacatatgattggcaactgtatatccattgagatcgactcggttatctgttaatggaaattattgctagtaattataaatacctaaaaacaacatcctaacaggcttaagtaacactactagatgttgaagcagcagcgttgtcaatttctattcatttgacatttttccgaaatcataagcgggcgtttgaactatgtatagcgcctatgtggtattaacccatactatatcatataaaatttttcctcggaagagtgccagaatgaaatttcttgttccttggtgaaggtcaagaactagcaaagaaaagaacatctgtttatgaatttgacaagaattttgttttaacaccaatataatatcacctttataaaatttactgagaaattaaatactgtataagtcattaaaatatgcatattgagcttgtttagtttatttcctgctaaacaaactcttgtaaaatggttggtcatcatgcattaggtcatcagcgttgtagtcagcgcctctcttggatactggaacccaggaagctgatttccatggtagaacaccttcggcgtacatatcattaacttcttctaatgataaacctttagtttctggaacgaagaaaaagacgtaaaagtaagcgaaaaccatacagcccatgaaaacgtaaccgtagtagaagttgatggcaccagtaataaatggggtgaagaaactaatcaagaaaccccagatccagttagcagcactggcaatagacatacacttggatttgactcttaatgggaaacattctgaaataacaacgtaagcaattggggcccaggtagtagcgaaacagaaaatgtagaaacatgcgaaaacaatcatacagttaccagcaccctttgaagatggttgatcttgaccgtttggccataatctggtaacaccaacagaggcatagacaacataacagcagaccataccgacagcaccccacatcaaacagttacgacggccaaaacggtcaacggtgtacagagaacaacaagtggagaagaagttgacgacaccaaagacaatagaagtttcaaaagagtcacttaaaccgacagcctggaaaacaatggtaccgtagtagaagaaatagttatcaccagttaattgttgtagagattgaatcatgatacccatcatagtacgttgaaacatggctggtttaccagtgaataattcgccccaagatgcagtaccagcggctctcatttcttcgacactggcttcgatagtttccaactcatattgaatgtatggatggtcaggtgggcatttgttaactttagctaaagaagccctggcttcgtcgattctgccagcttcaaccaaataacgtggagattcaggaacaaacatcataccaccaatcataaataaggcccaggcgaaacacaaacctaatggaactctccattggacagagtttgagtaattcttggtaccaaaattggtacagtaacctaagaaaatacctaaagtaatcatgacttggtaacatgaaaccaaggtgcctctcatttcactgggggcgacctcagatattagcatgggagataaaactgtgataccaccgacacctaaaccagagataattctaccaatgaaatattggtaccacttgttgatcgaggctatttgaataatgataccgatagtgtagattactacaacgacaatcaaaccgattctacgaccatacatatcacctagcttggctaagacgataccaccaatggcacaaccaatgttaaaaatagagacaattaaaccagttctcaccttggacaagtaatgactaccgtcgtggtgcttcataccaaatcttcttagaaaatcagtttgagcaacaaaaccagaaatggtaccagtatcccatccaaatatgaaaccaccgaaagcaaccataacacaacagatagaaaccgttacgtagacaccttttccggtgtttggaggggcaacggcgggttgcacttgactttcacttaagttgtcgtgaaaactttcatttttaccttctggagtattcatggcctttgaacgaccagattccaattcatatgagttggatgaattggatttctgaggagatattagatcgggagttgaattcatgattttacgtatatcaactagttgacgattatgatatctttatagattttaaggtggggaaagaacatgagaccccagatggaattgattatggggacattgttgcctttatatataatttcaatatactaattcaaatgattaaaaacgtgagggggacacgcaacttcgggtgttaagaaatattttgctacattagataatggtggagtttcctggcttgtcggataaaagccatcaaatgtcgcagcagctcatgtttacgtttgctgtcttctgcccacgtcatatgagtggtattcttctatcagcacttgatgaatattctttttctcatatatctgaaagacaaaagatcggcacggcaatgccctgcagcatttcttcctagtttttccgaatttccattacgtattggatcttgtgcgcatatttgtcagtccttcacggaaaaaaaaaaagagcactgggtcacttcggaaaaacttttgactcaatgcaacagtgtcataatcctttgcgctgtctctttgaagaaaaatcaggagtgcaagatatcgattaattccttggaagttatgatggttagtcttagtttaactctcttgaagaagggttttttcagttggtcaacactctttagaggtaaaaaaaaaaaaaaaaaaaaaaaaaagagaattcttcatgtaatttaccatgattctacgtttttgcaagcaaaaatgaagataatccgagcgcatgcgaagtagtccctgccatgccgcttcggaaaaactttcgaaaccaatactccttacatccgccttgaatttaggacctacaattgttgtctcttctgcttgaaccaataagccctagaaaccttacaccctaatttgcacaagaaaactacgaaaaaattttttcctcttttttccgcagctccaatctcgccctgctatttttttggttcggagaaaaatagtcggtcgatatgaattgaagtttcattgtggccactcgtttaggaatggaataacctccgcgaatggaaaaaaagaactcggaatatcaaaaattccggctcaaaggaaaaatttgcttcaggaggggggaattatattccagatgagacctgcaaggatttctgtgtgaggttttctcggaggaataatagttttccaaaaattacttttggcaactacgtgaatataattgactacggatatccttcgagaaggccataaaaagaaccgtgacagggccaaacagaaaaataatgaagacaagtttgctttttctctcactgtatttgaggatcggaagctttttgcactgaaaatattctgggttaacaaggtttaaagaagcaaactgccacaaagtatatgagagtataaccggacggtacctatactttgaagttggaataaatacggggtagacaaaaaggatgtgtttctgtatgtctgatgagaatgatgtcatcaaagaacgtaaacaacagtaactgtctatattcttgctttttattatgcgctgttacagcaggtagcggagttttcagttctttccctagtatgtagtatgaaggataatacggtaaaagaacggggctcttgattcatcatataaatttattttcccctgttgaaacctcgagtaaccgtcctcactgttttattaccaaggatgagctcgagcagttgtaagagagaagtgggcagaaaagtataagtaacaagaaacgatatacaagttcttgttgttaggcgtagcaaccctttctcccctggtttgatcctacttaaaataaagaaaaaaaaacaaaaacgtcatgatgattttgatattattagacatacgtaatttagttgaattaaaggaataacaggcagccctattaaccacggacaaaatatctctgcatatgattgcattatttgtaaactatgaatgaacatatgaacgaaaacgattaatattaatattaaaatttgaaatggtgcaatgctgaacattgcaagtatgcgaaaatagttgatcctacactacaagagattatttttctttagtgaacatccttttataaaatggtctcggatcatttctagtagcgtctaggtcataatctgttgttctcctagatggtgggatccatttggtagacttccaaggtagcacattttcttcatacatttcgttgacttcttctaatgttaagccctttgtctctggaacaaagaagaacacataaaagtatgcgaacaccatacaacccataaagacatagccataatagaaattgattgctgaagtaataaatggagtgaaaaaactgatcaagaacccccaaatccagttacaggcacttgcaatcgacattgctttaccacgtactcttaagggatacgactcagagataaggacataggcaacgggggcccaagtggtagcgaaacagaaaatgtagaaacatgcgaaaacaatcatacagttaccagcaccctttgaagatggttgatcttgaccgtttggccataatctggtaacaccaacagaggcatagacgacatagcaacaaatcatacctacacagccccataacaaacaattacgacgaccaaaacgatcgacggtatatagcgagaaaaaagtcgaaacaaaattaacaacacccaaaacaatagcagtttcaaatgaatcttccaaaccaacagcctggaaaattgtagtaccatagtaaaagaagtaattgtcacctgtcagctgttgtaaagattgaatcatcatacccattagtgtacgtctgaacatctggggcttaccagtaaccaattccccccaagaagcagagcccgccaatctctcagcttcaatagaagactgatagttctccatttctaaagttactaaaggagagtcttcagtggttttgttagctcttgctaaggaccgcttggcctcttcaatttttcccacttctaccagataacgtggggattcaggaacgaacgtcataccaacaatcataaaaatagaccatgcaaagcataagcctaatggtaccctccattggacagagtttgagtaattcttggtaccaaaattagtacaatatcccaaaaagataccgaaagtgatcattaattggtaacatgaaaccagagtaccacgcaactgcttaggcgacacttcagaaattagcataggcgccaaaactgtaataccaccaacgcccagtcctgagatgattcttccaatgaaatattgataccatttgtcaatggaggcgatttggatgatgatcccaattgagtaaatgacgacaacagtcatcagaccaatcttacgtccatacatatcaccgagctttgacaaaactatacctccgatagcgcagccgatgttgaaaatagaaaccatcaaaccggttctgacatcggaaagataggtagtcccgtttgcacgggtgctgccaaatcgcctaatgaagtctgtttgcctgacaaaaccagatatagtaccagtatcccacccaaacacgaacccaccaaaagcaaccatcaaacagcagacggatacaaatagtaaatccgacttcgatttcttctctagttgtttgtcaacctccttctgaagctcttccagttcgtctttgggagggccttcatgggaaatgtaacttgagacgggtttagcttgtgccaaattatcgttgtaaccggcggtaccaggagcagtcgagtttcctgacttctcgttgtatgagttagaatttgtgctcacagtagcagacccttccaaggggccttgatgagcgttttcaagttccgacattctttctttacctctaatatattcttttttctagaaaaataatattttttgctggttttaacaaagctatgaagtaaaattgcaaagtgaaagcgaatcttgtttgcgtatattatatatagaaaaattattcaatcgacttttctctttcttttgatagtttcttattcttagagggagaaccgttcgactagcatgaaaagaaaagagagagactcttttatacgtgaaatcaaaaagaaaccaaacttgaggtactctactaatgattctggccctcctttcttgtttactccgtgcccctaaaactaattaacccatgcccatatattcatccacacgaccattaatattgaacataaagatatcatttcaccaagcagtacttcactcaataacaaggtgtgaaatccggtatattattccatcgctatgagtgcgggatcagaaagtgaattacttactgtcccctaatgtgcacagccacggggaatgcggatcaactgcagagaaaagggcgcacagagttagaatgcatcccttaatccgggaagtaacagtaacacgtcatgcggatgtttcttcggtgggtatgggtcacaatttcgtccaccagtacatcacagcatgctctcatttctttactttttgctagcagatgattactttcatttcgggtgggatgggccacctttttagtttatcctccgggatgccttaaacaagaaaatggaacagtggggataagacccataaaaaatccgaagtgataagtattgattggtatattcccgtatcggagaccttaacataacatagtgtagtgattttgcgtatagaaaagtaaccaataaaataaggtaaatattgctatatgaatgtaataaataaaataatatatgggcgcaacaaaaagaacgcaagaaagaagcattgatcagtgctttttactagttttcaagcttttcaccctccttaatagcttgttgccggtgttttcctttttaacaacatcttcgtgaccgcttccttgggtggcagtgaccggaacagaagttctattatcgtctacgtccttttgctccaagtgtccactatgtgttttcactagctttaaattgttgttgttcacttgtagatgtcttcttgaggggagagacttttttcttgctatgctgtttttcctacgagattcttgtgcgtggttgataacatcttgctctatggcagcggaagacgctggtgcgccatccaggaacgtcgttgagcctagacccatcgtaatgggcccatggactagttcagttttcattttggaatcgaactgggtaatattttttgaattcggtttaatcgcatccaaagtcgtagtactggaattggccttattgaataaatatgctctatcttgtagttggttcagcgtctcagaatcgtcgtctactgtttccctaccaaacacctcatctaaggtagacttcttacttgtgcggccgcctactgtattatttggaccatctgctgggaaggccagtacaggcgccactttattattcttatttctctgtggagtgcatgcatcaaaggggccgtcatgatggaaagatccgccaaataatcctgtaacatccatcttgtcaatagtgtctacatttttagggggcttaaccttggttctgcttttgctcttctgcttatctttgtccctatgtccgtgtgatgtacgacgatggtggtggtggttgtgttggtgactatttgaaccactactgcgtttcttttcttttgggtatggagcttgctgtttcggtgtccccgcagcttcttcatatgatgggagtctttcttgtctagaattggaaacgctactgttatgggccctcctagtgtcatcttcatttaaaaatgggttactgcaataattatggattatctcaatcgattttgaaaggagaaaaagagttaagttagtattctgaagtagtcatgactgttagttacactgtagtgcaattttgggagtggagctacacatacttataattcctgggcgtttcatccctgcttgatactctgtcctctgaaggagaaactctgaaggggttaatcactgtattcacgccattttgaggaccgcctatggtccttcctgtttgattcatttgcgtctgtttgatatagtattctttggaaaaaacgcttctgaaatacaaaatagtagtaattttgcaagatttaccagaagacagtcaagaaaaaataaagataaaagaggaagcaaagctacagttttatccctgtaattatgagattctctcatcctatgtagaatttcaccctttctctgcctgcgtttcacatactgccttttttttttttttggcagtattctcagcatagtcagcgtttcgctgccgagagcccttctgtggctggaaccccaccaaaacacgaacccaaaaatacttctcctgtattccccttgatcaacgcctttctacatgaggaggcgcaggtgaatgcagaaaggcacaatatagccaacacgtaaaaatcacaatcatatcagtctattcattcatttacgtatttaattatttagtaatggatatacgaaccgcatcggccacagccacaacaatatgtcgttatttccagttttctgcgtgtaagcacagggtctcctttgagcgaggctcaaaactgcacaaatttttgatggatattttcgtgagttgcggcagtcgagactttaatgaaatcgtctttttgaagtttttcttgaatttttttatgcattatcaccaagtaattgtcatatgattcgattctgttgacggtcttgtcctcgcaaagcaattgactcatcacattactgtaatattgatcaacattaggcctcaacaagactaacggcaatgatgacttgttgactacttgttgccagtttttaatgacgtttgaagccttttgattaatactagtgcccgtctcaggcaatgttccactaaataacgaaatttggctgacgggcaaggattcatccactgacagcaggtcttgcaagagcattctattggtgttctcattaaaccatagatagatagtatcaccttggaaaatcaagtagcaaccgccgttaatgaaattagagtgtgaggctcttacagatagattattaatagagctggagttgatctgtaataatttatcattagcatcgtaaaaggtcagatcagtttcctctaataatacatggaatggcacaatttgtggataaagtttgtagcaaagttgtgctgagttcaatgaatcgtacttcaataaatcataaattcgttcattaccacgggtactttgagcgtttggcttcattaattcgcttttttcaaatgctaacatgtaagcaggcaatgtctttatagaatccggcagtatcaattgcgttgatgagttactgctaaccaatcctctatattgggtcaagatttcgaccatcttgtcatcaattaatcttctgatctttacaaagtcacaatcaccgagcgtctttatgacatctttgatcattattctcatgacaggattttgatttataaacttgaaaatttcacgaatgttattagataccgcacctgacgtgttaatagaacgaacttttctgacaccatcaatatcagtatataacaatgcagtttggaaatgaacatcggttcctgtttttattttactgtcatattttagtaagacatctaaggtggtatctctagtcaatacaggaataattggatcatgatccgtattatcagatgaatcgcagtagtactgttccacagatagcccagtagaacagcgaactttcaataaagcttgataaccaacaatattggagacatttgtaaccatgtcgttaaccaaagtgaaggcatccgtctcttgttgaaagtggggataatatttcaaaataccggaagtcatctctacaggatggcccacagtggccatatcaatgaatcccgcattggtcacatataaatctaaagaaatgtaggatttcaaaaaatccgatgctaatttcttatagaacccattgtcgcatttaacatgagcaatgtgtgcattgtccctttttagcgataaattcccgttgccgatcgttggcaagctgttcaaagaacaaataatcttaccaccttgcccgccagttactgtgtctaacgctaattttgcggcttgtaaagcagaaccataacagacttggggtacgtgactatacttgtcggtggagatgtaaccactaatttttatcaatgtgtcattaatgattttcatcgagtttccgggtttaacaaataatccattataaaatggtaagaaaacatcgtccaattcacttacaatgtactcttgtgcattatctaaatctggtctcaaattaaagaaccgcaacttattatcataaacgattatagcaacctcacaatttggctggaaatctgaaatatactcaatacatgacctgacaccttccaccatggctaaagaacttccgttctcattagctaacaatgaaacatcaatcaaaaacacgtagtgtagtggtaaaagctccttctcctgaatagcattgtaaatacttggcaccaagaaatcgactgttccgtgcaataactctgatttttcgttcaaatcacttcgttgcccattgggacccatgggcgcaaaatgctcacctggaacttgcatcttaactctacaaatattacaaataacacttgaatcataagtgaactgaaatttaggattagcatacgcacgacaacgtctacaacgcaaaggcgtaccatccattggtaatggaattgtgggaacttctgcatcattcggtgtcaaagtggaaaatggttggatggttaatccaagtggtagcttcgtggcggctctcaagtgttcactttcggggatgttgtacatggataaactcatcaagtgcggatcacatgaaccttggtcaacacaataaaactgggtggtcggcaagggcggaacagaatctctacaagtttcgaaagatcgttgtaaatattgagcttgatcttcaaatctttgagttggaacaatgtgagatgtaggttgaggcgctgtcatatcaagcatagattgaccatatggcgaggaggcctcactcgcaccgaatcgctcttgactcaccattacaggcgtggacataacggaacccgaaccgttgttgaagccaccaaattgcttaggggtaaaggcttgaggttgttgaaaaccatcctgctgattcaattggggtgtagtgtagggtgaattgcccaaagtaggaacagtgcccgaggaaaagttatgatatgctctgtgaggtcttctactttttttggaagatgctccgcccgtatgcacagtagattcatcaagagagagcgctgaaacactagctgccaaaatattctgctgagacatgatggtccaatattcttctgcaaatggcctccttagtaaccctcaaaattactaatttcttcagttgcaagctccgatttggttgaatcagacctaagttgttacagcgtacgtgttttttttatttatttattttctaacatttttctctttggtttttccagtttgatcgttcccacgttgagacgaaacgaaggaaaaaaaagaacatttttttcgcattgtgcacggaaggcttcaccttcaatagggcaaacagaaggacgagctgcatcacttttagccgccactaatcaactccttcagatagatcgccagaacgcaaataagtgaaatttgaagatcaacttgaatcaaaaagccaaaactaagaattgtacgctactctgccagacaatattttacggacacgcgcatttcaagacaaagccataattcatgccttttcaactagcatctggacgccgctgagatcataggaacaaacaaaacgcacgaaaatagctaacgcacgtatcgaataccaaatcagtctgcatttattgtaccctcaaattacaaattcaaccaacaattgttcaaaagaccaccttgaatcttgtgtttcctaatttggtaagtgatcacgtggtcagacagttttccaggtcaaactgaaaaaaaagctcaagaaccatttttctttaatagccttttttagttgtattctaataaacaacaccaacaaaatcggaggtatcacacgtaattacataaagaagattaaattcagagaagatctatcacacgatatctccatagttacaaagaataccgcattttgccgatgtcactcactgagcagatcgagcaattcgccagtaggtttcgcgatgatgatgccactctacaatcgagatattccactctatcggaattgtacgacataatggaattactgaattctcctgaggattaccattttttcttacaagctgtgatacctttacttctaaaccagctaaaggaagttcctatttcatatgatgcgcattcaccggaacaaaagttgagaaactctatgcttgatattttcaacaggtgtctcatgaaccaaacctttcaaccctacgcaatggaagtgctcgagtttttactttcagtactaccaaaggaaaacgaagaaaatgggatattatgtatgaaagtgctgacgacacttttcaaatcattcaaatcaatactacaggacaaactcgactccttcatacgaataattattcagatttataaaaatacaccaaaccttataaaccagacgttttatgaagccgggaaagcagaacagggtgatttggattcaccaaaagaaccacaggcagatgaacttctcgatgaattctccaaaaatgatgaagaaaaggactttccatcgaaacaatcatccacggagccaaggtttgaaaactctacctcatcaaacgggttgaggtcatctatgttttcctttaaaatcctttctgaatgccctattacaatggtcactttatattcgtcttacaagcagttgactagcacctcgcttccggaattcactcctcttattatgaatctattgaatatacaaattaaacaacaacaggaagcgagagaacaggcggaatcacggggagaacatttcacttctatatcgacggagattatcaacagaccggcttactgtgattttatattagcccagatcaaggccacgtctttcttggcttacgtattcattagaggatacgctcctgaatttttgcaggattatgtgaattttgttcctgatttaatcataaggcttttacaagactgcccttctgaactatcatctgctaggaaggaacttttgcatgccactagacacattctatctacaaactacaaaaagctctttttacccaaattggactatctgtttgacgaacgtatacttattggtaacggttttactatgcatgaaacattaaggcccctggcttatagtactgtggcagatttcattcataatataagatctgaattacaactaagtgaaattgaaaaaacaataaagatttacactggatatctattggatgagtcattagccttaactgtacaaatcatgagtgcaaaattgctgcttaatttagttgaaagaatattaaaattgggaaaggagaacccacaagaggcccctagagcaaagaaattgttaatgataatcattgactcatatatgaatagatttaaaaccttaaacagacagtacgatacaataatgaagtactatggaagatacgaaacgcataagaaggagaaagcagaaaagctcaaaaactctatacaggataatgacaaagagagtgaggaatttatgaggaaggtactggaaccatccgatgacgaccatttgatgccacagcctaaaaaagaagatatcaatgatagtcccgatgttgaaatgacagaatctgacaaagtggtgaagaatgacgttgaaatgtttgacataaaaaactacgcacctatattattactacccacaccaacaaatgatcccatcaaggatgctttttacttatacagaactttaatgtctttcttaaaaacaataattcatgacttaaaagtctttaacccacctcctaacgaatatacggttgctaatcctaaattgtgggcttctgtttctagagttttttcatatgaggaagtcattgttttcaaggatttatttcacgaatgtattattggtttgaaattttttaaagatcataatgaaaaattatctccagaaacaacaaaaaaacattttgatatatcaatgcccagcctaccggtctcagccaccaaagatgctcgtgagttaatggactatttggcatttatgtttatgcagatggataatgccacttttaatgaaataattgaacaggaactgccatttgtctatgaaagaatgctggaggattctgggctgctacatgtcgcgcaatcctttttaacaagtgaaataacctccccaaattttgctggcatccttttaagattcttgaaagggaaattgaaagatttaggaaacgttgattttaacacttctaatgtcctaatacgacttttcaaattgtcctttatgtccgtcaatcttttccccaatatcaatgaggttgttcttcttccacacttaaacgatctaattctaaactccctgaaatactcaactacagcagaagagcctctagtatacttttatcttattagaactctttttagaagtataggtgggggcagatttgaaaacttatatagatcgattaagcccatactacaggtgctattacaatctttaaaccaaatgatacttactgcacgattgccccacgagagagaactttatgtggaattatgcatcactgtaccagttcggttaagtgtgcttgctccttatttgccatttttgatgaaaccattggtatttgcattacagcaatatcctgatctcgtttcgcagggtttaaggaccttagaattatgtattgataatttgaccgccgagtattttgatcctataatcgaaccggtaatcgatgacgtttcgaaggccttgtttaaccttctgcaacctcaaccatttaatcatgctatcagccacaacgtagtcagaatactgggcaaattaggaggtagaaatcgtcaatttttaaagccaccaacggacctcacggaaaaaacggaactagacattgatgcgatagcagatttcaaaatcaatggtatgccggaagatgtaccgctttctgtaacgccaggaatccagtccgctttgaatatattgcaaagctacaaaagtgatattcactacaggaagagtgcttacaagtatctaacctgtgtactactgttaatgacaaaatcatcagcagagtttcctacgaattacacggaactgttgaagacagcagtgaattctataaagctagagaggattggaatagaaaaaaactttgatttggaaccaactgtaaataagagagattattcgaaccaagaaaatttgtttttgaggttactggagagcgttttttacgcaacttcgataaaggaactaaaagatgacgcaatggacctactgaataaccttttggatcatttctgcctattacaagtaaacactacgttgcttaataagagaaactataatgggacatttaacatcgatctaaagaacccaaacttcatgctagatagctcattgattctagatgctattccctttgccctttcgtactacattccagaagttcgtgaggtgggtgttttggcgtacaaaagaatatacgaaaaaagttgtctgatatatggggaggaactagctttaagtcactccttcataccggaattagctaaacagtttatccatttgtgttacgacgaaacatattacaacaaaagaggcggtgtcttgggtataaaagttctcattgataatgttaagtcgtcctcagttttcctaaaaaagtatcagtataacctagccaatggtctattatttgtgctgaaggacactcagagcgaggccccatctgctataacagatagcgctgagaaattactaatagatctattaagtattacgttcgcggatgtaaaagaagaggatttgggtaacaaagtcttggagaacacactgacggacatagtatgcgaattaagtaatgcaaatcctaaggtaagaaatgcctgccagaagtccttacatacaatttcaaacctcactggaattcctatagtaaaattgatggatcattccaaacaatttcttctatcaccaatatttgcaaaacctttaagagcattacctttcactatgcaaatcggtaatgtcgatgctatcacattctgtttaagtctaccaaacacatttctaacatttaatgaagaactgtttaggttactccaagaatctattgtcttggcagatgcagaagatgaatcactatccaccaatatccaaaagacaaccgaatatagtacttccgagcaattagtacaattaagaatagcgtgcataaaattacttgcgattgctcttaaaaatgaagaatttgccacagctcaacaaggaaacatcagaattcgaattctagctgtttttttcaaaacaatgctgaaaacttcaccagaaattattaatactacatatgaagctttgaaaggttccttagcagaaaactctaaattgccgaaagaattacttcagaacggattaaaacctcttttaatgaatttatctgaccaccaaaagctgacggtccctggtctggatgctttatcgaagcttctcgagttattgattgcatactttaaagtagaaatcggaagaaagttgttagatcacctcacggcatggtgccgtgttgaagttcttgacacattatttggccaagatttagcagagcagatgccaactaaaataatagtaagcattattaatatatttcatctactgccaccacaagctgatatgtttttaaatgatttgttgctcaaagttatgcttctagagagaaaactacgtcttcaactggattctccatttcgtacaccactagcgaggtacctgaaccgtttccataaccccgtaacagagtacttcaagaaaaatatgacgttaaggcaattagtgcttttcatgtgcaatattgtgcaaagacctgaagcaaaggagctggccgaagattttgagaaagaactcgacaacttctatgacttttacatttccaatataccaaaaaaccaagtacgtgttgttagtttttttactaatatggttgatctctttaatacaatggtgatcacgaatggggacgaatggctaaagaaaaaaggcaacatgattttgaaattaaaagatatgctgaacttgacattaaaaacaataaaggaaaactcgttttacatcgaccatctacaattaaatcaaagtattgcaaaattccaagctctttacctgcgtttcactgaattatccgaaagggatcaaaatcctctgctcctagatttcattgatttttctttttcaaatggtatcaaagcctcatattccctcaagaaattcatcttccataatataatagcaagttcaaataaagaaaagcagaataacttcataaatgatgcaacacttttcgttctatctgacaaatgtttggatgctagaatatttgtacttaaaaatgtcataaattcaactttgatttatgaagtggcaacatctggatctttgaaaagctatcttgtggaggataaaaaacctaaatggttagagttactccacaataaaatttggaagaactcaaatgcaattttagcatatgacgttctagaccatcatgatttattccgttttgaactcttacaactgtcagcaattttcattaaggcagatccagaaattatagccgagataaagaaagatataataaaattctgctggaatttcataaagctcgaagatacccttatcaaacaatccgcgtacctggttacatcatatttcatatccaagtttgatttccctattaaagttgtcacccaggtttttgttgccctattacgttcttctcatgtcgaagctaggtacttagttaagcaatcgctggacgttctcacccctgttctccatgaacgtatgaacgcagctgggacgcccgatacctggattaactgggttaaaagggtaatggtagaaaattcttctagtcagaacaacattttataccaatttttgataagccaccctgatttatttttcaattcaagagatttgttcatatcaaatattattcatcatatgaataagataacgttcatgtcaaattcaaactctgatagtcatactttagctattgatttggcgtcattaattctttattgggagaacaagaccttagaaattacgaatgtaaataataccaagaccgattccgacggagatgttgtaatgtccgattctaaaagtgatattaatccagttgaggctgacacaaccgcaataattgtagacgctaataacaactcgcctatatctttacatttacgcgaggcttgtacggcgtttttgataagatacgtgtgtgcaagtaatcaccgtgccatagaaacagaactaggattaagagctatcaatattttatcagaattaatctcagataagcattggacaaacgtcaatgttaaactggtttacttcgagaagtttttgatatttcaagatctcgattccgaaaatattctttactactgcatgaatgctttggatgtgctttatgtattcttcaaaaataagacaaaagaatggataatggaaaacttacctaccattcaaaatcttctagaaaaatgtatcaaatctgatcatcacgatgtacaggaagctctgcaaaaagttttgcaggtaataatgaaggcaataaaagctcagggtgtatcagtgataattgaagaagaaagccctggtaagacatttatccaaatgttaacctccgtgataactcaggatcttcaggaaacctcatcagttacagctggtgtaactctagcttgggtactcttcatgaactttccggataacatcgtcccattattaacgcctttgatgaagacgttcagtaagttatgcaaagatcacttaagcatttcacaaccgaaggacgccatggctctggaagaggcaaggattacgacgaaacttttagagaaagttttatatatattatctttgaaagtctcactcttgggtgactcccgtcgtcctttcctctccactgtggcacttctgattgatcactccatggatcaaaattttttgaggaaaattgtcaatatgtccagaagctggatattcaatactgaaatttttccaactgttaaagaaaaagcggctatattaacgaagatgctggcgtttgagattagaggggaaccttcattgtcaaagctattctacgaaatagtcttgaaactatttgatcaagaacattttaataacacagaaattaccgttagaatggaacaacctttcctcgtaggaacgcgtgttgaagacatcggtataaggaaaagattcatgacaattttggataatagtttggaaagagatatcaaagagagactatattatgttatacgggaccaaaactgggaatttattgctgattatccatggttaaatcaagctttacaattactatatggttcttttaatagagagaaggaattatctttaaagaacatttattgtttgtctccaccatcgattttacaagagtacctcccagaaaatgctgaaatggtaaccgaagtaaacgatctggaattatcaaactttgttaaaggtcatatagcttccatgcaaggtttatgtcgaataatctcttcggatttcatcgattctttgattgaaatattttaccaagatccaaaagcaattcatagagcgtgggttacgttatttccccaggtatacaaaagtattccaaagaatgaaaaatacgggtttgttcgatctatcattacattgctttctaaaccttatcataccagacaaatttcctctaggacaaatgtgattaatatgctattggactcaataagtaaaattgaatcgttagaattaccccctcatttggtcaaatacttggcgatatcatacaacgcttggtatcaatcgattaacatcttggaatccattcaaagcaatactagcatcgacaatacaaaaattatcgaagccaacgaagatgcgctattagaactatacgtcaatctacaagaagaagacatgttttatggtctttggagacgtagagcaaaatacacagagactaacattggtttatcatatgaacaaattggcctttgggacaaagctcaacaactttatgaagtggcacaggtcaaagctcgtagtggtgccttgccctactcacagtctgagtatgcactatgggaagataactggatacagtgtgctgaaaaattacaacattgggacgtattaactgaattagcgaagcatgaagggttcacggacttattattagaatgtggttggcgtgttgctgattggaacagtgatcgtgatgcacttgagcaatcagtaaaaagcgttatggacgttccaactccacgaaggcaaatgtttaagacctttttggctcttcaaaatttcgcagaaagcagaaaaggagatcaagaagttagaaagctatgcgatgaaggaatacaattaagtctaataaagtgggtgtctctgccaattagatatacaccagctcataagtggctattacatgggtttcaacagtacatggaatttttggaagcgacacagatatatgctaacttgcatacaacaacagtacagaatctggattctaaagcccaagagattaagcgcatcttgcaagcttggagagaccgtctaccaaacacatgggatgatgtcaatatgtggaatgacctagtaacatggagacaacatgcattccaggttattaacaacgcatatctcccattaataccggcacttcaacaatcaaacagtaatagcaatattaatactcatgcatataggggatatcatgaaattgcctgggtaatcaacaggtttgcacatgttgcaaggaagcacaacatgcctgacgtgtgtatcagtcagctggcacgtatttacaccctaccgaatatagaaattcaggaggctttcctaaagttaagggagcaagctaaatgtcattaccaaaacatgaacgaattaacaacgggtctggatgttattagtaatactaatttggtttactttggtactgtccaaaaagctgaattcttcacattgaagggtatgtttttgtctaaattacgcgcatatgaagaggcaaatcaagcctttgcaacagctgttcagatagacttgaacttggctaaagcatgggcccaatggggtttcttcaatgaccgtcgtttgtcagaagagccaaacaacattagttttgctagtaatgcaataagctgttatttacaagccgccggcctgtataagaactcgaagattagggagttattgtgcaggattttatggctcatcagtatagatgatgcttcgggcatgctcacaaacgcatttgactcctttagaggcgaaatacccgtttggtactggattactttcattcctcaactattaacctctctatcacataaggaggccaatatggttcgtcatatcttaatcagaattgctaaaagttatcctcaagctcttcacttccaattaagaacgacaaaggaagatttcgccgttatccaacgacagacaatggctgttatgggggataaaccagatacaaacgatcggaatggacggcgccagccttgggaatatttacaagagttaaacaatattctaaagacagcttatccattgttggccttatccttagagtctcttgttgcccaaataaacgaccgtttcaaatctactactgacgaagatcttttcaggttgataaatgtcctattgatcgatggaacgctgaactacaatcgcttaccatttcctaggaaaaatccaaaacttcctgaaaatacagaaaaaaatttggtcaaattttctacaactttgttggcgccttatataagaccaaagttcaatgccgactttattgacaataaaccggattacgaaacttatatcaagagattacgttactggcgaaggaggttggaaaacaagcttgatagagcatcaaaaaaagaaaatctagaagtattatgtccacatttaagcaacttccatcaccaaaaattcgaggatattgaaattcctggccagtatcttttgaacaaggataataatgttcactttattaaaattgccagatttttacccacggtcgattttgttcgcggaacacattcttcatataggcgtttaatgattcggggccatgatggcagtgtacattcatttgctgttcaatatccagctgttcgccattcaagaagagaagaaaggatgtttcaattgtacagattattcaacaagtcattatccaagaatgtggaaacaagacgtcgcagtatacagttcaatctaccaatagcaatcccgctatctccacaagtccgtatcatgaatgatagtgtttcttttactacccttcatgaaattcacaatgaattttgcaagaaaaaaggatttgacccggatgatatccaagattttatggcagataaactaaacgcagcgcatgatgatgctctgcctgcgccagatatgaccatattgaaagttgaaattttcaattcaattcaaacaatgtttgtaccatcaaatgttttaaaagaccattttacctcgttgtttactcaatttgaagatttctggttattccgtaaacaatttgcgtcacaatacagttcgtttgtcttcatgtcttacatgatgatgatcaataaccgtactcctcacaaaatccatgttgacaaaacctctggtaatgtatttactttagaaatgttaccctcaagatttccatatgaaagggtgaaaccattgctaaagaatcatgacttaagtcttccaccagattctccgatatttcataataatgaaccagttccattcagactgacgcctaatattcaatctttgataggtgattctgctttagaaggtatatttgcggtaaatttatttaccatatcacgtgcattaattgaacctgataatgaactgaacacatacttggccctattcatccgtgacgagatcatatcatggtttagcaaccttcaccggccaatcattgaaaatccacagttacgtgagatggttcaaaccaacgttgacctaattattagaaaggtggcacaattgggccatttgaattcaacacctacagtcacaacccagttcatcctagactgtattggcagcgctgtcagtccaagaaacttagcaagaacagacgtgaacttcatgccatggttctagagctgatacatgggttagtttccggccttttctctgtatttaatgaaggtagagaaagcctcaaaaaatatgtactatataaaaaattaaaatgttttactttttattaaagttgcctaatcaaaatcccaaaaagttgtataattttttttcgaacttggagagaggatttgccgaaactttaacaccatctcgaatccacaccccgtatgaacccattaggtttgccatcaagatgtcagtaaaaagcctatctccaacaacagcaacctcttttggatttgttatggttttgtttctataaaaataatctaatatttcgttgtgacaacctggtttctttgtagagtgccgcaaaacaggtatacctgtcttatcttccaaaagttttgcttgcgaatagtccttatcagaattggaaccggcggtattgctaacaatcaagagtgctttgttagagtatttcgaccttaaggtttcccagtgttgcaagtaatctggccatattttgtcatcatgagggaaggcgatgcagttgtccttatccaagaccacggcctttatagaatcgtggattggtataggaagatcgttaaaagtggggacaactagactaggcttacacagtgatgggttataaagcaaccggagcgtatttaaggtgccactgatgttcatgactaggtagaggagacgatgtaatgtaactgccgcctttcagtttggccccatatatatatatatataaacagacggataattatatcatattaaatgcgatagcataaatttctcgatgcgcattggtaaattgtagcatggcgcgaagtctctcatggataattttgcaaagaatcgatgtatataacgaaccataatcaagatacttgctgggatggctttttctggatctcttgcacttttttgagcagttgtggtgacgtctgtttcacgttgtcctttttattagtaatcttctcatctacaatagttttttttgtgaaaaaaaactgaataagaatatacccaaccaaaattgtgaaaatcagctgtaataaacctctgttattctcaattaattgtgaatcaaatattgagacatactccgaaggtggctctgaaaatcgtggagtatagtcattaaacgacagacgaggcacatccaaaactctattattttgttccacttcacccactctggattttatgtcaaagatatctggaaatatttggatagggatgatcgactcgtgagccagcgtagttcctgggtttaacgaggtgtaaatgacattttgttctggcgacggaatctgcgccagtatagtcctcaaatacttgtcataatggcggaatgcttctttacgttcattagtgtcctctggtaacttagggtactctattataatcactcttttttcgctatcaataaagggctggaaatcttctgtattattacctcgtaagttcaacacctggtctacgttacaatactcctttacaaactctgcaagatcatagtataaatcttgaggcaataggtctaccttttcgaacttaatcgcggttgaactccgtcttatatatctctgtaacgaaacaaactctgtttcaaattccaagaagtccaatttcctcaggcctggttgattaataaacacataagtgtcagcattacatacacctaagaatttctcagccgcttcaataaaggtgtctcttggtaaagtcacagccctatcataatcctcttgatactttaaaataccgggagttctatccaaaagtacaaatatgtgtataacatctagttagtaagaaaaatgaaagttactaaagattaatgtttcttgttctacatacagtttgtaagagaagaatattgcaggaacattggtctggttttgcaattcctccgaagcacaaaagcttccacacataataagcaacaaatatttcaacacagtttgcatcttgccttgctactcctaattagtatgcgcctacgtttcctaactacaaaacagataggtataacctgcaacttaacctccgctgctgatattcttggccgtagttaagagaggtttacattactacagagctaacccgtgttgcatgatatcatcgatataattaaagaatgcacatatgtcagcggtactatcgcatacaatgctctatcagaactctagataacgttagaacatatcctcccaggtttcgccacatctgtggcctcgttactctattcgtttcactctttcttatctatttacagcccatcgagcaacattatcatgccacacgtcgatctcaggccgatctgacaatctttaaaggcatcaacaagagcagcagcttgccgacgtggcaaaagtcaaagaagaacagaggcaactcgtcctacgtgaagccacatacaacaagttaggaactattaggcggaaccgctttctaaggagcttactacttttaacagtactacttttaacagtacacagataaagaaacaaaaagtataaatttgggcgccatcgactggcaagcaaaacacgtatagagaacaggcagtaatgacgacgaagccacaaaatagtaagcagggtttagccgaaggagagatggatgtgagttcacttttcaagagaacggaagttattgggcgagggaaatttggtgtggtttataagggctataacgtgaagactggacgagtgtatgctatcaaagtcttaaatttagattctgattctgacgaggtggaggatgtgcagcgagaaattcagtttttggcctccttgaaacagatttccaatatcacgcggtattatgggtcgtatttgaaagacacaagcctttggatcataatggaacactgcgctggtggttcactgcgttcgttgttaaggccaggcaaaatcgatgaaaagtacattggggttattatgagagaactgcttgtagcattaaaatgcattcataaagataacgtcattcatcgagatatcaaagcagcaaacgttctgatcactaacgaaggtaatgttaaactatgcgattttggtgtcgctgcacaagtaaaccaaacttctttacgacgtcaaactatggctgggaccccctactggatggctccagaagtgatcatggaaggcgtttattacgacactaaagtagatatatggtctttaggtattacaacgtacgagattgccaccggaaatccgccatactgcgatgtggaggccctaagggcaatgcaactaatcatcaaatcgaaaccaccgaggcttgaggacagatcatacagtacatctttgaaagaatttattgcgctttgtcttgatgaggatccaaaggagagattgtcagcagacgatcttttaaaatcaaaatttatcagggcccacaaggcgacgccaacgtccattttgaaagaactaatatcacgatatctactatttagggacaagaataaaaacaaatataaaatagagggcagtataccggaaaatgagccatcaaaacccagtgaagctccaaaaccatcacaaaatggcgggggtgatgaagcacaaaagtcaatagcatcaaatgataatgaaattaagagagtgaacgaaggcgatgtggaaatgaaatgggattttgattcattgagttcgtcggattatattattgaaaataatatcaacctcgatgctttggctgaggacaacaacgagtgggctactgcccaacatgacctgttcaactatgcataccctgacgaagattcttattactttgaccctacaagtcataatactagaccctttgtttatcaagggacaacgataggaaagggctatcctggtacaatagctcaaaattctactttgaatgcaccagtaacaaataactatacgaactcaaaatacccttccaaaatggtagctggaactacaaacacctctggaacacatacggccggtccaatgacatcatctaagaggctggaaagtaaggctccaaaacaattacttgaactttttgaagacaatgaaattattactgctgaaaatgatgtcaatacagaagctcctaaaataagcaaatccatttcatctctaaatgctggtaatagttcacgagatgatttcattccctcaatatccaacgaggtcaacggaaatatcaataataataaaatgcgaccacaccttccacctttatccagtgggaacaattattatagccagagtacacctgctttgccgctactccaaacaaaatttaacaagacgtcaaagggccctccaacaagtggattaactactgctccaacgtctattgaaatagaaattcctgaagaactaccgaatagtgctctaccaacgcctgcgagcgcagatccggttttaataccaagcacaaaggccaggtcatctacagtgacggctggcactccttcgtcatctagctcaatacaatataaatcaccttcaaacgtgcccaggcggttgacagtcagtaacaataggccagaacattgcccaagcaccataacaaatcaaaaattggggtccgcagttgcttctaattccggaatcagctccactccgaacaacagtaataactataacaacaacactgatagtgagaactcaagaggaagcagcggtagtaacactgcaaatagcacacaaatgggcataaccaatccaggtaatgtaacaaagttatctactcataaggcttcttcaccctcaaggccactatttggagttggaacttctcccaatagaaagcctgccggttccccaacccaaaacattggtcataattctactcacacgaacctcgcgcctcctcctacgatgaaaccaatggccaatagcaaagataacaaggacattctcttgcaacctctgaacagcatacctagttcttctacacttaacactattagtggtaatagcagcaataatttaacctcatcaaactacttttccaacgaaaaggaaggctcaagggtcaatggtgactttaaacgcaacaacccaaacttaaaactacaaatgccactacctacacctgttgtgagaaataaacttcttgatccaaatacagcaacctcacagaataacaatggcatgccggggagcgctggcatatccacgaacgaaaatattaatcaatttggatttaacacaagcagtgcgtccaacatccctgtctcaatgactccaattagtgagaaacacattgattttgggggcaagatcaagagaagtcaaagcatttctaacaggaagaactcttctgcctcggaacacccattgaatattcttggctcatctgtttccggcaatgtttccggtatcggtaacaacaatgttggctctaacaacaacagcggccctaataacagtgttcctctttctgctaatacaggaaacactactatcaaagccaattctacgactatcgcaacttcaagttctgccgcggcatcaacgactgcaccaatttcacaacagactattccatccggaacacaattcaatcatattctgagttccgccgcaacagctgcaaactcggttaattctttaggctttggcatgtgtcctcctccacagagtttacaaatggaaatgttcttggacttagaatcgtttctgccaggaaaacagaggcgggtagacaggaaaccccaggttctgaaagaactggaaaatcttttacaaatgttcgaagaaggtttgccctgcattgaacacgctttaaaggaacaacttatttcaacgcctatcaaggataatgagcattaaaagcatcgtctagtttattcttttgtttatgtacatattcaagaaaaataagcaagatgtaagaaaagtgaaagtatatattttctacagaacttaacaagtccctttaagcaccacatggaactcgactgcgcaaggttagcgctttacggactttattgctattctagttcaaagaaagcaaatggcgcagttaccaaacctcgccatttgttttttccgttattttttcttcttataaacgcgcctagaagaaaaaaccgtgcgaagcgcaaatcctgagaaagcgctaaggaggtttcaaccaatgtttaccacttgaaattttagcattctcatcactgtaagagagataattatcctgtaaacattccaaaataccttttgtaacgctgattgttgtatttgttaccccagaattgccatatatagtggagaagaaatcgaaaaggtcatatacagcagaaccaaaaaaaataatacattcgttgatcctttaccgttttcaagagtgaaacgtgatcgtgtttatactttttcgactcaaatttgtccttatctttagttaatacggtctaacttgccacgctactcaagaaatgacctcgattcaggagcgaggcacaagcgctcatctgcattcgcttaaagaaggtgaggctagtgatcgttccagcgagatgcttcctaaacaaagaagtatcataggatcccacgtgcaacgtccaccgtctcaaacaactttaggaaggtcaagggctggaagcaatacaatgaataaagtttcaggcttagatattgctcgaagaccaagtgagaatttattatcaaacatgaactgtagcgacaacggcaatgggggaaatatgctaaattcattcgttaactcggctttaccaccgccaaaagtcaaccctgctcaaacaagacgtgaacgtcccgcttcaaatagctcaataggtaccaagactaccgaggtattttcatccacttctgcatcttcctccttgggagataccagcgatgagggagaaggcagtgatgccgacaaatctaaaataaatacttttcccagcatattgatggaaaaggctactcaaggtagaggcgctgatggaaatggaatgagaagcgcaagcaataataccattgtggaagcaactacggacggttccaaaatggcactgcaaaaaagcatgtcgtttgatgatacagccgcagagaaaactatgaataaatctagacattcttaccaagaacagttctcctcgaagaaaagccagtcatctttactgaacagcaagcaaagatcacgtgctaaatcgcaaacatgctcgtctacgggttataacaacagcagcattctgaaaacgtttggcataagctccaaaatttctaattcaagtgatcggatagaggcttcgtcattagaatttaacgttccatctcagaaacctttgaattgcaagccattaactccgtctcagaaatacagacttcgtaaagagcaatcggagatgaatttaagaaatacaatcaaaagaaaagagaaattttatgatagtcaagaacaaattcttgagttacaagagggagacgttgatgattcgttgatttggaacgttcctatggcatcattatctactaattcatttctagcgtctgctaagcccgatgatatgaataacttggctggcaagaatgacttatcagaatataccggaggtttggtaaatgataactctgaaatttcttatacaaaacaaaatcataggtactcgaacatctcttttgcgagtacaacatcaaacgcctcattattggactttaatgagatgcctacgtctccgattccaggtttgaacaaagtaactgattttcagttcattcaagacacaaccaagagtctagcctctgtttatttgcattcttccaataggctttcaagatctaagctgtccgaaagaacaaagtcttccgatttcttgccaattgaactaaaagaagctcaaaatcaaggcatggaagatttgatacttgtctcggagaacaaactagatgtggtcagccattcaagaccgagttggttaccacccaaggatcgccaggaaaaaaagcttcatgaaaggcaaattaacaaaagcatgagtgttgcttcccttgaccaactaggaaaaaataaagacagagaagaaaagttgattagagatgaaacaaataggcaaaaatatgtgttattattggacagagatataactagaaactcctccttacaaagcctaagtaaaatggtttgggacactccatttagtgacgaaactaggtcaacaatttacagcgaaattttacagagcaagactaggtttattaccaaaaactatattcaaccatttcatgagctacaggagcttttaacaaaaatgggagactttcctaaaaacaaggaaattgaaatatcgcagctaatcgaaacaagtttgaggcgaaaagtgagcggtttacatgatatatgtcctgatttgatgcttttattgaagataaaatctatctcatcacagggtatagtcaccggtgatgaactccttttccatcatttcttggtgagtgaatcatttcagaacctggggctaaacgagatttggaatattgttaatttagtacaaatgacgtgttttaatgatctttgtaaagaaaagttcgatgcaaaggttttagaacgtaagggtgtcgtagccggttatttatcgcaaaacgaggagttcaaggatgaatttaatacggagtgtataaactctaccacctggtggaacatcctagaacgtattgatcataagctttttatgtggatcatggatattatagtagtcaacaattcccagagctacaaaaatagcccaatcaacgaagatgagtttgttaacaaggattgggaatattaccgctcgaagaaagtggtaataaactacaagatcttgatttcatttgcattaaatgtattgttaaattaccactttggattcactgatttaagaagtctttgtaacgtgaatgaccagagattttgcattccagtattcatcaatgatgaattcgtagacgcagatactgtaaatgccgtgttcatcaagaaatgggcgcattactacaagaagttttgatattttttgtaactgtaatttcactcatgcacaagaaaaaaaaaactggattaaaagggagcccaaggaaaactcctcagcatatatttagaagtctcctcagcatatagttgtttgttttctttacacattcactgtttaataaaacttttataatatttcattatcggaactctagattctatacttgtttcccaattgttgctggtagtaaacgtatacgtcataaaagggaaaagccacatgcggaagaattttatggaaaaaaaaaaaacctcgaagttactacttctagggggcctatcaagtaaattactcctggtacactgaagtatataagggatatagaagcaaatagttgtcagtgcaatccttcaagacgattgggaaaatactgtaatataaatcgtaaaggaaaattggaaattttttaaagatgtcttcactggttactcttaataacggtctgaaaatgcccctagtcggcttagggtgctggaaaattgacaaaaaagtctgtgcgaatcaaatttatgaagctatcaaattaggctaccgtttattcgatggtgcttgcgactacggcaacgaaaaggaagttggtgaaggtatcaggaaagccatctccgaaggtcttgtttctagaaaggatatatttgttgtttcaaagttatggaacaattttcaccatcctgatcatgtaaaattagctttaaagaagaccttaagcgatatgggacttgattatttagacctgtattatattcacttcccaatcgccttcaaatatgttccatttgaagagaaataccctccaggattctatacgggcgcagatgacgagaagaaaggtcacatcaccgaagcacatgtaccaatcatagatacgtaccgggctctggaagaatgtgttgatgaaggcttgattaagtctattggtgtttccaactttcagggaagcttgattcaagatttattacgtggttgtagaatcaagcccgtggctttgcaaattgaacaccatccttatttgactcaagaacacctagttgagttttgtaaattacacgatatccaagtagttgcttactcctccttcggtcctcaatcattcattgagatggacttacagttggcaaaaaccacgccaactctgttcgagaatgatgtaatcaagaaggtctcacaaaaccatccaggcagtaccacttcccaagtattgcttagatgggcaactcagagaggcattgccgtcattccaaaatcttccaagaaggaaaggttacttggcaacctagaaatcgaaaaaaagttcactttaacggagcaagaattgaaggatatttctgcactaaatgccaacatcagatttaatgatccatggacctggttggatggtaaattccccacttttgcctgatccagccagtaaaatccatactcaacgacgatatgaacaaatttccctcattccgatgctgtatatgtgtataaatttttacatgctcttctgtttagacacagaacagctttaaataaaatgttggatatactttttctgcctgtggtgtcatccacgcttttaattcatctcttgtatggttgacaatttggctattttttaacagaacccaacggtaattgaaattaaaagggaaacgagtgggggcgatgagtgagtgatactaaaatagacaccaagagagcaaagcggtcccaaaatcatttgagtaaccggatatctatcgggatattaatagcagcttccatttcaactaaaacaacagcaagatatgagcgacaagatatcctttctacctcccgaacccatccaactacttgacgaagactccacggagcctgaactcgacattgactcacaacaagaaaatgagggacccatcagtgcgtcaaacagcaatgatagcactagccatagtaatgattgcggtgccacaattaccagaacaagacctagacgaagcagttctatcaatgcaaactttagttttcaaaaggctcatgtcagcgattgcaccatagtcaatggcgaccatggaacaaagtttgctgtctggagaattaccgtatttcttgaacccaacttgaaggcttttgcggccaagagggaaagctataaaatccaaacctataaacgatactccgatttcgtcagattacgagagaatttgctcacaagaatcaagacagcgaaacctgagaaacttaactgtttgcagattccacaccttcccccttcagtgcagtggtacagttcttggaaatatcaagaagtgaatctgaacaaggactggctggcaaaaagacagagagggctcgagtacttcctcaatcacatcatccttaacagcagcctcgtagaaatgaccaaagatatactcatacagtttctagagccttcaaaacgagttgcatagctcaccatccctatccaaccgactattcttctcatcgactactactatcccatttaactcgggcgcgttgttaattaatcactcgatggggaatgccttgagctgaccgcaatgaaaacttttaggggatcgtccaacattaaaggaagaacgaaacggactccacagtttctaatataaataaacaatgataaaacatatagtttcgccattcaggacgaattttgttggcatcagcaagtccgtgctgtcaaggatgattcatcacaaggttacaatcataggttctggccccgctgcccacaccgctgctatatacttggcaagagcagagatgaagcccacattatatgagggaatgatggccaacggaattgctgctggtggccaattgacaacaaccaccgatatcgaaaatttcccagggtttcctgaatcgttgagtggcagtgaactgatggagaggatgaggaaacaatctgccaagtttggcactaacataattaccgagactgtctctaaagtcgatttatcttcaaaaccattcagattatggaccgaatttaatgaggatgcagagcctgtgaccactgatgctataatcttggccacgggtgcttccgctaagagaatgcatttaccaggggaggaaacctactggcagcagggaatatctgcctgtgctgtatgtgatggtgcagtccctatctttagaaacaagccattggccgttattggtggtggtgactctgcgtgtgaggaagcggaatttcttacgaagtatgcgtcgaaagtatatatattagtaagaaaggatcattttcgtgcatctgtaataatgcagagacgaattgagaaaaatccaaacatcattgttttgttcaacacagttgcattagaagctaagggtgatggtaagttattgaatatgttgagaattaagaatactaaaagtaatgtggagaacgatttagaagtaaatggactattttacgcaataggtcacagccctgccacagatatagttaaaggacaagtagatgaagaagagacggggtatataaaaactgtgcctggatcgtctctgacttctgtgccaggtttttttgctgcaggtgacgttcaggactctaggtatagacaagcagttacttctgctggttccggatgcattgctgctttggatgcagaacggtacctaagtgcccaagagtaacgtgaaaaaaccggtttatttttgtttttactgttcgattgtgttacgtattctatgttttttgagatatatttgaaatatttttataagatacatatatatatgtgcgtattgctgcgacaaaagaagagacaaagagataggcgttgaaattgacgagacaaagaggaagacattaattaatcatcattttaaatgggatttttttacttgcaagcttttgacctgctcttctagtttttttacctttccttgaatttcttccaagtcaccgttcagtctgattctttcgttaacaatgttttgctcccattgtctaaatctttgctcctcagctttgacttggtcagtgaaatacttcttcaatgcattttcttcttctttgtatctaggattgtgtgacaatttccttgctggtgcaattgctggaagagtgaaatcttcattcccctccccggtgttctcgtgaccctcaagtcttaatcttctgtatgtttcgtaatgcatttcttgggtggtagaaatcaaatctaatagataagtcctcagtaacagggctctgagcttacggaaatcacaatgagaatcgttttcgatttccacaagtccccaaggatacttccttgcaactacctgagtgccttgcccattgtcaaattttttttcagaccctactatggcaaatggcattgcttctatcaactgtcttgcatgttcaacagcggcagaatctggattactgccacttttggcatcttccttagaatcagcgtctaatggaggcgtgaaaatacgaatttcttgagcttctattacttgcctgattctggacttgaactgttgtaattcttgggcagtcaatgtatcagctttcgcaataactggaatcagattggctctggttgacaatctcttcatagtctcaatgtcaattggctttaaaccatgtccagtgggcctgatgaagtacagaacggcatgaactctcaagtcaaatttcttagtacggtacggttgctgctcttgacgcatataagaatcgtgttgatcatcaataaaatccaccaatggttgccaggctttgttgttattcacgttatctccaaaacctggggtgtcgatgacattaacgcgtaattcgaaatgcttctcttccagcaaagctcttgtgatgtcgatttctacagtctttctgatgggttcttggcggtgttgctgaccatctgcccttttcaagacagtctgaaataaggtattaataaatgtagttttacccaatccgctctcaccacataacatcacggtgaatgtaccaccttcttcattaacaattttataacgctggttgggaagattggatatccctacaggaggaggaacaggggcagcagtcgcagtggcagcactcattatttgatacaatatgtgatgtagttcgttatcaatactcttcaggtcaagatcctatatcttgctgcacctttcaagactttgatctactcaaaacaaacaatggtgatttcgaaaaaaatttcggattcttcacttttccagcgccctgttttttttctgtaatcacgattgcaaaaaaaagagacttaccataggacaatttccataaacaaaacaaagagcaacataactcatagctgaattgctaatcgtgatactgcatcatgtcccatccgcactcacatagcatatatttgtctgagttgcccgtcaggaaacctcaagccttgggcaatcctcttttgaggaagattcaaagagcttgcagaatgtcacttgctgaaccagacttggcgttgaatcttgacattgctgactacattaatgaaaaacagggcgctgcccctagggatgctgccattgcacttgctaaactgatcaacaatagagaatcgcacgtggcaatattcgcgttatctctattagacgtgcttgtcaagaattgtggatacccattccacttgcaaatttctagaaaggaatttttgaatgaactggtcaagagatttccaggtcacccaccattacgttattctaagattcagagattgattttaactgctattgaagaatggtatcaaacaatttgtaaacactcaagctacaagaatgatatgggttatattagagacatgcaccgtttgttgaaatataagggttatgcattccccaaaatcagtgaatccgacctagcagttttgaagcctagtaatcaattgaagaccgctagtgaaattcaaaaggagcaggaaattgctcaagctgcaaaactcgaagaattgatcaggcgtggtaaacctgaagatttgagggaagctaacaaattaatgaaaatcatggcagggttcaaagaagacaatgccgttcaagctaaacaggctatttccagtgaattgaacaaattgaagcgtaaagccgatttgctgaatgaaatgctggaatcacctgactcacaaaactgggataacgaaactacacaagaacttcacagtgcattaaaggtagctcaaccaaaatttcaaaagatcattgaggaagaacaggaagacgatgcgttagtgcaggatctattgaagtttaatgatacagttaatcaactattggaaaaattcaacttattgaaaaacggtgactccaacgctgcttcgcagatacatccaagtcatgtttctgctccgttacaacaatcttctggtgctttaacgaatgaaatcaacttaatcgatttcaatgatttggacgaagcgccctctcaaggcaacaacaataccaacggcacgggtacaccagcagcagcggaaacatctgtcaatgacttattgggcgatttgaccgatttatctatttcgaacccttcaaccgctaaccaagcatcctttggtctgggaggcgatatcgtgttggggtcctctcaacccgcaccaccagttactactactaacaactcgaacaacactttagatcttttgggactttcaactcctcaatcgccaactaattcccaagcagtaaacagtagtgggttcgatcttttgatgggatttaatccaacaacaggtactactactgcgcccgcaagaaccctagtcaatcagtctcctaacttgaagattgagttcgaaatatctagggagtcaaactcagttataaggataaaatcgttctttacaaacttaagttcgtcaccgatctccaacttagtgttcttattagcagtccctaagtcaatgtctttgaaattgcaaccccaatcgagtaactttatgattggcaacgctaaagatggtatctctcaagaaggtacaattgaaaatgcgccagctaacccttcaaaggctttgaaagtcaagtggaaggtcaactattctgtcaactccacccaagctgaagaaactgctgtttttacgttacctaatgtataatcctctggcgtttcttatcaatcctttctcttctctatgtatatttttagaaggataatacctctatgtagacaatcttataaagatcttcgcaacaatacatatttcacttactaatatatgttgcgttttcatgcatcaaaagtagttagcaatgctagatcgtgtaaaggaaaaaaaagagaaatagtataattcgccatcctcataaccactgaaaaatcgaagttaaccaaaaggaaagttgaaatggaggaagtgttccgtttttactcgaactctagaaatatcttcattcataaaagcctttcattaaaaccatccaccattgatgaccccaaaagtggatatggccttttcgtagaaccttcgaagttcaagaatgatgaattgaaaagtgaaactatccaattgctccgaatccctaagcgctgcacgtttaatataaacacacttctggctctcttgggagatgaggacgaattttcttcaaaggaagaatttcaaagaactaatgacaaaattaagattgctcttcgtgaaataatggctcatccgaatttcagtgtgttcctgacagaaacaaatttactcataatttatttcatgatatttcaaactattcgtagtcgttatgagattcccgaaaatatccaatattatttagaaaatgttttaatgagcattgaagtagaaacagccatggattctattgaaaacttagctactgattatggacattatccacagatttttggccttcgagagacgctaaatttatttaaagaactgtttcacgacgtcttgaatttaagtgatatcaaacatctttattctgcaataatttcacgttgtttagagataccagaaagggccgataccaaaagtgaagaattcacggtccattctactttagtccctattgtagattttgccaaccatgaaggcacccaaaaaaatgcttattttgacatcgacccttcaaataatgacgttttacttctattggatacaaaagcggtccaaagtgaactcacaaaacctattgaagttttcattagttactcaccaacagaggatttattttccatgcttgtaacatatggattcaccccagattttagagggaattcccaattttggactgtatcctttgacaggtgctttttaagaaactatgatggaccagataaaactacaaatttaagattgttttacaaatggatgcacataaatccagtggtaccactagttaaatacgagcacaacggaaagactcgctggtttctcaatgacaccacgcctgaatttgatatgcttttgctcccattcattccatcgatagatgatggcaaaattgctcggtgggcgtacgattccacatgtcatttgatgttcacgaaaatccattgtctgataaatcccgaggccaacgaacatgcgttaatgattgcagaaaactaccgctctctcattaaagagaaagagtcaaatggtgacgatttcataaatttaccgccactagcttggtcattgcgttacaaagatacagaaaacgattgtgtacggcaaagacatatatgcagtgaagatgcggtcgctgtacttaaacaagaagaaatgcaagactcaaccaaaaccaaatcccagtttaccagtttctttcgtaaatttttagagtttcgtagatccaaaattattaggcctaccagtgattcaaaagttgcaagcatattataccagcaggaactggaaataattgctgacttagcaaaagctatcgatagcagctctaccatttttttcagcgatctgaatgttacattggacaccgaaccagaacggctcccccctctaaggtttttagatgattacatagagatctctgcggataagcaggagccaagcccaatttgtgaggatctttcttattatacacccagcaggtttactgatttttttcaagaagaggtaagccaatatgcggctttctttcaggatgactagatgagtaccacttacgatcttgtatataaatgtttttagttgtcctttcttctacattaaaagcatcacaaagaacaatctgacgcgtttttccactgtctctttctcgcgttttattcttttccgtttgagacaaaaaaagaggagctttgtagtgtaatactactagttacttaagggaacacatcaagcattcggtgtctcacaggctactatgaaatataatatagtgcatggaatttgcctattatttgctattacccaagctgtaggggctgtccatttttatgcgaagtccggggaaaccaaatgcttctatgaacacttatcccggggaaacctactgattggggatttagacctatatgtagaaaaggatggtctgtttgaagaggaccctgaatccagtctgacaataactgtcgatgaaacattcgataacgaccatcgtgtcctaaatcaaaaaaactcacacacaggtgatgttacttttacagctttagacacaggtgaacatagattttgcttcactccattctacagcaagaaatcagccacactaagagtattcatcgaactagaaattggcaatgttgaagcgcttgacagcaagaaaaaagaagatatgaattcacttaaggggagggtaggccagttgactcaaaggctatcttctattcgtaaggagcaagacgctatcagagaaaaagaggcagaattcagaaatcaaagtgaatcagctaacagcaagataatgacgtggtctgtgttccaacttctcatattgctgggcacctgtgccttccagctacgctatctcaagaatttctttgtcaaacagaaggtagtataatataccatgtttgttatatagagtttatatatcgctcattacgaatcggtgcaatgagctcttcgatatgaaatattccttagcttagtaataagagtgacttaagctgatgccgttgactgcaaaaggaagtaaatagaagtcaataacaatgaatgactaccatctcgaggataccacgtctgaacttgaagcattaagattggagaatgcacaattaagagagcagcttgccaagagagaagacagcagccgcgactacccattatctttggaagaataccaacgttacggaagacaaatgattgttgaagaaacaggtggtgtagcaggtcaagtcaagttgaaaaatacaaaagttttggtagttggtgctggaggtttgggatgtcccgccttgccctacttagcgggcgctggcgtgggccaaataggcatagtagataacgatgtggtggagacttccaatttgcataggcaggttcttcatgattctagcagagttggaatgttgaaatgtgagtcggccaggcaatatatcacgaaactgaacccacacattaacgtcgttacctatcccgttagattgaactccagtaatgcttttgacattttcaaaggttacaattatatattagactgcacagattctccattaacgagatacctggtgtctgatgttgcagttaatctgggaataacagtagtgtctgcatccggtttgggaacagagggccagctaactatattgaattttaacaatatagggccatgctacagatgcttttatccaacacctccgccaccaaatgccgtgacctcttgccaagaaggcggtgtgataggaccttgcattggactagttggaacaatgatggctgtagaaactttgaagcttatcctaggaatctacaccaatgaaaattttagtccctttttgatgttatattcaggtttcccacagcagagcctgcgcactttcaaaatgagaggcagacaagaaaagtgtctatgctgtggtaagaatcgaacgataacaaaagaagccatcgaaaaaggtgagatcaattacgaactgttttgtggcgcacgaaactataatgtatgcgagcctgatgagagaatcagtgtggacgcatttcagcgtatctacaaggatgatgaatttctagcaaaacatatatttcttgatgttaggccatcccatcattacgagatatctcatttccctgaagcagttaatattccaatcaaaaatctaagagatatgaacggtgatcttaagaaactgcaagaaaaacttcccagtgtagaaaaagacagtaatatagtgattctttgccgctacggtaacgactctcagctagctacaagattattgaaggataaatttgggttttctaatgtacgagacgtgagaggaggatacttcaaatacatagacgatattgatcaaaccattcctaaatattagttgacctatacatgtataacgtgtatatgtaactttatttttttttatccctttccctcctttcattatttcttcttgtctgtcacttatgctctataacaggaatgttttcgacacacttgagcaatttattcaggctgcatcctgcaattctttcaaggccgaagccaaatccttaatcaaatcattagcggattcacagcccacagatactcttattaaagtttggtcgatatatgggtcagtcattgctctccattccacaagggattcaattccacccagtgaggtcgcatgatggaaatatttcagcttgaggggtaattgtttacactgctctttggtgtacaaagtgatagcaaaaacgggaccatatcctcctaccagttgctttttaacgaactcttctgtttgtaaagaagagtggtaaatcgtcttcaatactttgtcaaattcagattggtgatctgacaaaaatctaactaatttcgtagcattttctgattgtttggttattctcatttcgtaggttctcagggatcgcaacaacatgaaactttccaaatttgccacgtttgtacccaagtagattctgtcgtcttttagttgtcgggaagttgcttcctctttgactacaaggacgccacttaacaagtcagaatgaccaccaaagtacttagtagcagagtataggacaatatcggctccgaaattccatgcgtattgcaatggaggagatgcgaatgtggaatccactataagcagggcgccttttgcatgagctctgcgggccaaactctcgatatcagaagaggtaccatatgggtttacaggagattccagatggacaatgtcaccttcagaagcacatttttcaatatcttccaaggggtgttgctcaatgccgtaattacgggtcaatatgttagcaattgctcgaacaccatggtagctctgtccgataaagatcttcttagggttgtaatgtaccattgccgcatagaacgcagctaaccctgaagaataaatgacagcataaccatcgaggatctctgagaagatactctctaatctggtgctatttggatgcgctagccgtgaatatacgggcttcttctccataaagtccaagttttcacgctctgtccatggaattaggtcgtcatcgtcgtaacggaaggttgtagagacattaattgggggcgccacgtcagtaaccctgttatctttatcatcgccatgaatcaaagctgttgacaagtccaccatcttacgtactcttttcgtgcaatctttcctttatagcatgtactacaacatttgaagagatggagggattgcaacgatctattgttgcgcaatatgcttatatatcgcgtgttgcataaacccatcaagtgatcgcactctgaattaaacaccgcaaaaaaatagaaaccacagtttcaccatttgacaagaactcacaagatatccttgaggtctatcagtaagtggttaatcccgtaccaaagcgtatgtgaaggacttcagaaacagttatttcacgtactacaattattacaactggccctctttcccttatatatactgtaaatattgcgactgacatggagaccacataatcacacgtgataaatagtcccgttcaacttacgtatataatgtgattcagtgttccgccaaggagtaaactcctttagtttaaggtctgcttatttttgcaacagaagcctgccttggctttcgagatactagtttctggctacggttttctattccttatcattttagccttatcatacttgctgaaaagttgcagatatctccacgctcttaaatgaaagaaaaaagggcgttttcctcctgtatgaatgaaagaaaaaattcatgttatgtgagcaagtaggtaaaaagaaagaataaaaggttcagcttttctatgttcaggatacaactgagaactatgtccagcaaaacatgcaagagtgattacccaaaggagtttgtcagtttcttaaatagctcacactctccttaccatacagttcataacatcaaaaagcatctggtgtcaaatggcttcaaagagttgagcgaacgtgactcgtgggctggccacgtcgcacaaaaaggaaagtactttgtgacaagaaatggctcttccattattgcgtttgctgttggtggaaagtgggagcctggtaatccaattgccattacgggtgctcacaccgactcccccgcattaaggattaagcctatttctaaaagagtcagtgagaagtatttacaagtgggcgtggaaacttatggtggcgctatttggcattcatggtttgataaggatttgggcgttgccggaagagttttcgtaaaggatgcgaaaactggcaaatccattgctagattggtggatttgaatagacctctgttaaagattcctactttggctattcatctggacagagacgtaaatcaaaaattcgagtttaatagagaaactcaactgttgccgattggtggtctgcaagaagacaaaactgaagcgaaaactgaaaaggaaattaataacggtgagtttacctccataaaaacgatagtacagaggcatcacgcagaacttttggggctaatagccaaagaactcgccattgatacaattgaagacattgaagacttcgaattgatcctttatgatcataatgcatccactctaggtgggttcaacgatgagtttgtcttctctggtcgattggataatttgacatcttgtttcacatcaatgcacggtttaacgttggcggctgacacagaaattgaccgagaatcaggcattagattgatggcatgctttgatcatgaggagattggctcatcctccgcccaaggggcagattctaacttcttgcctaatatattggaaaggttgtccatcctgaagggggacggttctgatcaaactaaacctttgtttcactcggcaatattggaaacttccgctaagtcgtttttcctttcatctgatgttgctcatgcagttcatccaaactatgcaaacaaatacgaaagccaacacaaacccttattgggtggtggtcccgtaatcaagattaacgcgaatcaacgttacatgaccaattcaccagggttggtcttggtgaaaagactagcagaggctgctaaagtccctttgcaattgtttgtcgtagctaacgactcaccatgcggttctaccatcggccccattttggcctcaaagacaggtattagaactctagacttgggtaatcctgtgttgagtatgcattcgattagagagaccggtggctctgcagacctggagttccaaatcaagttatttaaggaattttttgaacgctacacttccatagaatctgaaattgttgtctaaactgcaattgttagatgattcataatccggtatatttattgccctcttttgtattttacaaatagtaaatatatataatatcttgtgatctacataagctttcgcggggtcttcagaaaaataaaaagtttttaaaagaatatacgcttagcaaaggaatagacagatttagtttgtacgcaaatagtttttgaagaaggtagcagattgatcaattttgtatgagcggaaatctatccttaaacgccaactactacattacttgcaataaaaatgagtgcagatttatcgattggtaatgaaattaaagattcatttaaggaaacccataaatgggtccaaaataacttaaaatggttgaaggacattgagcaattttatcgggaaagggctaagttagaaaaagactacagcgagagattatctcgcttatcagcagagtactttaataagaagtcttcgacctcagttcctatctcggtaggtgacacacctactaccacgccagggtccattgaagctgcaggtgtggttgcatggaatgaaattctatctcagactgatatgatttccaaggatcatgatcagttatcaaccgactttgaaaatcatgtagcaaatcaattgagtggattattcactaaacttgatatgactttgagcaagataaatggatttaacaatgacatggttaataaaaaggataacatttaccacgaactggaaaaagcgaagaaggactatgatgaagcctgttccactatggaaatggcaagaaataggtataccaaggcatctaatgatagaaataaaaagaagttggatgaaaaagaaatggagatgaacaagtgtaaaaatgaatatttaatcaagatcaaccaggcaaatagaactaaggataaatactattttcaagatgttcctgaagtgctagatcttctacaagacgtaaatgaggcaaagacccttttcttaaatgatctgtggttgaaggcggcttctgtcgagaacgatctgggtgcaaatgtcagcaaaagactccaggcggcaaattctgttgtcaagcagaataaaccctctttaaacacggccatctttatcaagcacaatctaaagaattggaaagaaccacaagactttgtctataagccatctccagtatggcatgatgatgaaaaatttgctgttccctcgtcgttggaagttgaagacttgagaataaaactggcaaaagcagaaaatgattacaattcattgcaagataaaactcaaaatgagttatccaaactgtctactttgaacaagataaagcacgaaatgaaaactaatgaagataatatcaatgccactaagttttatgatacactaaaggaatacttaaatgtcgtttcaccctttacctcacacgaaacattaaaattgcaagccgaagttcaaatcgaaagtattcagaataatgttcctgaagaatacgatttatccacagacaatattgatctttccaaaacaaagaagaaatccgggatattcagtaagttcaaacacaacatcctgaacgtcgactcgaagccttcgagtggagggagcactggtaatggcaacggaggacccttgcatataacaagtctcttcaacacatcaagaagaactaggctaggctctgcccctaacaacgctggtgaagattcagataataattctatacgcaccactagtaccaacaatacaaaaaagaccacacaaaattccagtgatgacggcaagaataaagtgttgtatgcatacgtacaaaaggatgatgacgaaatcaccattacgccaggagacaaaatctctttggttgcacgcgatacgggttctggatggactaagataaataacgacaccactggggaaaccggccttgtacccaccacatatattcgcatatctagcgcggctacagttaaagcaaatgatagaggccctgcaccagaagtaccaccaccaagaaggagtacactacctgttaggacgatggaggccatatatgcctacgaagcacagggagatgatgagatttcaattgatccgggggacataattactgttatcagaggcgatgacggtagcgggtggacatatggtgaatgtgacggattgaaaggtctatttcctacaagttactgtaaatgaacgaaggaatgaactgaaactattaaatattttccctggccgccacttttttgagaggtatgacgactctatgttatatatatatatatatatatatatatatatagcacaaaatttcatgtgatcaatctactaggcgaacacctaaattgttatttatttccatgtctatatccatttcaatgtctggctcatcttcgtcctcgttttcgaattcggattcagattcggattccaaggtagtctccaaatcacagtttgtcctacagttcggacacatgaattgaggataattcataataaccaatcttcttacacaatgaaaatgccaactatgggcacatggtgatataaaaatggcttggcaaggttttattttgtttagacaaatggaacagtcttcttgttctaaaccagtagttagtttctgtagattttttattcggctcaaggcttctttattaaatgcattggcctttaatttccaagacttgttcaattctattttcatcttaacacaacgatatatctcttccgtcccgccgcgaaagtccatacccagctgtatgatatctccgtcatgtaaaaggtagtccttagaagtggtagacgcagaagatagacgctggtggttcaaaaaggtcccactggaagacttgacatctttcaaaaaccagtttccttggtcatcaactttgaaacacccatgggtcctggatatcacttttgatttgaacactacgggatgatactgatctggaattttggaaattgcctctcttactctttcggtgtatcttccgatgataatttgcgagcctgcgcccgcagtcctgataatggggtcaaagaaaagaccctggttagccacagacgtggatgaagtatctataaacggggttagcctaatgctgaaaagcccgtgcttgtccattctgcgtttcaaagtagattggtctatccgttccggtagcgaggtatttggtgggagatgtatatcaagtgaaaactccgtctgattgacttggtttggaggatatatgaaatggcggatactctttgtagtgttcaccgcgggggctgtattcgtctccacagtggcagcagcagcagcagtagcaccaacattgccgtttgcgctaccgttatttgcaacgactaaagaagtagccgtacgcgagggcaaaatacctaaaccattgctaacgctattattattgctgttattgttaggcgtatcgttaatggtgagagagatggatatcggtagtctgatgggattgttgaacttggtgtgatcgtgagaggtagcgatgccagaagcagcaggtggcgtctggtttgggggagatgagggaacagtattagtagacatccaggaataaccactatacagaacgtatgtgcacaggaaatcgacactgtaagaagaaaagctcacggcacaagagtcagaaacagggcagtgaacaaagaacgagaagtacggtttacagttgagccgtacaccgagttcctctttgaataatatcgaacctatacactaatgcactaatgtgtttctgttcacacccagaattctaaggctcctgctgatcccaatgctaaggtttatcaattttctcattctctttgtgggccgtaaacagtgatattctctcacgagagcgcttaaagagaatggagaagcccagccccaccaggcggcaaactagtagtctctccactatctccaacggtatgaccatgaccaacgataatagggataccacaaataccaacagtggctctacaagcagcaacaattcacaaccatcttcgtcttccacgccaccagcggccagtggacccgtaacggacagaaccaaagtcaactatgtaccaaagagcgacgatccgtcgtcatttcaatactacccagacgacccggagaacccggtcaataagtataaattcgcgttaaaggctgacagtcagtactatgatccttgtgaggagtcctccaagctcagttttcagtgcctcgagcgcaacgattacgaccgatccaagtgccaagaatattttgacgcataccgcgaatgcaagaaacaatggctgacagccaggaggaaaaacagacagcagtgggaatgaggcagccttttcttcttgtttgttcagctgtgatctgttttctatatagatcgccactacgcgacgtagtgttccgacaggcagccacagcacactctagtgcaatgtgaaaaactaattcgcaatggtatgtaaataagcaagctaaattggattttcaaagtgcgaataaagaattttttgtatatatctctacatacttgtatataccgaacataagaagctcttatggccgaaaactccctcctgaggtttatcaccaagaacaaagtggccatcctagcaacggtctctgcggggactgctgctgtgggtgcttatgtttactaccagcaaattaagcagcagcaacagcagcaattgaagggtacaaaagacaaccgacgtcaaagtgaggcctttgctggtcaaaatgaagacgaggcggacttaaaggacgacggcagcgtcgtaagtggaagtaataagaggaagaagaagaagaataaacgcaagaggaacaataaggcaaaatcgggagaagggtttgactatccctccttgcccaatggcgagcctgatattgcccaattgaaaggcctatcaccctcccagagacaagcgtatgccgtgcaactgaagaacagaggtaaccacttcttcactgctaagaattttaatgaggccatcaaatactaccagtatgccattgagctggacccgaatgaaccagtgttctattccaacatatctgcttgttacatttctacgggcgacttagagaaggttatagagttcactacaaaggcacttgagataaaacctgaccattctaaagccttgctgagacgtgcatctgccaacgagtcactgggcaacttcactgatgctatgtttgatctatctgttttgtcattgaatggtgactttgatggagcctccattgaacctatgctggaaagaaatttaaataagcaagcaatgaaagtactaaatgaaaacctatcgaaggatgaaggcagaggctcgcaggttttgccgtctaacacatctctggcgtcattttttgggatttttgactctcacttagaagtttctagtgtgaacaccagttcaaactacgatactgcatacgctctattgtcagatgctttgcaaagactatattctgcaacagatgaaggttacttagtagcaaacgatcttttaacaaagtccactgacatgtaccactctctactttctgcaaatacagtggacgatcctttaagagagaatgctgccttggcattgtgctacacgggtattttccatttcttaaaaaataacctgttagatgcccaagttcttttacaagaatctataaacctgcatccaacaccaaattcgtacatatttttggcattgaccttggccgataaagaaaactctcaagaatttttcaaatttttccaaaaagctgttgatctaaaccctgagtatccgccaacctattaccaccgtgggcagatgtattttattctacaagattataaaaatgccaaggaagatttccaaaaggcccaaagcttgaaccctgaaaatgtttatccctacattcaattagcctgtttgttgtacaagcaaggtaaatttaccgaatctgaagcttttttcaatgaaacaaagttgaagtttcctaccttacctgaggtgcccacctttttcgctgaaatcttgacagataggggcgattttgatactgcaattaaacaatatgatattgctaaaaggttggaagaagtgcaagaaaaaatacatgtgggtataggacccttgattgggaaagcaactatattagctagacaatcctctcaagatccaacccagttggatgaagagaaattcaacgcagccattaagctgctgacaaaagcctgtgaattagatccacgatctgaacaagcgaagatcgggttagcacaactaaaattacaaatggaaaaaattgacgaggccatagaattgtttgaagattctgcaattttagcaagaactatggatgaaaaacttcaagctactaccttcgcggaagctgcaaagatacaaaagcgtttgagggctgatccaatcataagtgcaaagatggagctaacattagctcgttatagggctaaaggcatgctttagaagatatgtcaggtattggtcaaatatatacttttagttaatactggatatgttataaaggttctgttaatgccaaatccatttcaattcttttcttccaaatattgtactggtcgtctgtgaccaaaatattggtggtttgtaacatcgatcccagtttcctaaatataatttcatcgtatctgatgccatcaaaatcatcatacctaatttgcaaatctctgaaccatttttcaccgataattaattccttcactaattttacacattcaataacatcatccacttttgacgtcaacatcaagctgcacatcttactgactataaaatggtcaattcttggatccttgcgtcttctttcattaaatacaatgaatgtacaatttaatactaacccacacactaattgccatgggcaaaccaatcttgacgcgtttatgttgtactcatccacaattttatatgctacttctcttggtaattcaaaatcgttgcaaagccgtattatttcttcagtagtcattttgcaatacttctttactaacaaagaatttggtattctgccccttttcctcagggcttttgccgtcttcaattctgattgcggttttccaactgccttattttgtttcgttctcccgcttctgctttcttgcacacctaatggctcttcctcacttgtagggtcactttcatggttttcatactcatcagaatctacatttctggttccagtaatgctcttattactatggctttttaaagacaaaccgtcgtttcctggttcctcttcatcctcatcctcatcctcttcaaatgctaactttctcctagtaatagacggcgattcattggtttgcatggggggtagttctggtattacgaacgaatcattattttggcttttcctaactttagttggtgtaccaaacagttgattcctcaactctttcggatcagaagaagtaaacctcccaccgttctttactggactgcgtttgttctttttggggctcggtgtccaagcaaattgtttcataggtgaagaattagataaactttgtctgaaaaggttcattaaatgcttggcttttttcggctccaagggaatactgtctatataatagcaaaggtcaggcatgtgtttttcattcattttctgtgacgctatgtatgcacatatgtgacatctagcaacctcttcatcttgtttcagcattaccttgttcagtgaagtattatataaaatcgatgtcgcattagtcaacttcttcaaatatccgctcgaccagtccggtttttcttgtggatctagtcgaagtacttctgcgacacaatgttggacttgttgcatggacatgactggttttaatggtattgttttggccaattttatttactgatattgtacacttttttctgcaattttagtgtgagattttttttttcaatgccgatttcttactaacgtaaacaacggcaaagaacaaagaaatacacagttttatcacaaagagttgatttttgctgaagagaagcgtgaggagtgtattcgaaagccttgcatattctggacacttgcgattctagctctttacggacgcccgcattcttttttcatactctgtttcgtgctgctttcacacaatatttttcaaaagtttcttctcatcgtttttctgttagcaaccctcaacttacgagagagttgcgactagcataggtaacattccttatttgttgaatctttataagaggtctctgcgtttagagaatgtcaaattactatagaagagcacacgcgtcttctggttcatacagacaaccccaggaacagcctcaatattcgcgttctggtcactatcagtattcaaacggccattctcaccaacaatattctagtcaatataatcaacgtcgacgttataaccataatgatggtacaaggcgacgctataatgacgatcgcccacatagttcaaacaatgcaagtacgcgacagtactatgctactaacaacagccaaagcggcccatatgtaaataagaaatctgacatcagtagtcggaggggcatgtctcaatcacggtattcaaatagcaatgttcacaatacattagcgtcttcgagtggatctcttcccacagaatctgctctgcttttgcaacaaagaccaccttcagttttgagatacaacacagataatttgaagtctaagtttcattattttgatcccataaaaggcgagttcttcaataaggataagatgctttcgtggaaggctacagataaagaattttctgaaacaggttattacgtagtcaaagagttacaagatggacagtttaagttcaaaataaaacacagacatccggagataaaagcatccgacccacgtaatgaaaacggtatcatgactagcggaaaagtggcaacccacagaaaatgcaggaactcactaattctattgcctcgcatatcttatgacaggtactccttagggcctcccccttcatgtgaaatagttgtctatccagcgcaagattcaacaacaaccaatatccaagacatatcaataaaaaactattttaaaaagtatggagaaatttctcattttgaagcatttaatgatcctaatagcgctttacctttgcatgtttatcttataaagtatgccagttctgatggaaaaattaatgatgcagcaaaagcagcctttagtgccgttagaaagcacgaatcttcgggttgctttatcatgggcttcaagttcgaagtgattttaaacaagcattccattttgaataatatcatttctaaatttgttgaaataaatgtcaaaaagctacagaagttacaagagaacctgaagaaggctaaagagaaagaagcagaaaacgaaaaagcaaaggaattacagggcaaagatattaccttgcccaaggaacctaaggtagacacattatctcattcgtccggaagtgaaaaaagaattccatatgatctcttgggggtagttaataacagacctgttttacatgtctccaaaatatttgttgccaaacataggttctgcgttgaggactttaaatacaagttaaggggatacagatgtgcgaaatttattgatcatccaactggtatctatattatttttaatgacattgcccatgcgcaaacatgttcgaatgcagagtcaggaaatttaacaataatgtctcggagcagaagaattcctattctaataaagtttcatctcattctccctaggttccaaaacagaactagattcaataaatctagctcatcttcaaattctacaaatgtacctataaaatacgagtccaaagaggagttcattgaagctacagcaaaacaaatattaaaagatttggaaaagactttacatgttgatattaagaagagattgattggtcctacggtatttgatgctttggaccatgcaaattttcctgaattgttagctaaaagagaactaaaggagaaagagaagagacaacagattgcatctaaaattgctgaagatgaattgaaacgtaaagaagaagccaaaagagattttgatttgtttggtttatatggtggctatgcaaaatctaataaaagaaatttaaaaaggcataattcactcgcgttggatcatacttctttaaagaggaaaaagctatccaatggtatcaaaccaatggcacatttactgaacgaagaaaccgattccaaagaaactaccccattgaacgatgaagggatcactcgcgtatcaaaagaacatgatgaagaagacgaaaatatgacatcttcatcttctgaagaagaggaagaagaagctccagataagaaattcaagagtgagtctgagccaaccacccccgaatctgatcaccttcatggtattaagccgttagtacccgatcaaaatgggtcgtctgacgtactggatgcttcttcgatgtataaacctactgctaccgaaattcccgaacctgtatatccacctgaggaatatgacttgaaatatagtcagactttatcttctatggatttgcagaatgctatcaaagatgaggaagatatgctaattttaaagcagttattgagcacatatactcctaccgtcacaccagaaacaagcgcagctctggaatataaaatttggcaatctcgccgaaaagttcttgaagaagagaaggcttccgattggcaaatagagcttaatggaactttatttgatagtgaactacaaccaggtagctcttttaaagctgaagggttcaggaaaattgcggataaattaaaaattaattacctaccccatcgtcgcagagttcaccaacctttaaatacggtgaatattcacaatgaaaggaatgagtacacacctgaactttgtcaaagagaagaatcctcgaataaagaaccttcagactcagttcctcaagaagtttcatcctctagagataatagggcatcaaatagaagatttcagcaggacatagaggcacagaaagccgcaattggtacggaatctgagctgctatcactaaatcaattaaataaaagaaaaaagccagttatgttcgctcgttcagcaattcacaactggggtttatatgctctagactctatcgcagcaaaggaaatgattatcgagtacgttggtgaaaggatcaggcaacctgtagcagaaatgagagagaaaagatatctgaaaaatgggattggatccagttacctttttagggttgatgaaaacacggttattgatgccaccaagaaaggtggtatagcccgtttcattaatcattgttgtgatccaaattgtacggcaaagattataaaggttggcgggagaaggagaattgttatctatgcactgcgtgatatcgcggcaagcgaagagttgacatatgattacaaatttgagagagaaaaggatgacgaggaaagacttccttgtttatgtggagcacctaattgtaaaggtttcttgaactgacgatgatacattgatttgtttggagcttcctgatttaacatatcgttgctttccagcaaaaggtaaagataaatactaaactgtatacatctataagtaatctcggccattattttaacgattagtacttttgttcgtgtcatttttttggaaaattttgcgatctctcactgttgaagaataaagatttcgcgatgacttttgcttgcagagaaatgcctgaaaacacgaacattcaataatatagatggtacataacatatgcgcaagaaaacgtaaaggccacggatgaagcatttctttaggctaccgacagcattccggcccatttctagggtttccttacgatattctagtactgataccgctcaaccaaaaatatcaaaactcaaaattagttttaataaaatttctgaatcaaatagcgaaaaaaaagataatttgggttcaattgacacacgaaattgtctttcgactcagcaagatgacaaactatcaagcactgagccctcgaaggcttcccttccaccatcattacaatatgttcgtgacttgatggatttgtataaggatcatgtggttttaacacaaatggggtcattttatgaactttactttgaacaagcaattagatacgctccagaattaaatatatcattgacgaatcgagcttatagtcatggcaaagttccatttgctgggtttcctgtacaccagttaagtcgacatttaaaaatgcttgttaacaattgcggatacagtgtaactatcgcagagcaattcaaaaaaaaggacgtggcagataatgaagccaataaattctataggagagtgactagaatcgttactcccggcacttttattgatgaagcatttgaaaatttgagggaaaatacatatctcctgaacatcgaatttcctgaaaactgtatgagtcaagtggcagacacgagtctaaaagttggtatatgttggtgtgatgtgagtactggggagatatttgttcaacaagtgtatcttagagatttggtttctgcaataacaagaattcaacctaaggagattttattagatgaaagattacttgagtttcatatcgagtcagggacgtggtatcctgaacttgttgagcttaaaaaattttttataaaatatcagaaaatgcccagtcaacatcgcactattgaatcattctatgggctgtttaatttgggaggtaaagaagcaacggaaaggcaattgaaaatccaatttcaaacttttactcagaaggagttagctgctttgaggaatacattaatatacgtaagtaatcatctacctgatttctctattaattttcagattcctcagagacaattagcaacggcgataatgcaaattgattcaagaaccagcactgcacttgaattgcattctactgtaagagacaacaataaaaaaggctctctgttatcatctataagaaggacagttacaccttcaggaacaagacttctgtctcaatggttgagtggaccttcccttgatttgaaagaaattaaaaagcgtcagaaaattgtagcatttttcaaagacaaccgtgatatcactgaaacactacggactatgttgaaaaaagtaaatgatctatcccgtatacttcaaaagtttagtttcggaaggggcgaggcattagaacttattcaaatggcacgttcactagaggtttcaagagaaataagaaaatatttactaaataacacgtcgttgatgaaagctacattaaagagtcaaatcacacagctgactgagtctttaaattttgaaaaaaatttgattgatgatattttgaagtttttaaatgaggaagagctagcaaagtcacaagatgctaaacagaatgcagatgtaactagaatgcttgacatagatgtaaaagacaagaaagaaagtaacaaagatgagatttttgaattaagagattttatcgtaaacccttcgttcaataccaaacttaggaaattgcatgacacttatcagggcgtttggcaaaaaaaaactgagtacaatgctttattaaaaggtttttttgttggcgacctaggtgctaagactttcaccttgaaggaaaggcaaaacggtgagtatgccctccatgtgacaggaacagcctctagtttaaagaaaattgatgagttaattagtaaatcgacggagtaccacggaagttgcttccatattttgcaaaaatcaagccaaacacgatggttgagtcacaaaatttggacagacttggggcacgagttggaattattaaatttaaagattaggaatgaagaggctaatattattgatctttttaaaaggaaatttattgatagaagtaacgaggtcagacaagttgcaactacactgggctatcttgataccttatcgtcctttgctgtgttagctaacgagagaaatttagtctgcccaaaagtggatgagagcaataaactagaagtagtgaatgggagacatctaatggttgaagagggtctttccgcgcgctctttggagacattcacggccaataactgcgaattggcgaaggacaatttatgggtaattaccggaccgaatatgggtggtaaatctacattcttaagacagaatgcaattatagtcattctggcgcaaattggatgttttgttccatgcagtaaggcgcgtgtgggtattgtagataagctttttagccgagttggttcagcagatgatctgtacaatgagatgagtacgttcatggttgagatgatagaaacatcgttcatcttgcaaggagctacggaacggtctttagctattctagatgagattggccgtgggactagtggtaaagaaggcattagcatcgcttatgcaactttaaagtatttgttagagaacaatcaatgcagaacgctttttgctacacattttggtcaagaactgaagcaaatcattgataacaaatgttcgaaaggaatgagcgaaaaggtcaagttttaccaaagcggaatcactgatttaggtggaaacaatttttgttacaaccataagttgaagccgggcatctgcacgaaatcagatgccattagagttgcggaattggccggatttccaatggaagcgttaaaagaagcccgcgaaatattgggataacttttgaatacaactattaattgtatataatttgacatgtaatataataagatgtggaatcaatttccctgtcttttttttcaaaagcgactgtgaagatacttagaaaatggcaaaaacggtagtttgcaaatttccgtagtttgtcgcgcgaatgatattagcggaaacaaaacgatcaaaccttataccatgaatataatggtggatatttattacggtaaggaaacactctgagccaggcttgtaaatagcggttatctaagcttgtaactaaagaaatcaatttgcatctttcgtccatgagtgtcagccttgagcaaacgctcggattcagaataaaagttacgaacgtgttggatgtagttactgaaggaagattgtattcgttcaattcatccaacaacactcttactatccaaacaacaaagaagaatcaatctccacaaaacttcaaggtgataaaatgtacattcatcaagcatttggaagtcattggtgataagccctcgtttaactcattcaaaaagcaacaaatcaaaccctcatatgtcaacgtggaaagagttgagaagcttttgaaagaaagtgtaatagcatctaaaaagaaagaactcttaaggggcaagggtgtgagtgcagagggtcagttcattttcgatcaaatcttcaagaccataggagatactaagtgggtggctaaagacatcattattcttgatgacgttaaggtgcaacctccatacaaggtcgaagatatcaaagtgctacatgagggaagtaaccaatccattacattaattcaaagaatagtggaaagaagctgggagcagctagaacaagacgatggtaggaaaggtggatagattaattaatgacggaaacgataatatacgttatatattttatccgtacttctataatgtcaactattgtttataaagagatccatttgagtctacagatttttctatttatcaaactataatattccaccactctcttctcagtcgcaatgcttgggtgtacggtgtttgaataattgaattagatttaaatgcgaataagtgatgactaacaagcaaaaaaatcgagtatttcaagatccagtcgaatataaaatcttgctactgcattattctacgatttcctgttatcacttatagtacacatgtctgagtttttgaatgaaaatcccgacattttagaggagaaccaacttcccactagaaaagaagatagtaccaaggaccttttgttaggcgggttcagcaacgaagctacgctggaaaggagaagccttttgctgaaaatagaccattctttaaagtctcaggtattgcaagatatagaggtcttagacaagcttctttccattcgaattccaccagaactgacttccgatgaggatagtttgccagcagaaagcgaggatgaatccgtagcgggtggaggaaaggaggaggaagagcctgatctcattgatgctcaagaaatatatgatttgatagctcatatttccgaccctgagcacccgttaagtctgggacaactctctgttgtaaatttggaagatattgatgttcatgattcaggaaaccagaacgaaatggctgaagtcgtgatcaaaataacaccaacaattacccattgttctctggcaacgttgattggtctggggatacgggtcaggttagaaaggtctcttcccccaagatttagaattactattttgttgaagaaaggtactcatgatagtgagaaccaggtaaataaacaactaaatgataaggaacgtgtagcagctgcatgtgagaatgaacaactgttgggtgtagtctctaagatgttagtgacttgtaagtaaacggggattcttctttttgcttcccttactcacgaagctatcaaaaaacatgtaaatttaacaatgtgctctcactgtataacacagctatagctacattttattatatagtattttctccaatcgattaaataacggtttttacaatggtttggttcctgtatcttgtttattttgttcaaatggcaaaatacagaacacaggtataactttctttgtcttcttcatcaaagagtatcgcatatcaaacctttatgtacattaacgaactctcgacctatagtagcctcctggcgttcgttcagtgttattcttacgattggtctcacttttcataaaatttcacaagcttccatatttacgcgaggaattgtgcgaaagggctggactgagcatacgtatatttgtcgagaaattacgttgtggctaagaatacaatggcatcgtagtaggaattagaagtgtagaataagaaaaacaagctaaggtataaaatgggatattttgttccggattcacatatcgaaaatctaaagtcatataagtatgtgaagcgtccattggctgcctttaaagtgcagaagtcagaagcattgttactaactttcaacaatttttattccttttcatgatagatatcaaagtgaagaccgctcgctggtatcgaagtatttcttaaagccattttggcaaagattttgtcacatatttcccacgtggatggcgcccaacatcatcacattatcaggatttgcttttatagttatcaacgtgttgactgtattctattacgatccaaaccttaacacagatacgcctcgctggacatatttttcttacgctttaggtgtattcctatatcaaacgttcgatggatgtgatggtgtacacgctcgccgtatcaatcaatcaggacccttaggagaactattcgatcatagtattgatgccattaattctactctgtctattttcatcttcgcatccgaaactggaatgggattttcgtataacttaatgttatcccaatttgcgatgctgacgaatttttacttaagtacttgggaagagtaccatacacacacattatacttaagtgagttttctggacccgtggaaggcatcctgattgtttgcgtttcattgatactgacaggtatatacggaaaacaggtaatctggcatacctacttatttacaattacagttggtgataaggtaattgatgtagacactctagatattgttttttccctagctgttttcggtttggttatgaacgcattgtctgcgaaaagaaacgtggataagtattatagaaacagcacttcttcggccaacaatatcacgcaaattgagcaagatagtgctataaaaggtcttttgcccttttttgcctattatgcaagcattgctttactagtgtggatgcaaccaagctttattacactctctttcatcctttccgttggtttcacgggagcatttaccgtcggaagaataatcgtttgccatttaactaagcagagctttcccatgttcaatgcacccatgttaattcctttgtgccagatagtattgtacaaaatatgtctatccctttggggaattgagtctaataaaatcgtctttgccctatcttggcttgggttcggtctctcactaggtgttcacattatgtttatgaatgacattatccatgaatttactgagtacctggacgtttatgctttatccatcaagcgctccaagctgacataaatcgcactttgtatctacttttttttattcgaaaacaaggcacaacaatgaatctatcgccctgtgagattttcaatctcaagtttgtgtaatagatagcgttatattatagaactataaaggtccttgaatatacatagtgtttcattcctattactgtatatgtgactttacattgttacttccgcggctatttgacgttttctgcttcaggtgcggcttggagggcaaagtgtcagaaaatcggccaggccgtatgacacaaaagagtagaaaacgagatctcaaatatctcgaggcctgtcctctatacaaccgcccagctctctgacaaagctccagaacggttgtcttttgtttcgaaaagccaaggtcccttataattgccctccattttgtgtcacctatttaagcaaaaaattgaaagtttactaacctttcattaaagagaaataacaatattataaaaagcgcttaaaatgaatgaaatggaaaacacagatccagtattacaggatgatctcgtatccaaatatgagagggaattaagcacagaacaggaagaggatacgcctgttatccttacgcagttgaatgaagatggcaccacttcgaattatttcgacaaaaggaaactaaaaattgcccctagatcaacactacagttcaaagtgggacctccatttgaattagtgagagattattgtccagtcgttgagtctcataccggaagaacactagatttacgaattattccaagaattgacagagggttcgaccatattgatgaagagtgggtaggttataaaagaaattattttaccttagtatcaacgtttgaaacggcaaattgtgatttggatacttttttaaagagcagttttgatcttctcgttgaagactcttcagtagaaagcagattaagagtgcaatatttcgctatcaaaataaaagctaagaatgacgacgacgacacggaaatcaatctcgtccagcatacagcgaaacgcgacaaaggtcctcaattttgtccttcagtatgtccgttggtgccttcccctttgccaaaacatcaaatcataagagaagcttcaaatgttcgaaatatcactaaaatgaaaaaatacgattccactttttatttgcacagagaccacgttaattatgaagaatatggagtggactctttattgttttcctatccagaagattctattcagaaagttgcccgttatgaaagagttcaatttgcttcatcaattagcgtgaagaaaccatcccaacaaaataaacactttagcttgcatgtaattttaggtgcagtggtagatccagatacctttcatggggagaatcccggaattccttatgatgaactggctttaaaaaatggatcaaaagggatgtttgtgtatttgcaagaaatgaaaacgcctcctcttattattagaggaagatcaccttctaactatgcgtcatctcagcgaataactgtgagaacaccgtcgagtgtcaattcctcacaaaacagcacaaaaagaaaaatgccatcaatggcgcagccgttaaatgaaagttgcttaaatgcaagaccttcgaaaaggcgatccaaagtggcgctaggtgcaccgaactctggggcctccatctcgcctatcaaatctcgtcaatccacaccaatggaagcttcgaaggaaaatgaggatccgttcttcaggccaaataaaagggtggagactcttgaacatatccagaacaaactgggtgctttgaaaaatcaatgtccagattcctctctgaaatatccgagttcatcttcaagaggtatggaagggtgtttagaaaaggaggatttagtttactcaagtagtttttctgttaatatgaagcaaatcgaactgaaaccggcacgctcttttgaacatgagaatattttcaaagtaggctcattagcattcaaaaaaatcaatgaattacctcatgaaaattatgatataacaatagagaagaaatcaatggaacagaattatctaagaccagagataggctcacgttctgaatgcaaaacaagctatggtaacgaactctccctttcaaatatttctttctctatactacctaactcagcagaaaattttcacttggaaactgcacttttcccagctacggaagaggatgtgccaaggacattttcaagaatattagaaacaggttcgtttcaaaattattatcaaaaaatggatgcagaaaatgcagatagggtatattcgaaaggggtcaagttgattgcaagcggtactctaccatctggtatatttaatagggaagaattgtttgaggaagatagtttctataagtattaaataaactaatgattttaaatcgttaaaaaaatatgcgaattctgtggatcgaacacaggacctccagataacttgaccgaagttttttcttcagtctggcgctctcccaactgagctaaatccgcttactatttgttatcagttcccttcatatctacatagaataggttaagtattttattagttgccagaagaactactgatagttgggaatatttggtgaataatgaagattgggtgaataatttgataattttgagattcaattgttaatcaatgttacaatattatgtatacagagtatactagaagttctcttcggagatcttgaagttcacaaaagggaatcgatatttctacataatattatcattacttcttccccatcttatatttgtcattcattattgattatgatcaatgcaataatgattggtagttgccaaacatttaatacgatcctctgtaatatttctatgaataattatcacagcaacgttcaattatcttcaattcggcttcagtactgtatgaaatactcgctaacattttctttattctataatagcacagtgacacttaaacgtcaaacgtggcgcacattaatatacgatgtatgcatttggcttgacactgctgtaataaggaacatcatcatccgtcaactagtagtcacattagtagtgtattatcacatggtgtgtaagaacattacgtaaagattgaaaaaaagtcatcaaaaataaaggaagctgaaacgcaaggactagtagtgtaatagaataatattgtgtaaaagtatcgataccctttttggaattattgtatcttcgagggtggcttttaatatatttttgaaaacctaatattataacctttcacaacaacgaaatcccaactgttgtgtaataattttactcaattcttactattgctttaccaatccttgtatttgagctctcataaagttcgctgactacttctcacgactcatgtcatctccttatactgtatatgataatatactggtggtgaatgacagcaaactctttctggaaaacttcttgtcctaaagaacaaaatcagtgtaatgtgtaggccagtgttatgttttcatgaatatgacatctgataagaataaaacaactggtaaaatgactgctttttcggcttataaaattctaacatgtacatattttttataaaatgaaaatactattgtccttaattgtacaatttttacatttggaggccaaattataaaaataatagcgctgctactccaactatataacccatgttcttggattcaaccttcataccagcaccttcatagacagagacatttgcggtactacttggggtagtagcagcggtagtctcaggtccagacgcagtggcttggatttgaccatcactgatctgtgaaatagcggcatcttgctttttgccgggttgatgatctgcaacagcgcttctattggaacgatacaatgagccattccaaccacccacatcatatacagctgcattagatatctttttctgctgagctgctaaggaccaagatgcgctgctgttgaaggcttcatcagtcgaattaaattttccttctatgtacgagttcgtactattcgcaaattgtacgtccaacgtgtctgaggagttgcttacttgtgcatgtgcaactagaatattggtgatggcaaacaatgtggaaactaaagtgcacttcatggtagattaattatgatgttcgtttgattctgttctatattttttatatgctgactgaacagattataaaaattaaattacatgaagtattgaagttaatgttggctatttttgaggaggaggttcacctttatatagtattcctcgagctacaaaaacatggatatttttacaaatgctagtaaaaaggaaagaggtcaaaagaaacgtttggcatcaaaagtaatcaaagtggggtctagatttataatttgtactacgaagaatcgcgactcaaggtaccaggtacgactgaaactttctttttggattttcgaagagagaaaaattagttagcataaaaagaaatataaaaaaaaaggaaaggaaaagtgttcgagactttaccatacaaagaaatattacggtagaaaaaagagctgcacttacccaatacatattgatgaggtagtattcacggtgagaacaacttacatcaacacctcagtttgccgaatctgcagtgatattgtatccaaagtctacttttcatcctcatttactgtcattacagaaatttgtcaggaaaagcaaccgggtaagggaactttcagggccaacgcgaaaaaaaaaaaggtccatccatagattttttagaagatacacaccgtgaattgattagagatcatagtaacctcaaaatatacaatgtcttagattggagcaggcagaaatatctatcagagcacaaaatggctagaaatagaacaacctccaagaaaaatgttcaaagtaaacgcttaatagacagagtggttcccatggacaagattaaaaaagttggcgtagcgaaaaaaaaaaccgtagaacacactaaagaaggatttagcgttgtcaacggtaagctagtaagcagcaatgacgtcggtgtactgttaagagaagcacagggtgctatcgataaaagaactaatgtttcccaaagaaataggaaaaagggaataaagaataataggccccacaaagacataaacagcagtcctgactggggcaatgcccacagaggaaccgattggcagagcgaaaaagcaaacggcatgaacagggccaagaactctcggaattttaccactaatattaaattgcagcgacaacattttggcgaagaaatacaaggtggcagccagcttgtgatatctacaaattcagatgcttcagataaattgttaatgctattcaacctaactttgggagtaaaccaagaaaacttgaaaaatgttctggaaaacatttctcaggtgcagatagctcaaattagggttagagacctgccttcaggatctgccaccgctaaggtccgtctggcatatcctacaacacagtctttggagaaggtaagaaaactgttccatggcgctctagttgatggaaggcgcatccaagtggtgattgcatctgatgaatcgtcccacttgtcgtattagagtttgtcaacgacactcacaaggtatttaatcagcaaaatccccgccacaaactatttttttgaagacatgctttctcatgactgcctaataacaatacctcattctactagtaatcgacctatgtaattatttcataaactataaagcaggtcattgcaataacagaaaggccggtttttctataagcttatctcatcgcataaaaaatcgacagttgtaattatctccggcggacttttccctttccgtcttttttttcaaaatttttttttttttcacttcttctttcaaagctgcctcaaaagagatatatatattggtaagaatcctcttccaatactagcttcatttcttcttgaaccatgaacccgttattctttttggcttctccattcttgtaccttacatatcttatatattatccaaacaaagggtctttcgttagcaaacctagaaatctgcaaaaaatgtcttcggaaccatttaagaacgtctacttgctacctcaaacaaaccaattgctgggtttgtacaccatcatcagaaataagaatacaactagacctgatttcattttctactccgatagaatcatcagattgttggttgaagaaggtttgaaccatctacctgtgcaaaagcaaattgtggaaactgacaccaacgaaaacttcgaaggtgtctcattcatgggtaaaatctgtggtgtttccattgtcagagctggtgaatcgatggagcaaggattaagagactgttgtaggtctgtgcgtatcggtaaaattttaattcaaagggacgaggagactgctttaccaaagttattctacgaaaaattaccagaggatatatctgaaaggtatgtcttcctattagacccaatgctggccaccggtggtagtgctatcatggctacagaagtcttgattaagagaggtgttaagccagagagaatttacttcttaaacctaatctgtagtaaggaagggattgaaaaataccatgccgccttcccagaggtcagaattgttactggtgccctcgacagaggtctagatgaaaacaagtatctagttccagggttgggtgactttggtgacagatactactgtgtttaaataaatcacacccgaacaccatcttgaaggttcagaacggctgaagccgcatatcaacttttggtttctactgttttaaatttcctttctcgttttaaacctttgttgccgtctcttctactatcaattttgttgttcatgcatgtttaattacctttttttgtaaaaataatataaacgtatcaatggctatttataacaaatatgcttgaaaaatctaacgactctgtttcttacattaggttcgaataaacacgggtactgtcctctagccaatctgactttttggtccaaagtctttgaaaggtagataaccccgttaaaatagaaccaccaatccatgtagtatattttctttctgaaggggctataatctttatcttggatgttcctttggttaatgcctccaaatcccatagcattcggtctccaaagcctttaagcgttgtagttccgccacttaggattatcgatgacagtaaaggtttccttaaatccagatcgactttccaaatagattgcatgcacatatcagataatccatcgtaccctaagccgatgatttgaggtgaaaataatatttctggagcacgatatcgatcattccccacctctatacacctcccgtcgggcaatttgaatgtcgagattaaatcttgagtaccttgtaagtatttctcctcttcctttttaatattcttggccaaataacaaactttctctttcatcgtgcgaacaatctctcgttcactgctggaaaacaacgaaacaccagctgatttccgtagttgaaattgtaactgctctgtgatatctgctcctccaatatccatcctcatcatagacgcaggtaatgcaaagccgtcatatatgggaacagtgctacagtatccttcaccacagtcaactacacaacctgtagttctcccactagcatataatgacagaacagcagggtttgaaacgtacaaagccgatacgtcaaaggtctcgaacaatacttgagccatctgctctctattcttcaaaggattcatcggggcttccgtaattaataaaggatgctcacctatattttgcaactgtaggacttcatttaacacatatgaccatattagttccatagaatcccaatcttccaccacgccgtgctttatggggtatcgtaattttaataatccacgcagtttttgggcattgtttccaataaatgtatctccttgcagaccttcgagcataactttatcatatttggtatttcctacgagacaatattccagtgctttaggcctttcctcaccactaaatcctgcttttatgatcccagaaccattgtcgatcactaccggttgattgtacaaagcatagctgtcacttagctggtccattggctaactttctttctaattcctcaattcgtggtatagcattagcatgtactccttggtctatgcccttttattaatttgctgttttattgggaatatctgctatttgcttcgctattattcaataaaggtgtttatcattattgatgtgcatcgcgaaaatggccactttggaaatgaactttttcttgaaaagattaatacaaacggaaaaagagaaggcaataggaaactcaccgtcacacaggtgtactgtgtcctttgctttgagctcttgttcagaacattatgctacttagcattcttttatgagcttttttctgtagtcttattataggttgatgaaagcgttaccttcaagaaatgatttttaacgtggtataataaacactgtttatcatggtaaaacaggtatttcttttattctttggaattaccagacgatacccattcaaaattcaacttctaatcaaacgttgatcaataaatactgtattatgttgcttgtttgaaattagaggcattgcctttgttaaattgaaatataaactggaaaaatgaagcgaaaataaagtactgtctataaacaaaaaccttaaaatgattaatgttaacctttctgagcaacgaagcaatccatacgtattgaaagctttagctcttggagtacggtgtcgagaaatcgaagtaagacctagtagaaaatcattagtttgtatagactagtcaatgacaaagtaatagttgaaaacaatactgtcttagttcgcaaccatttatatatatttaaacttattttttacagcccttgctaattcctgatgccaagtaacgaggggcaaatcatctgagtatatacgtacatatacatcaatgatgccaatcggaaatgctttaacatttctgaagaattctttaaaaggttactatttttactcaattcgagaaaatgcaaaatataattacccacttttatgtaaacatcggtgtcaaaatcgtgaaatataccgaatgataatgttgaaaagaaactcaagtgcaaaagaaaaaacacgatccaaagtgtatagaatgaaataaaaaagaaatagaaaaactcctcatcatgtagcatatatccgatgataatatatatacttttagtcatgatattaattctgcaaaaacaagattactgcatcacagcttatgcagtaatctgtccatcatcatcgtcatcgtcgtcgtcatcatcatcatcatcatcatcgtcgtcgtcttcgtcgtcgtcatcatcatcatcatcgtcgtcgtcgtcatcatcatcctcaccatcatcaccgtcaccgtcgtcctccccatgatcttcagcgtcctttgttgttccaacaattgcattcttatttttacaattaagttctatcaacgccgtaggtcccacgatgaagccttttaaaaaatgattcttctgcttctgtaagctctggcggttgctaaagtgaattttattacttgtttcaaaggttggtcccgaaactggaatatagataaccttacccaaacagtcgttactatctagaaatggtttgatgcacttcagagaatccctcaaataacgccttcttgaaatttccttaatagctggtttccatttaatatcatccgttccgtaaggtatattggagaagcaacttagagtagaagatgctcgccttcgatttcttattcgttcttcaattaaacatgaataatcactttcactgccataagcataaccaatattactgtcatcagtatcatcattagtatcatcgccagcatattcatcggtttcaccgtcattttcgtcctcatcggtctcagtagcgctttcatcgtcattgatttcagcgtcacggtttgtgagacataacgacctactgctttgggataaatctgtggcggattccccattaggagctaatcctgataggtatatcgaagagctttgaggtttaggtctaatagatgcctcatccctttcattggctaccaaattcgacgcaacactccgtaattcctctttcataaccgcattttgtgattgcagcataatctcgcagccatcaacggaaagatgctcaataggagagggtgaatgaactgattcacccactgtgctatttggaaatttgatggggacaacctcctcgctaattgcacgcctcaatgactgtctttggggcatggaaatagctctatttctgtgcattggacgctctactttaatggtggtatttactggaacaccaggctctggatgatctcccccgcttgattcatggtgttcatcatcttcttccgtttcaataacactatttaagttacttgagttggacctgagtctgtgaagcttttctgtgcgtgaagaatttttaggcctgaaaaagttcttaattttaaattttaaacttctagatgcaatcgaacgggaagctgagcaaccagataatgaccttgttgatcccagggtactgttatcactggattctcctgatgcagccgaagatatcaatgcctctgtaggcgtctttgagaggccagtgcagtaatgatctagtagaccagctgtgaaagtattcgagcgttccctgatagttgtattgttattagtgctagacccggtactatatctttggattaagtccggtctggaattcgaacgaatgaatctctgcgaaaaagaccccatcgaactctcacttctatgagtgtgtcttcttctcctccttctcctccttctccttctccttcttctgggaacaattcgataatctggatactccctgacttccaagtccaaagacacagatatcccgattgataggtacatagaccagtcaatcatatcatctatatgagagaaccgtaataaaaactgttcgctttcacaagacattcttaacacaaaactcttcttggtataatccgttggtatcccaaatcttgcattttgtaaagtgaaagacttgtaaagagcttcatcggttaaataccgcgatcgatcacgtttcactctataagagatccgttcttgatctgcttttttaaactccgaagctgatctcgtcggtagagtgaagagacggtgatgcagatgttgtgattgatcactgcgatggaccaagtcactatgaattctatcctctttttcagattttgtttccccgcttgaataattcctaatgtgtttcgtcaaagattcgtcaatatggtaaaaatttagttgagtcgaattaatttcaatgatgaaattcctccagctcctgttactagaaatttcataaggtgaaagcctttccaattttaaggatatcaacgtcaattcatatactgcaggtgcatacaaaggagggagagaagactttgggcatggtgccgtgtcaccaaatataggaaagcggacctctttattgggatttactagatcatagctcggtggataagcagggaggggatctatatgctcgtaaagatcttgcttgatgaagagagcagcgtgagaagaggacgaagctgcagtttccttgataatatttatctgaccagaaacaccttcccgaggaagttgacgcatggtctctaaacatatagagctgctgttattgcttgaagtaatgagaacctcgtccattgagcatgttgatgaagacgagggtgattttaacctttcgatcctattatttgccatggataatttgccctctattggcagagcatccttaacaaacgaacaacttgtatgcacgatgtcggatcaaaaatatactgtggccccaagaaacaacgatttcttttgtgctggtcaacaaaattgtaatcttttcggtggaccctattatgaaacttttctcttttttttttttcttactgtaagacagttagatgcacccacctcactgaagcttgatgattacgactaaattaaaaacgcggatatacaactaaggacttacaatgttgatctcctgagtattgttaatgtccaaaatgaccgaacaacagcggataacgatatatatccttcttgcaattataaagaatcgtaagataactccgtcaacgatgatgtggaaattatgaccctcttggaggcttaatcactaaaaaggagatgaagccttcaagtcacatcaaaataatcgaagccaacaccaaagaattttacagattggttctgctcatgttagggggtgtatgagcagataatccaagttaaaataattttttggagaatatagaagaaaatatataaggttttgctttttctagattttatataggatagggtattactaacttgtaatataatgtataccgtggtatccattatatctctgggtctagtaggaagtcacaaaagtactttaaagcagcataagtttcctttccaactggcttgatgttttctggaggcaataaaaatccatggttccctgtatcccgtaatttcaactggaatgcccaatgtgctctgtggtggtacatgaagtccaacgcagaacctgcaccgaggccggggaatatgtcggaaccacggtccttacatgcggagattacgtcgtagtttctacctgattttgaacggatggccttggataagccatatgataactccaacaaattttctaagtctctgggcaaggcatcacacgagtatgcgtagggatataaaatctcctgtgaatacgaatgcatgtcaatgtagccataaattttgtaatcgcccttggtttcattaatatacttgtaccaagcagatgcttcccaagcttcgaagggcgtttccccactatactcttcgctgcaagcgtgggtgtgtgccttttcccactggaaaccaaaggaatgatcaatgtcgataccaagacattgaggaacatgagtcctttgacgattcttacgccatagtctgtcatgcgaccacgtatatgcgtatccgtctggattgaacacaggtatgactaaaaagtccaaatcgtccaggtatttggtttccttcttagacgaaccatatcgatttaacaactgataaagtgcccaacagacggtactgacactgatccactctctggcatgtataccacctgtgataacaatagtcttcttttccgggtttgattctggcttgtttccggatatatgcagagcttttagctctctgccttcaaatgtcctgcccaagtgttccactgcaaccaaactgggaaagcttctttctagaagatccaaccacatataaatagtatccaggtccctgtattcgttaaagaagaaatcgtaatcattttcaaaaacagcctgctcacgtgccatcatctgacttgtaggcaatgtattttgtatcaattcattcatgttatctatgatcacctgcccatcatttatctgctcacctatttctttaggcaacttaatatcaatgaaattattgcttctcgtccatacatcataatcatctgtcagcggtgcgatcacatctcttaccagggtagaatagttgtctgaagtaaacctgtaaacagcgtattcactgtaatcctcttggagaccctgcacagcacctgtcacggctagtaaaacgaaaagaaaacaaccccacaacgaattcatgtgcaacatgatataacttaacactctggtttgtttatatagtgttaacttggtcttttaaaccgtcgaaaatattttatccttccttccatttagttggaccattttctagttcttcgtaaaatccgcagtcagcgcaggagaaaatagaacgagacaaatgatcttttaaattacaggttatcgcgggagaatatttggggttcagaaatacaacacatataaacaaaaatacgtaccaaagaagtgttataaaagtgatataactatgtcagaggatctttcacctacaagcagcagggtggatttgagcaatcctcatgggtttaccaaagagggagtggatttatcgaagctgtcaccacaagaactaaaattgtataaaatgtatgggaagcttccatccaaaaaagatctgttaagacataagatgcaggatcgtcaatattttgacagcggagattatgcattgaaaaaggccggagtcattaagtcggatgacgttatcgtgaataattctagtaataatctaccagtgaccaatctagcggtttaagagagtctattattagaagacgtatgagtagtagtagtggtggcgattctatctcgagacaaggaagtatctcaagtggacctccaccaagatctccaaataaatgactaatgaaggaatgatattatgtggtattactttttttttatcatcactagcttcggctaagcccttgcattttcaatattcaattaccaaataatatatatatatatatatatatatgtatgtatggtataccttgtgttactgatgtgttttttgttgacgtcatccttttgatttactcacatgcttagtaaatgaaggttgttgaggcctaaaaatcagctaagatttacacatcgatactaatcattgaacgcccctatgggaacacttaattgaataaatatctgcccaacttgctgaacatcaaaaacccaaaaaaatagaaatctataaaatacaacgccagtgacaactgcgagaaacattgtgagcaagtgaacgcactaagggcaccaattactagacctgggaaaaaaacggttaaagtgccatcaaagaacaaccacagaacaatgtttaataagctccatgcaccagctgcctgcaaagaggaggaccattcaagtttcctaataccaaatattaagcccaaaagagtattggcacatcttataaatgatcctagggtgtttttgtaaactgatgacctggtttttggctggtgttgataacgaacgaaagagtcaatgaatggtactatggaaccaaagataacaccttcagtaccaaatacagcccaatcaggcaccatgtcaggttccgcgacgatcttgttcttaatttctataccatgctttaaaaaggatacgatatctccctttgccaattggtcattatcaaacaaacattctgatatcatggggaagagtattcctgctatgaatagaataaaaaatgcagcaatagtattgattattttcgcatacaatgacctttcgtgtctcgcagtcgcggatggcggaaccatttccaattgagaggcgttagacaataaagccttgtcataaacattaccttcattcttggtaatatcgtcatcataaaatgaaaacaaagcgggcttagtcagcgtatttatagctgtaaaacttgcgcttcccagcttatttcccaaaggtggcaaagctgcctctttcttggtattatggacaccattaggaacacctccagtgtttaattggttcttactcttcttcttgcccattagtaacctcctctgtttaaattttttttttctcacttgctctgaataccaaaaggtgagtttggtgaagaaattttgacactttttcttttgcgctgtattttgtaacaacgcatattttgaagatattctaaataagagagattgattaatgaagacagaaggaataaaaagcccatcggcaaaataccatgatatggcgggctcccagagaatccctcacaagaacccgcacattcaaaaagtggctgttttgcaaagtaagcccaataaggaagatgcgctaaatttaataaaggaaatcgcacataaagtttcctatctaatgaaggaaaatcacttcaaagtgaccaacttggtggagttttacccacgtgatcaaagactcctgggaatgaacgtcaaccatggatctaagataatgttacggttaagatgctccacggatgagttccaatttttacccatggagtgtataatgggcaccatgctgcacgaattaactcacaatttattcggtccacacgacaaaaagttctacaataagctagatgagttgattggaaggcaatgggttattgaacaaagaggtttgtacgacacatttttggggaacggtcaacgtctcggtggaagagcaaacttacgttcaaatagatatcctatgacaggaataagtactaacacagggatagtgagaaaaaggggcaaaggtgtgaagttagggagtttgcatccagagggtatatcatctatagatagaggtaattccccgagagagttggcggcttttgcagccgaaaggagatatagagatgatcgctggtgcggagagacgaagaataacaaagatcaaataataagtgataatattagcagctccttagaagttgtaatccttgatgatgatgacgaggtactcccgggagatactcttatcgaagttattgatctcacttaatctcttgtccacagcgaagaactcgaaaattataagtatggtaaatgtcgtttcggttgtaaagtatacagatatattcacattacaaaaaatgtaagaaagacggtagtcttgcaaaaaatgtcatttctatatttagcaacaacctaatttttggaaaaagcccttatgagaagcagctagacttgaattatcgtcatttgggtgctgttcaggagttcttaaagcagcagaaggttgttgttgtggttgataacgagcgccaaactgctgagattgagtttgcgcttgaggctgagatggaggttggcctgttgcacgtagctgttgctgttgctgttgctgctgttgcaattgttgctcttgaagttgttgctcctgaagtttttgttgctgctgtctcttttgttgttcttgcaggtatttctgctgggtttgatgctggtaagcttcataagaagtagggtctaactttggtttatattgagaattgcgcatatctgcctcagttttttgagcatattgctgttgctgttgctgttgttggagctgttgcatttggagctgttgcatttggagctgtttgtttctatgttttctcgatttttcgtttggtggatttggatggccgtatccgtggagatttggcttcttgtttatgttaagatcccaaccacggccatcgttcagtttcatccaatcatattggccgtccgcggtttcacctaaatcatccagtacagatagtaatagttttctatagccttcataatcgggacactcttcaaaggaaagacttctgacgatttctagatacctgccaaattgcacaggtaagccttgagctagatcgtaaacgttagtagatcttttcttttcaccaatcttttcgtatttttgcttattgtttggagcttttaaaccctgccagggtaagtggcctctcaagaaataaaagaaaacgtgacccaaggcctccatatcatctcttctggactgctctcttccaaggtgagtattaatggacatatatctggcagtgccgctgagtgattttttctctctatatgggatgtgctgtttagttttcggatcacgatactgtttggccataccgaagtcgatcaaatggatgttgtttgcgtcaggttggccgggccttccaatcaagaaattgtctggtttgatatcacggtatatcaagtcatgtgcgtgcaagtcttcaatcaaagtaatcatttggacagcaacttgcacaaccgttttgacagaaaattttcttccacaccaatcaaataaatcttccaaagagggacccaaaagatcaatgaccaagatattgtgcaaaccttcttggccgaagtagtacgcgtaggggatattgggagtgccattcagaattttatatgttttatattcatctcttaattgaggggcctccgtttttctgggctcgaatttgatcgcgacgggtacgccattgatcatattagtaccttcaaatagcacaccaaaggaaccttcccctatttttttgccgatcttgtaatgtaggccgacaatagtagagtcatctctggaagagttgctgttggagttggcggcggtcgtggcggtcatcgaagatcttgcgggcgagtcgacagcctggtggtggagttgtttgtttgcttgtacgttaaaatttgcgtttccgtttatattggtgaggttgttaactgctagagtggtacttgctatgggcatggacatggggaagaggagagcaggaaaagggccagcgaatgcgcgaaatttttgtatgtgtcttttctctactatggcatccacatgaaaaccagtcacagagcactcaatgaacggtttgcgtttgttgtttgtaagaagcaagcagaaatcaaagacccatgtatacgatcgctgatttgttttgttctgttttttcttgttccggcgaaaaaatcgtaagaaacgaaaggagaacgagcccacaggcggggtaacatcaaaaggatttatattagatcgtaaagtcaatgcatatgtaacagtacagaggtagaaggtatgtatgtgtaacgattaagagatgcaatcatgattgttcttcgtcagacgaatcttcgaatatgtcttcgtcaatgacacagtcgttctcccaaaagtcatgggcgagcttgcttaaaacggcggcagcgttttgacgctgcgctctacttgaatctttctcattaatgtactcgttatactctttaaaagttgatccactgagagattgtgactgcgatgttctacgtggagtatagtaactagcaggattgagcctcctgcactctttgagcctcaatagagaagcgatctcctcggagagttttcttcccttatgctggtgaccatctttaagttgtttgtgttgtccttgtgaaactgctgtttccattttgccgcgtggagacatctgtccaatttgcccctggctctctgtaaatacccatatatgaacgttatatatattgtatattaatggcgtatatgtgcccatgggaagtcatagtaatagatctaggcacgtggctgcagtgactccgcgcagggctgtaccgccaaggtagataagagagcggagcacgtgggaaaagagagatacggtatgttacaacagtcaaagtaatgaactttcgcccacgtgcgtacatcatttactatctcaggccgctgcgtttggaactttacggcgttgtagttgtaattgccataactgccatgcatttatgtatatatattttcgtacgtaatgaacatggttatgttatatattgtttgcaatcagagagaagttgaagaggagaaaaaaaaaaagagagagccgtaccgcaataaaatggacccttgtcggtcacgtgagcaaaaatactattgccgccgacggccgtagataataacaaaggaataaaaaaaaaaaagcggtaactcgcggaagcattgccgatgcttaccgagatttgccgcggataaccgaaccatcattggggtaggaaacattataaatatttgatatatataaaggaaaaagcttgatttggtcttgtaatatcccagtgtaaacataaaaatacacacataccacaattacactctctcatcgactcaatgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttgaacagtgaagattaaacctatgtgttatttgcatatcatatataaattgtagttttttgtataaaagttgggaaaaagttatagtcgcgtatattttaaattactctaagcaactaaatggtcacggtttagagcatgaacttctgaatccttttccaaattgcatttagcaccgtactcgctttcaatatagctcaaacgttctttcagaccgtccaaaatttggtcgctatcaggtaagtccactgtaaagccctttatcaagctatattcgtgtgttattttaccccctatgtccaccacatattttttgacatcttcaataatgctattctggtccgtagccatattatccgtcttggggaaagttacgatgtatgatgataaggaagatgcctgtgccatggagaatatgctaatgaaaatcaaaactaagtaactggccttcatatatatgctatagtctgttacacaatagatttaaatgttgtaatataacgaggaaacgcaacttatccatttgttctctccatcgcatcgctttttcttaaatacttttgccccccacccctttatccacttgcgttttcctcttttcttcgcctctttttggtagcgccgaccgatctaatcggaataatcaaatttaataggaactgaatattagaaattattgaagtcaatatactgtaaaaactataaatcctgtaacgaacataaaaaaagaaaacataaaggaagcgcgtgatgtatcagtaacatcacatagtacaataaaaaagaaagagaacactgataataactgtactgaagacaaacaattaggaaagtaacgacgatctttctttcgtccagtcatcataacaatatgtgtttttgtttttgtttttgtttttgtttttgtttttgtttttgtttttattttatttattttttgcttattttcgtagtacacaacacataatcatcttattgttgactaacagggaagatttgttgtaactcgctactacttgtgacttgattatggatagcaatagacaacaaagtttgcgcttggattggtgacaagtacccagcagaaattgcaccttgtggaatacttgtgttacttatgaacccaattcctgaaccatcatgaccactggatccatcacttgcataaacgacagggaagtcgaccgatgtccatgatgccacggtactgttgtgacttgtaccagagctgacaacaaccaaaccttggatactagaacttagtgattgaattaagctttgagaatatccttcttcgtatataattggaaccaatggactggaggatgatgaggatgtattggtcccggaggaggcattagaagatatttgtgcgctcgtaaaattcgagtattgagttctgattgtggagttgctggcaatcagagttggctcacaggcatcaaagaaccattgaacattcttctgaccagacaaaacgcccacaggaacagtgtaaggagggaaaacaccagaatacacaactttatctctaccggcaaccaaagtgcctctaccttccgcgtccgaactactcaatattggtacaccccataagaaattctcagtaatgacaatggtctttgatgtattaaaaacgattgagcagaagaaactcaaagtttcaatggaacgccagtttgtgacgattataatgccggaagacgattcgctttgtaaagtctgattaacttgagtagcaatttggtaaagttgagtgatgtttaaggtggaagtagagttgaatagcgttgtggtagtaacgtttgactggctaccagatacagcaggtccacccgtgatgatcacggggaccgtaccgccgccagaagtaacgttctgcctcttgtaaagtggtgttgcagaagctgttaaagttgcaagaaaaaatgctagcactgatgtgaatttcataatagctgattgggttcttagatgtgaaaactgatcgaaatcaaatactagagcatgattgataggaacaagagaaaccaaaagtgtttttagctttcctcccaatttttatagtattctaatgagtaacgtcttaggggaattttcaacaaggcatttctaaaaggggatgctagttgcacattctgagagaatcatttgtacacgtttttccctattttctgctcataaaccgaggatcatcagcgttaaatgtaattgctaagccaagaacttttgctactctaacattacatatttgaagggtacagtgagattccccaacaggaattcgcttctgtacatcagccggtattcgctgagaactactgtagcccttaactgttgaatgatctttttctggtagatcatcggcttcttttgacgcaggaaaaggcccgtgtcacttcggcttagcttctttcggcgattttcaagggaagcgtctgcaccttaacgcagacaaatgacgcatgatatgcacccttaaggcggacttgatcttcagatccctcaaatggtaaatgtgccataaggtggccaaattccaactaaaaatgataaataggtaatgaattgttcactatgcagcgttgccaccgttacgcctcccccttatttttcatttccgtttccatccagtttttcagcctccttgaaccctaccattagtaatggaagcaataatctcatagcagcaattgaaaaaaaaaaagcatattcgctcacattaaaataatgagataacatgagatggcttggaattataagcgttcgctgacctgaaaaaggcgcggggctaatggacccattcgttaaaatgaccttaagcatccacacatgcagaataaaagaacttaacctattccttaggaaagtttatgtatttgctggtaccctcttccttctttggcctcttttctgacgtgaatgtcacatgttaacatttttgtcaaatagcgtccatctatttgaacaaatgctatcatttttggggatacaaattctataagaggttcctgtttgcagcatctaaaaacagagcgtgaaacgcatgcagaagtgacatataatcctttgtttaagcgacaattaaaaataatgatcgctctcttttccttttcagacttgctcattaaatttgacaagatccgcggattagagaagtctgcgcttcgcatttaatgaaaagatctccgataagtatataagtcccttttttctcgaattatataagtcactttctatatgtcagtgattatctctacactagtcttgctgtattcttagcaaatttttctcgtattttaaaaccataatacaaggagaatccatgatgtcttgtctggtaccaacacgttttactttgacccttaacaccgcgtgtcttttgacgagcacctgggggtttgttagggccacatctgtagtcttacctccaagtttaagtaaagcaggccataaacagtttctaaccattatatctattattgcaacaatcattaataacgcggttaacatttctaattattatatccaaagaaacaataagatgaatctagaaaccaagaaaaaatcagactttattagtagacatgtcactttgccagtttctttagtattagaatctattgttgctaccgtttattggccgcttagattgttttttgtcaacttaataatgcatggagttgaatctactgcaaagacaccttttcctatgacagtggatatggcaatccacttatatcctattttatatttactagccgatcactacttatcgggatctggcacgaaattcaaattatcgaataagcatgcatggctcattgtaaccagtttagcattttcatattttcaatatttagcattcctgatagatgcggggcaaggccaagcctatccatacccgtttctagacgtgaacgagccgtacaagtcgattatatttgttgttgttgctactattacgtgggcttattatgtattttatcaaaagtttccgccaaaatacatcaagaagtcggcaaagaaaggtgataagaattagcattactactagtatactactatttaagctctttgtatgtaaagtgagcaaatctcaaattttgctacttaattcttattttcgtgctagccctacaacggaacccaaaaaatcaatcaccagggtaagcgggaaaaaaaaaaagtgtaggaaccgcactataaaaagtcgaaggtttgtattaattttccacacctctttagttttgttataatcaaattccttttggtttttgttttaaaaaggccaacatcataattatatcgcgaatgtactactagtatatgcagttttcttaaaattgcagggaatgactaaaagcccacgtttttcccacttttagtagtactgaagcgtagatagattgaacgttgctgggcgcctggtgttgatcatttctgaaatgagatattgggaatcagctgtatctacattttatttatacatatttatttttactggttcttagtaacgtactttagtagcaatgctgtgttttagtgcgaacgcctacgtgtcttgttaacttatcatggttgccaacgcgaacgtttacaacaggttcaaaggcaggatgaaaaattacgccaaataggcaggttttcaatattaaagagttaagtatgcaaaatttacaaaaagttaatggtcaaagtataactataaaaatataataaaacaataaacaataacaactctcagaattgcaaagcttgacccttttgcttcttttcaccacccaattcgaagtgcttacatctcttcaaggttaattgggctctagtcttacatttgacacattccaatctcaaaacaaccttcttggtagtcttagctttcttgtggaaaacaggcttggtttgaccaccgaaaccagattgtttacggtcataacgtctcttaccttgagcgaacaaggaagccttaccagctttgtattgagtaaccttgtgttgagtgtgcttacgacaggtcttacccttacagtaggtctttctggtctttgggacgttaactggttcaaaatgatatcacagcaaatttagcatgatagttgattgttagtaattgatcttaaaaaaaaagtaatttgactgcacatgtaattagttgtatcttttttctgtaatggggaaacggctaaattcacaaatatctaatgagtattactaatgatatcctcaatatattttctaaccagagttcttattaaaagggccaataaaagtatcattcaggtgttcagtactttaggaaatgatgaaaatatttaactagctcaaaagtaaatgaagtttaataactattagtttcttgcttgacatggatttgccctacgattcaggatattttaaaaagttctttagcattctagtagtacctgtgtactaattacactctcacgccctaatggagataaataacatggtttgtctattcctaatcgtccacatacccattattactgattgtttttttgcttaatctccttcaatttacgttaaaacagtgaaaataccacatcaattaagatatacattgtcaacaatatggatgtatctctgagttcatttcgacgaataattttacctctcttggtggaaagccttccctccccctggcggaacccatcatcccgtcgaacaactaaaccgtcagcgttgccgcaccgacggacgtctctctagaggtcgtctctccgtctgaacatacgcactgttggtacgatgcagcggcagtctggccgcatttttgacagcgatctttttttgtatcaagacttcttccaatgtcaggatttattttcatgatgtatgggtgtatcggatgttcggatgtcactgtcttttattttgaagtttgtgacagagaatgctatggaaaataatatgtagcaacatagccaactaattgccattgcattaaattttggcagtactatttaaaatgccatgttttatgttgttacagtaagttattgacattcttctggtgttgcccgcttcgctttcttaaaacggttaaatattgaaaaagtttcacaagacacgaaatcaaaaaggatccattttggtataaaaatagcatattgcataacttaactaaaaagattaaaaaaagtcaaagctacactggcatactttgaactgttttttcaaagctgtctccacgtggaaagtttatttcatcaaaactattatcaaaaattgtggttttgttaatacaaaagctgatatatatataatatggcatttagtgattttgctgccatatgctcaaagaccccgttgccattatgttcggtaataaagtctaaaacccatctaatactttcgaactcaacaattatacatgattttgatcctttaaatttgaatgtcggtgtactgccacgctgttatgctcggtcgattgatcttgccaatacagtcatctttgatgtcgggaacgcattcataaatattggtgctctaggtgtcattttaatcatactttataacataagacagaagtatactgctattggcaggtctgaatatctctactttttccaactaacattgctattgataatatttaccttggtggtagactgtggtgtatctccccccggctctgggtcatatccatacttcgtggctatacaaataggactggcgggtgcatgttgctgggccttattgataatcgggtttttaggtttcaatttatgggaagatgggactacaaagtccatgctgttggtccgtggaacgtccatgctaggattcatagccaattttttagcctctattttaaccttcaaagcatggatcaccgaccataaagtagcaacaatgaacgcttcagggatgattgtcgtcgtttacataataaacgccattttcttattcgttttcgttatttgtcaattactggtatccctattggtagttcgaaacttatgggtcacaggagctatctttttggggctatttttctttgtagcaggccaggtattggtttatgccttctctacacaaatttgtgaagggttcaagcactacttagatggcctcttttttggaagcatctgtaatgtgttcacattaatgatggtttacaagacttgggatatgactaccgacgacgacttggaatttggtgtaagtgttagcaaggacggtgacgtggtgtatgataatggatttatgtgaaatgcttcttttttctattaccatatatagaaaataggtgtatactattagtttaatgtaataagcaggactatgacaaaccaaagagtgaaagtagccgtttccacgttttaacggcttgtgtacactttgacagtcaatcagcgtagtgacttcttttatcagcggaaacaaccatatccataaaagaaacgtgatggtcgttcccgtagtttattaagtaagatgacaaattatccttctttagtcaattgaaaacaaaacttcttaatctgtttccaatgttttaaagtcgctcatatgttcatgactacttttccatgagagggttctacgaaaagcatcatcttattttcgcaacgctgcgggtttaggcctttccgctggtctcttttctgtttacagttctgcccgaatgtaaacaaatactttgcgaaaagtaaataatgtattctgaaaaaaaaaaagagaactgtgaacaatgcttgatagttgtaggaatatcttagaagaaaggggatagattatctggaaaatcgtttgaataaaataagaaccagtaattcattcgtttaaattggaaaaacaaaacataaaagaaccagcaatgtcttggttgcctgttaatgtaaaaagttctcccaaaagatgacaggaaactcgttaactcatactcggtatataagaggaaacttatctaatgtttcattcattcttcctcttctgcttattcgatgtctattgaaaaacttcaagtaaaccagcaatatcgacttccattaagtagacagcgagcctgaaacaaagaatatactgtttcaattccaactaaagccactccctcaagcgttattattttttgaattatattttcgggttttaagctaactctagtcattccttactacattttattgtaactcttcagtagagctaaccacagtcattccttaatattttttaacacagatctctttcacagagtagaaataaagccactcctttaacaaattacaaagaaatgaaatttaatttttctacaattttcaatatcttattctttttattcaccttaattgaagccaacagcaatggggaaacagtcaaacttattacttctgatggtattgtttacagttatgctgtctacacaaagactcttgcgccggcaagggttgtggttaaaacgatttcatatactactacaagggtatatccgattactttagctaattccgtcgtttcttccactactgaaaagataacagaggtttcaacggtgtcagcttcagaacaagttagtgctactcaaacaaactcattggtttctacttctactgtttccactatcagtccaacgatttcatctggttcttcaacatcctctagctctacatacgatatcgaatcatctcaaagtatcgaatcgtcaggtacatcttccgctacagccgaaccatctgcgtcttcaggttttcgtttgacttctagttctgcttttgtttcatctactgcacctttctcttcccaactttcttcatcttcatcttctgaaacatcatcctcatcattttcaacatcatcatcatctgcccctctttccttaacttcttcttcttcttcttcttcttctttcgccactattattaccttggcaccatcgagctcaaaaagcggaaactctcaactaactttggcgtcatcgtcttccacttccgcagttgagtcatcccaaacagggtccactatagcaagaactacctctacactggtaccctcttctagcgtagatacaacgtctagagcaacgacatccatgccattagaatcgtcttctacgcaatcgatatccgtctccagctcggatggcacttgttacgttttttatgatgatgatgactactatagtactgtctacttaactaacccgtctcaatccgttgatgccgccaccactataactagtacaaacacaatttatgctacggttaccatttagcgcttaggcataatggtggtgcattcttttctatttgttttctcaggcgtattttttccattattttttgttaaaaatagtaaaaagacagtattatttattcatttttcctcgtgttgttataacgactaagtttcctaatttctttattttgtttttttctcatgatcttttcattttgtagtttcaactattatatacaatgtgtatactataacttaattttattagttacctcttactaaggatactgattcttccccactcatttcatgaattcatcacaagtctttagtatttttcatatggaaattacatcacctatatatatcaaaatgttccggcgagtacattgtcagaatctacagtttttcctgatatgagcagtgatatggagaaagagacactaaataagaacaaaatattgccgtagatttaatgattcaatcatgtgtgtcaaatttgttctccattgcatcttcctatttgacatttgtctcatgaccacgacattgtacattaccaggtaaggctacaattagcctcaccgatgtaacgttatataacgctgcggtcgtagaatatgatttttctgaattttaatttttttttttttttttttcatttctttaacatctaaaatagattttagaatcagaaaagtgaagagtattccacatcatcgacttattctaccaacatttaataagaacgtacccaagaataaaagtccacaagtataacaatgtctcgcgaagggttccagattccaacaaatttagacgccgcagctgcaggtacttctcaagctagaacggcaactttgaagtatatttgtgctgaatgttctagtaaattatctttatccagaactgatgcagtccgttgtaaggactgtggtcatagaatcctgttgaaggctaggactaagagattggttcaatttgaagctagatgaatggagagactgaaaaccataatgggttaccggggcagaataatacgaaataaagaacctaggttttccaaggtttttgcaatatataaacttgtgcttgatttaagtttatgcagcacttttcttccagcaaattctttatgtttttttaagggaaaacgtatatcacttagagattatattaatgaaaaaaggtgtatacaaatgtataataataatagtatataagaaaagtattcgctatttatagtgattttagtttgtacaatgtactgtattttttttaaatgtagtattttatatatatgttacattagttcgaactgaaaaggaacttatgaattaaatcatcacaattcttggttcttccgtaaagctgaattgccggacggttattcccgcattcttcaagaccttgaaactttcctcgtccattctataactttggctataaactacttcactgatgcctgtttgaacaatctttacagaacatgttaagcaagggcaagtatcacagtataaggtcgcattttgacctacacgatccctgccagcttccagtagtgcattctcttctgcatgtaagcataagcaagtgtgcagatttctagaatcaccgtcattgcaacgtgggcaaccgccattgaaacaatttgttaaatgtcgaggagtcccattatagccagtagcaatcactctgcattctctcacaatcacgcaaccaactctacgtttcatgcaattggaacgagatgctgctagtgtggctaacttcataaaatagctatcccaactaggcctcattaatggagccatttgtttctctttgtcatcgagaatctttaattgtgtggtaatgttattaatcaagctctgtctccttcctctgcggtcctcattaactattttaaatctcaaatgggatttctcccttaatttgatgccttcaggctgaaagtcatgttgatcaatggcttgtattatttgttctaatgataagctttctgcttgagtcgttttcctgtataatgctacccttgtagtgacaggagcgtcgatagaaagatgaacaaaaaatggtctcttttccagtttctccagtaatgataatttttctaggaatataactgaattttttgtgtaatttttcgtagcataatctaatatctcctctggattatctaggtgattgagtaattcaaaatgaaaatgatcaaccaacatgttaataacatcttcgcatccgcaaaatttcgtaccacttacaccaattaacataatcgtgttatattgattagtgtagcattcacacctttaatgtgccaaaaaaagatgttgaattctatggtaatgcagaagtttcaattctcgagattgcctacatcatctcataactgcgtaccgcgcgttcttgcaaagaacaaaaaagtgaaaaaattataatggggcgagctgggaattgaacccagggcctctcgcatgctttgtcttcctgtttaggcaggaagtcgcccaaagcgagaatcataccactagaccacacgcccatgtatctgttggtgttctaaataaagaattaaactatgtaggcataaaaagagacgggagcatcttaaagatgcaactggatggagaatggcaaaatatgaagaagaaggaaggaaaagaaatattattatgcgtaactgttgattcctttttgtggatttcttgaggagaatgtctttttgaagagtgggtgaattttgagataattgttgggattccatttttaataaggcaataatattaggtatgtagaatgtactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacacttttatatattctgtatttgatgttatagctttatcaattacagaatgccaaaaattatcaaattattcaccaatatcccaaattttaatgcaaccgttatgatccgactattgataaaggaaattcctattctacataatgttactggtatttcttcttccgttttttatgtcgtcattcgtcatcctattgcattatcaatctttgcgtttcagcttccattaaattatgaagattatttttcaatcttaaagtcatcttcttacactggatataataatatactagcagtatgaatattagtcgatagacgatagttggttctatttcgacgggtaatattctactaataccaatgacactattaatttacctaacagaaattcttcttcaattgaccctagcgtttgccttattatcaagacactgaaggtaaagttgccgataaactttttgggttccactgtgcacctatttctatgcttcaataagcagttccaggtaaggtttcaccatttcaacccaagtaaatgctatgtagttataatattaattaatgtgttctactggtttttctgtgcataaaaaagacgctctgacgccatttatcttggtgtgttacccgttaggaaaagtggcgttgctaaaattgttgaaacccgatctcatcgcctggtaaacaatacaaacaaggatttgaacaaggttttatcattttctgatacgttttttgtacttacaaaataaaagatacaaaaatcactaagaaaactaatctatcaataaaaatgagtagtgaactcatgttcaactatacttttagctggcctgctggtccaaaagatgttattttaacaggaacgtttgatgactggaggggcactttacccctcgtgaagaccgccaagggaaatttcgaaattactatgcccgtgaagctagccaacaaggatgatacgtttcagtttaagtttattgtggatggcgtttggtgcgttagtgattcgtataaaaaggagcatgttagtgaaggaatcgaaaacaatttcttacaaattaccgatttagttgaaacgcaggaagttgccggtgccagtagaatcccggaggcaggtggcctattatgtggtaaaccgcctcgttcagcaggtcctccttctacaagtaatagaaagaaaaacaagcgtaacaataagaaaagaagatctaaattgaagaaaaagagtactaagaacaacaagaagtcaaatgaaagtttagacgataatgaagaagaagacggggtgactggaactactactgaagatgttactggaacctctagggaagaaactccattggcggagcctactaatgtttccaaagaagctccgggcaatttccatattctgccaatcgatcaaagtgcagacacaactcaatcaaatggtataattggtggaccaggtcctgttcttgtcccaaaccctggtgaaatcaaggaatttaccgaaattagagacgttgatgctagggaattgaatgaaagacttaacaaaaaagaagaggttccagaacccgttgctggccctattgttgaatcatcagttacggaaaagagtcctgctcttccacaagctgacgacccgattgttgagaccaaggaagtggctcataatgtgcaggaacttactcctcaagtggaagcggttactccgttaataaatgagcccgaaccattaccaactccggaagcacaaatatctatacctgagtcatcgaaagttgaaccagtggaggggtctcttcaatctaagttggtggagaaacgtgagtccactgaaggtgtattagacggttccaaaaaagtagaaaataaggcaaaaaaagatgaagaggtctttacattagaccccatcgttaacaaagctcccaagctacccttgactgacgagcaaacagctgaaggtagaaaatcaccagcagtgtcagaagaaaaagaaaagaaaaagaagcaagaaaaaggctctaaagaggtcaagaggtcagaaaccagtaaagaaaaaaagccttctgccaaagaggttaagaaacaaactgtaaaagccccaaagaaacagacagcttctcctttgtcttcttcgacagaagagcccaagaagaagaaaactggtttcttcggcaaattgaagaagctatttaagtgaattatctaaggattggtctcatgttgccgaatcatagaaatataagaaaaaaattaaaaaaaaaaagaaagaaagtataatactaatattggcaataatgctaacacattactaataatagcaataatattaataataataataataataataaattataataatagcagtaataaaaatatcaaataataataatagtaatagtagtagtagtagtagcagttgtagtaatgataataataatataataataatataataatagtataataatagtataagtagttgtaggtaaaaatctttgatttatcttatctggttgcaatgcttctcccctctgatgcctaatatgtctatctttatcctataccaattggcaggggagcaatcataatttacattaatatcgtccaccataccctgaaattccaaaagagttcgagaaattggaaggtacagcatttcatttactcacttatttgatcttttcttttgttttctggtaaacatctttgttttaaatgggctctctacaacaaaacatgaaaagtactcaagaaaaaaaatctttattagcgttggaatcaaaaaatatatagcattagcagaacgttaaagaggatatttggtttctagtctaaatggtgttcccttttcgaaactgtataaaatgaaaggtaaggttcgaacttctgtggccttacttattgcgttcatattccgtgaaactagtatatattaaaggttgcaagccaagagtttcattgaacaccaaaatgtttaccaagcaagaacacgtcaccgcattaataaccaatataaatttcatttaagttattttcataggatatttacaaggtattccctataaagtataagaaaagatacatgtcataaaaaaaattacgaaaatgagtacgaaaataactgaaatcctgaagttatttgattttcttgtcctttagctttattgtttcatcgttaacgtatattcctttgcctttatacggctctggtggatggaattttctcaatttggcagcaaaaagaaggacctgctgcttattgcacccttcaataatcagagacgtgggagcaggtgttttgacaacaataccttcaggaacgtccaatccttgtttgatagatgcacccaccttaacgttgacaaatttaccatcattttctaattgagctctataacctgtccctacaaatctaaggacagcaagatgcccctcagtaacacctataatgtgattatttataagtgatcttactgtaccccacatcgaacgttgatgtttatcttctgaattctgaactgtaacatttattttaccgtgcttttcatccttgtccaagtgcaaaaaatcagggacctccacggacaattcacccttgggtccctttactgtgatattctgtgatatattcattgaagttctaccttttctgataatcctgggcatggataatgcatttatggaaacctgaacttcaggagatatataaagtggtaaagaccccacttgagagcgcagaaaaagtgtttgcgacaataacctcctctgaataaatgacataggttggcctcaattcctatagtaagatttgcgatagctttattgcgtgatcttcccttacttactagtatttgatattcttcctctataaccgtagcgtctcctcgctatttccgctcgcctttcattaccctctacttccagtgaaaaaaatttcactgatataagctcatcgcaacaaaaattcaatgggataagtaatatagaacgttctaaatagataaaccaccaggcataatcacaaccaataatggttagaaaactaaagcatcatgagcaaaagttattgaaaaaagtagacttccttgaatggaagcaggaccaaggccaccgggacactcaggtcatgagaacatatcatattcagaatcgtgaagattatcataaatacaataggatatgcggtgatattcgtcgtcttgccaataaattatcattattacctcccactgatccatttcgtcgcaaacatgagcaattattactggacaagctatacgctatgggtgtcctgacaactaaatcaaagatttctgatctggaaaataaagttactgttagtgccatctgtaggaggcgattacctgtaataatgcatagattaaaaatggcggaaactatacaagatgcagtcaagttcattgaacaagggcatgttcgcgtgggtccaaatttgatcaacgatccagcctacctcgtaacgagaaatatggaggactacgttacttgggtggacaactctaagatcaagaaaaccttgttgagatacagaaaccaaatcgacgattttgatttttcataaattgactacaaacttacgttttctgtatcaatactcgatttatcatcttcctacattgtgaaattattacgaataggcaacgaggcagcaaatacaaatgatgtgaggcgcctgagctttcttaaaagctggaagcatgaaaaattgttatatacacaaaggaacttcttcgtcgtatgcaaaaataagaaaaaccgcaaaacaatttctcatcggcgtcatttgttaaatatgccttaaaacttaaaaatacacttcgaaaaaatcctatttaacataaattaatttgtataaatacgcaatttgtaaaatttctccaataaaacatcaatttatatatccgataattgtccgttcattatctacacttcagttgacggtataattatgtgaagagcctaattgttttcttaaatcgtcctgtgaaccactatgtggcaaaattccaccaacacttggtggctgtacaacatctgtctcttctaatatcccactaacacgagaattatacagttgctgctgctgctgttgcagatagatattattttgtgtggtcagactgttatttcttgaattggttgcgcttacacttctgaaagaacctgctggcttataagatggttttgccgtcaaatccgaaggattggtcattaccacactttgtctaagttgataaggtgaaggaaccgccccattttcgttaaacttcatatattggccttgctgctgtggagcataataggcatcgtttgtcggtgaataaaacatttccggatgatcgaccggatttaacgcagttccgtttagtctggcagtctgtaattgaagaagttgttgcttgtttggtcttttaaaagaggtcaatgaatgcgaggaagctgattgagctaaatatgcgggagttggtaattctccaatagtttccagggtctgaggatgattatgttgctgttgttgaggagttggtacaccgtaccattgtggattttgcacgaattgcgcagtatacccctgttgctgaggatttccgctatatccattgccaggatactgtgtgtggccattatatactggtgattgttcctgttgttgatattgatcctgataattcaacggctgaattgcttcggaataaattgaggaagcaattctattggaaggcgctgcttccgtatcgttcacggtgagtgtatcctgcactggatattgtttctggctttgggccatttctggaccatattctgccaagttagtattgtttagaggaagtgcttctttcaccaggtgttttgcttccggtacctcattattgtcgatattgtcgttattattaattttgatagaaggcagtggattctggactatattatccactctattctcctcctgcgatatatcatttgcattatctgctttatcctcttcctttttcattgttttagctctatccaaataaacttgataaatacttttcattctcttaatatcttcttcttcattaggggataagagtgatacatagtaatcatcatcttgacttttactgctactacgatcattcatatgttcagcttctctgatatcttgaagttcataattatcatcatccttaccaaaacgcagattcctttcatgtgtcttttctgaactattatcaagttcgaattcgaacgcgtcattgcttgcagactcatttgactcattcaaaacctcagcctcttcactaactgaggacgaatcattgtcttcattaggaaatgtaaactgcttgttggcaccttctgtggcagaaccacgggaaagctggttattatggattgggctaccgtgagatcgaaagctttcactctcttgaaatcttgaagacgctcttattggtgtacaattcgaaaagttatcaggatgcaaggacgtttgactggcatttctagactcggccgcaactttatagccacctagtccatcttcttgtactctcatggcaaaatctctcaaactgttagagtcgttcgattcctgtggaagctgaaacgggtctacgtaccatgaccgaccaattgcaggtggggtagcgcttctcacattatatttactactatgcatgctaccaacaaagggatctgaaggcggctgttgcaaggtcttttccatgaagtcttgctgcgagtcgctagagtacaaatgatttattccaggtgaataatccttcattgtcggtaaaaattcagaatctccttcgaaatctggatcattatcttcctcagcttcctttttgcttctcctatacacaatgcaaagtatcacagccagaacaatgataatgacacctactggtaccgcaacagccacaccaacagttacactggtgctgtgactcgaatctgtgggtaattgacattgctgtttagagcctgtacattcagcagatttgctatttttcgtgctggatgctgaggaagaagatgaatcgctatcgtctcttctagtgagccttgcataagcataagacgcatcagaaacacttaccgttgaagtcacagatattaaactttcatgcatatgggtgtggtacatcgcgaactatatctttgttagaactatgtgacgctatatgagttcaacgaaaaactatgaaaggtaatgaaagaatgaaaagaagaaccagtgaaaaattcgatatggataaagacaaggcctgctccccacaaaagcttcaccatgagtttgttattgattattaaaagttcttattgagataaaaagagaaaaaatacggaagaaaccttgtcttttcgatgaactttcctatttgggtgagcagttttcctcttcgagctgcaaaaaagtttatcgcttcgcgaaaaaaaaaaaaaaaaaaatttaaagaatttcaaaacgtgtcagggctactaaataattgaacgaggtctatgaaataaaatgggctgagaaaatttcaagaaaaaggaaataagtaagggctatttagggttagtggaatggcttttattatttccgccgcgatgaacttcccttttattgtgacatgatagacataaatatgacgaatgcctacgaattggagtcatcagtagatagaaccataatgaataagataaaaacgcaggtatttagggtgacaaagagataatatatcttcagcaaatgagtgagaccagctcaagtcgcaggagcgcgagtaaagacgctgtcaaatcttacttcgcaggcaaatacaataaagtgttggattctatactggaggcagaagcagcaatatcaaaatcgccaactgtagcagaagatctatcaggaagctcctccagcggaaattctgagatgagccatccttcgctaaccgcctcctccgcaacaagccaaggcattagcaaaaaggaactactccaacaaattgctggttcattattcagtacgtccattgagcgcctgaagactgcccactcatcagaagtatcaagtactccggaatattcagtaaatgattcgtatggagagcaagagtgcagggagtgcgatggtgttttcaagtgttcagcgcactttgagggcgcgcccgaatattatgacgatgaaaccgaatcagggccagctctagaacctatgacttccaatagtgaaaaagatccttttatcgatgtatttttggataaactaatatcgaggttggtccctgaaaagctaccagaaagagagcattttagtagcaaaaccaccattgagcatgatctagacacaggaagggttcccgtgttttcagcaactacattgggtagtaatttcaaaaaattgtctaagaaaatgggctcaatatttgaactccaggactccatagttcgactgctgacttggagaaaccctaccgggacggtgacgtcgttaatattattcactttgatatgttttaatccaatgtacttggtaattttgcctatattccgctttgtctatggtattgtagttcctggctatgtgcgtaaacatcctttacaaaggagtatatatcctctgaaacggaatcacggatcatcattgttatatgatgtgtgctatgagggaaaaaatgagtacagctacggtcaacagtttttctccaaatcttttatggacactttggaatcaagaaatcaagaaatagacgaaatatcagaattagataaaagaaccgaaaacacaggggaattgaaacaaggaatgaaagtactaattaatttacgcgatatgcaaaacatgacctctggtacccttcatgttattgaggcaatcaatagttttcttcgtaagtcttctagttttcaaaacgaagagtgctccactaaacgtttttttacaggatttcttttgattgttttcttaaaaatattatcaccatttgtgaattggagctatgtatgtagcatattcgcctggtgcttactgatatatatgcatccaagagctcatccaaaaataataagttttttcaaaacaggaacaatgggaaaagaatacaaaaacttgaaaaaaagagaacaccaggcgcttaacatgatattcgatgaacaaccggaaactaaattcatcgagatttttgaaatatataaaaaggccttactgccgaacgactggaagtttttccgatattcaaatagaattttcgatcctcaagatccgtatagaagagcacagcaattcccaccgggagtagattctttggctgatgttattccccccacaggctggtcatttgatcctaattttgagtggaaaattgacaatgatgtggataggtgggtggtagaacgtgggttgaatctgccaattaccggcgaattcttatttgatccaatgttcaagaggaggagactgatacatcgtgttattaagaatgcaacaccagtagcataatgcacaattgttttccttcacctacaaccccacccctcttcttggggaaatcattgtattacgtacttttttcctaaagatattagaaaaaaaaatgttatgtatcaatattactaggtaaaatacaaaaatgcgcttttgaagtataaataatacagttttgttttaagaaatgctatatatgaattaataataaatgaaacgaaaaaaagcactacttgagttttaatgtcgtaaaacttgagaaaattctaaagtgtcagaaaaaaagtgatttttaagaagggacaccttctagctcggatttagagattttattgataactcttctccaattttttctattatcataaatggggaccctcaatacactcaagtaaacgacaatacacagtagggcaaaggaacagactgacgcagggaccatcattgttacgaaatttctcctagaaatgactttttcatatgggcaactagcataaggaccaccacttacccaacaattgcttactgatatagagttcaaatctatccatatttgtgtgtcagagaaggaggaattcctcatatatgcaataaacgatctctgctccaatgggcttctaggaatattaaatgaatactgatcgggacatttagatccctggtaactatcaaaatcaaagtacgtagccttatttgatctcaccaaccatcggaatgccatattttcatatctacagagcccaatattagaattgtaacagttacctactcgccatgttactgtctcattgttagcaaagtagtacaagagaacgcaattgtaagcctctaaggtcccggatgagctgccagatttagaagttgactgagtaactgaaggttggtcactatcccatgaccaaacgctgccttcatgaattatatctgctaactgcgtcacattattgacgtacgctgaattgcttattattggtgataaaccacacgaaatatactctttgatgtccacggaattgaacagcgaatctaagaatctccaatggatagatgataaatcagtcagaccctctacagtagaggggcaatctaatgtagagttcccctgctcataatgaaagacgtcatgaggaaaaatatatggagcagtagtttcattaaaaaaatcggtcagctcacctataaccagtctcttcttttgttcatatagcacagagcccagagtgggccaaccgtcaatggacgattttccgtagatgttccaggtattattctttgctctatcactttgtaaatccgtaggcttgtaaatgaaactatttcctaaatttttgtccagtatataagtagtgttcaaagtttggttttggtggcggtattctgtggaatccagttcaggagctgatatattcagcaacagtacaatgatattcgcatagaggttgttttgtgtgctgaagatgaatgactgtaaagcagttagaacgtcgctaaataacaatgtcgtatctaccactctcaaatcattattatattgttccaagtcgaggacaaaagcatttgcttcggaggatagcatagatttgaacaaagtcagtaatcttgtattattaccttcatttaccatgctagtctcattgttcaacagaacccgtcgtagattcaaaccaacatacggcagctggtctatagttaagtttcccatgacatctctttgggacctaaaggccaccgtcatttgaggggacatcgtcggccagacagatgctgaaacggtctcattcagatcatcgccaactgtcgtagtagagtcaacagcagtaacccacgttcgcagtgaggaccatatgataaataggtatatgagtatccacataccgtgtctataacgatgcgaatgcaaatgaacaaaagaaaaagggaagaatagaatggagatagtctttgaaaaagcgaggttaaaagcgactaaaaaataccagcaaaaaggtgacaaataaagttaaacagggtgtatctcaccgtgcagcgaacacttcaatgtgacttgctcagccaaagactcatcaacatttatggaaatttcaatgattcccattgtattgcctcttcccattgtggaaaaaagaaaaatgccaaaattgcaaaccctaatttaaaagggttacagaaaaaaaaaagcaggtctgaaatgcagttcgccatggttaatatcttttcctaatttggaaatatgtaaacagggcatctttcctttttttctcctaatgaaaattgtaagcaaaagcatgaaacaatactgccacaagaggagaattcctccttttgaagtctaaagcgccatttcaaactagtttttaggaggtcagccaaacgttcattcagattagttactatcttggaatacttctagtaggaaaacaaaataacatatacagtaagaacaatagaaaacgtatttatgtccaacaaggcaagtgaccaatcagcacgcacggcttccatcctcaagactgatattaccagagaaaacacaatcaccagaagcagcagcagcaacaacgacaactaccatcaccacaataacatcaataattacaatgaatcggcgaagacaggagaggacgccaataaagagaatatacctaatttagaggaggagattgcggcctttcgaatttttaggaaaaaaagcacttcaaacttgaagtcgtcacacaccactagcaatttggtaaaaaagacaatgttcaaaagggatcttttaaaacaggatccgaagaggaaactccaactacaacaaagatttgcatcaccgactgacaggctggtatcaccatgctcattgaaattgaatgagcacaaagttaagatgttcggaaagaaaaagaaagtcaatcctatgaaactgaactttaaaggcaaccttgctgccgattcagaggatgtagaaatcgatgaagatgaggagtatttctactaaaaaaatctgcctttctagtcatccaaaaatagccaaatgctacactaaaccaataagcaaacgagtacataaagaataagtaaataataattcaacaatacctgattttttttttcttacattttttttattattcattaaaagcaaccaccaagctttccaaattatgaaaccttgataaaatggcttcaaaatcttgatctggaattccgttttttttgaagaggtcgaaaattatttgcttgattagaatttcaaaatcaataaactcgtccatatccacgctgttccgtgtcaaacgctggttagctttaaaagctagaaaatattgattgttttcaacatatcgacttctgtctactggtgtaacctctgtaataaagtagcgggcacccgttttcgatggtccatttattagatctagtgacctctccaataagatatcccaataagctattgagaatttcaagcgcgtgaaattcaaatttatcatcagagaacgatgtgcgggaactccagggcttttctgtattttctcatagacattatttatcagtaattgcagctgtgtaacaataaaattgacgccactttcttcgtcttgtagctcctcgttaagctgcgaaattaacctgctcgtattcacagtaacacacttaaccacagaatgttcttcgacattagaaatctcttgtattttttgtacatcccaaaagaattcagacatttctattgaaccattccagaaatgttgttccagaagtttattctcttgaacctttacactatttcgtattttctcggttttagccgcccacttttcacgcgttaacagggtaagctatatcagatgtgacttttctttttcactcatctaatgttgtttttcgcgtcacattttttgccaataaataaatacatcacaatgttctatattgtatattcaatggaagtcattaggttattgggcaagatttcaaggaggtagcatactggtaaatatacgatccatgagcacatcacttctgtttgagcagctaaattttttaattttagtggcagcagaggctgagcttcccatcgctcactctactagaaagcttttgatggataattcatgcaataactgtcaaatatacgagctttataacgaaaatttgaaagatgtcaagacggataaagattggttcatgaacaaattcggcccgcaaacagtacattttgtcattagtaatacaatcaactttcctttttataagatagtttatttcgatcttttgatcccggtggtatcacacacttgggtccaggattcggtcaagacgaagagacatttgaggacaaatatgtattcacctaacccatttcatttgctccgagactgtcaagtatatatttccaaaagctcgtttaataagtgtgaatacatattatactctgatttgcttcatttattaggaggcactttagtcaattacatctcaaatagaacgacgcatgtgattgttcaaagtccccaggacccgatcatagcaacggtcagtaaattgacatttggctctttttcctcttcatcgaccaacaagcacaccgaaaagcctttgagagagtggaaatttgtctatccaatatggatattatatcatttcaaaatggcgaagcccttgaagggcgagcttgctactttgtgtgagcttgatatgcaggacaccagtgaggaacagttattcgcaaaatgggaagaggttattggcgataagcagacatcatcatcgcagcttactcttcatccaaacaaaactttattcaaaaatcaccactttgctatctcaccagatttaaactttttcacacctttgtattggtttttgaaaggatttatcgaggatttggacggcaaagtaactccgttgagtttttctgacgatctgaagtctgtttaccaagcttttcctgatattgactgttatatcggccactctgctaactcaccgatactagaaaaaaccaaaagcattaaaccggaaattcatgttgggaacgtaagttggttgttttatatgtttgcgctgcaaaaatttacacctgtatcgcaatgtaaacttattcaccaaccatttcatgcgaaattatttacttctaaggaattaacagtcgcgtacactaattatttcggctcccaaaggttttatattcagaggttagtagaaatattaggaggacttagcacacctgaactaacaagaaaaaacacacacttgatcacgaagagtacaattggcaaaaaattcaaagtcgcaaaaaaatggtcactggacccgcaaaatgccattattgtgacaaatcatatgtggttagagcaatgttatatgaataattccaagttaaaccccaaagacagtagatttcaaaattttaaattggatgataacatgggatggaatatcggccaaataggaatggatcattcatctctcccaactccaaaaaacctatcgatggtgacttacgacacgcaatccatatcagagaagccgcctcccacaaatgatcaaatggatcaaattaacgataacaccaatgtattatcaaagaaagatggtacgcccattagtagttttgagaactcaattgatgaaaagattgacaaattacaaaaaatatcaggagaggtggctgtaacccattctggagatttagaacggagttttgtttccagaccttcaagggcaagttttccagtagttgacagtaaaaaatctaatttacaaaagaaagactcaaactcagatattagtatggaaacagaggttttctgtgaaggacatgaaaaaagagaagaaaaggagtttacgaaacctattacggagtatgatgcacctaagaaacaagaaataagggaacagtcacgcaagaagaatgacatagattataaaaaagaagaggaagaaacggagctgcaagttcagctaggacaacgaactaaacgagagatcaaaacttcgaagaaaaatgaaaaggagaaagaaaccaatgaatgtcacattgaagtagatcaaatgacgaatgaaaagcaaggggaggaaagtacaggaaaactgatttctacggaagacgtcacttctaaaaaagatacagataaattctcgcatttgtttgaaggattatctgataatgatgatcacattaatgacgaaaaaccggcagttaattccaaatataccacacccaagacgtctcaaaatattacgagtggcgttgatactccaaccaccgcgcaaacgcaagtttttatgccatcaagtggcaattcaaggttagcaaagacacaagctgcgaagagattgcatacagatattgaatcattaaatgaatttcagaaaaactttaaaaggaagagaattgatagcgaggagatttcattgtcccaagatgttgaaaggtcaaataataacaaagaactggctactaaagcggaaaagatattagctagatttaatgaactaccaaattatgacctaaaagcggtttgcaccggttgtttccatgatggatttaatgaggttgacatcgaaatattgaaccaactaggtataaaaatttttgacaatattaaagaaacggataaattgaattgtatttttgctccaaagattttgagaaccgagaaatttttaaaaagcttaagttttgaaccgttaaaattcgcattgaaacctgaatttattattgatttactgaaacaaattcattctaaaaaagataaactttctcaaataaatataaacttgtttgattatgagataaatggaattaatgagagtataatatcaaaaaccaaactacctactaaggtgttcgaaagagcgaatattagatgcattaacttagtcaatgatataccgggtggtgtagatacaataggctctgttctaaaggcacatggtatcgaaaaaatcaacgttttacgtagtaagaaatgcacatttgaagacataatcccaaatgacgtttctaagcaggaaaacggaggcatttttaaatacgtacttatcgtcaccaaagcttcacaggttaaaaaatttaccaaactgattaatgatcgtgataaaaacgaaacaattttgattgttgaatggaattggtgtgttgaatcaatttttcatctcaatgttgattttacatcaaagaaaaatgttttgtatcaaaagaaaaataactaaaaatggacactatatattacgtcatctgacatacgacactgataacaaataaatatataataattataaagatgcgttgtagaaaatcttatgttcaacaaacaacccacatatgattaacagaccattttaaatgtctagttagaaacaattatttggtactgtctttgaattagattgtttaataaagcatttctaatataggatacaaagggtcaaatagtaccgtgagtagaatcatttattccacactttatccgcaaaccttttaatttttctacaatttcatggataaaaacagattcatggccagaatgcgtaaagcaactctattgtacaattttccactctgagatattcacacagcggagagcccttctactcaatgcgtcaagaacaatgttccaaacctagtgtattttaggtatattattacgagagtatccgcaatgttaatgacgcaaaatttaatggctcaagccaactactaacgttagtaagaactttttgatctaataattaaacaggttacatccatagatttacgtcagaaatcttaaataatgtttacatgcgaacagtaccaagatacatatatgtggagcggatgagagataaaattgggttaaatgggaaacattacggtatgatgcataattttgagtttgggcttattatcctcgtgcgtattgtatcgtctcaatatgagtgaagataaatcacctattacccgaactttgaagagaacactctgaaaatttggtgaataagaaagggctgtaggtattattcgcgaagctttcatttattgtagtgaaaactagggtgacagaagctgatggtctgttcttcgatttagtactgccaatttcaagtttttcacttctatagctttggtattggtcattgtagaacaattttataatgcatgaacacaaagcggagctacggctaataaccgttgcacttaacgaagcatccaccgattccccctcttttagagcttctgtcaattatttccataccagaatggaatctctgagtagttggatgcacagtactgtggattatgtagaaaatacgtacaagccttcgttccaagacttccaaagaataaaggaaacactattttcacagctgctcccttctcctatattactctccaatggatttgtcagtaaccagccatatactcccttgcttgtaagagactttactagagatgtcagtgacctttcaaatacggttatgaaaataattttaggtgatgaaaactcacaatacactgcggcattgtctgctttgagctctgatgctattaacccttacttcaacaagagaaaaacttttgaatactaccaaaggaagtatgattcgtttttaactgactttttagcggccactaatgatggcaatactttaattccacaaaatctgcaaaatgaaacattcaaattagtcgatattaaacacaaatatatagaagcttccttggatttgactgaggctatttcgttaatgaaagttaatttggataaattcctgatagagacaatagacattgtgcgcaaaaataacgttattactaccaaggacaccaaggacgttatcgacattactcccgaacttacggaaacattaaaggattggaccgattggatagaaagtaaccttcagactttacaagcattgtcatccaagctatctgaagctaagtatgccattctgaagctcagcttggcaagaatgaagccatctcgcctgatacaagactatgatttgaaaagcatacaaaatttgaagtttaaccttccaaaatcgataagtaacggaaataattctgaggaaaaagggctatcgggttggttgtacatgaaaactacagttggtcatgatccgaaaagagttgtgtgggtaagaagatggtgctttctacagaacaatgtttttggagttttttcactgtcgcctagcaaaacttatgtcgaagaaaccgataaattcggtatattatggataactgtagaatatctgcccaaagaacctagaaatttttgtttcaaattgaggattcaaaatccaaattgcaaaacagaagaagaaaatacatacatagatatcatcctgcaagctgaaagtattgacgagttaaaatcgtggataaacaccttaacttctcacaaaagaatcgcattgtcgataaaggaggaaaacgatcctcgttatcaattggcgagaaaaaaaattgaacctcaatttttcgagtttgcttcaagtagctcaacgtcaacagataaattattaacttcattttccagtaaaactttgacattggtagaagagctaaaaaaaaattatatgtcagaggatgatatatactctatcattgataataaggcataccatctgagagtaatttctacaccgatagccacgcagttgactcatttggctttattctctacatttctatctgtatcaaattattatccgtgtgctacccaggcaaacacctggggtacggcaaattggaatgatttgtcctatttagtcaatccactcaaaggaagttcagtacacaagccagccacagtatcgaattcttccaggttttccgttagctaccccgactattatccatacagcctgaaagtcgatgatatacaatttagatcaattttcttttcagtgaatcatgattttttacaagtcccaaaagaacttgttcttttaagatattcatcggtgtggtgcccgaacaataaacaaaaatttgcatctatggcttttgttacccttaaccacatttatgtctatttaaatatttcaggcttttcatatttgagaagaatagatttactagatatcgactcaatcgaatatgataaaagcccaaaacatgtttcttcaagaatgctgcacatgcaaagaggcgatggactcaggtttaatatgtccgtcttttttacagatcgaagagcagttgcctcaaagttacaatttctgatagaaaataaggcaatgcatatcccaaagggcgaaaaagaggttttagaaattttccaggaattagacgaagagattgagaacgaaaaaaaaatcatcaaagataatttgtcagaatcagaacattattcaaaagattatgattatctattgaagagcacgtatgaccatcattttgagaatactaacgaaacgcctatggaattaatgagcaggaaactccgtttagaaagggaagcctggtgctactttcaagacaattttaaagtcggaagcaagacgctattccacgttctttttggagacaaatctcaagtttttccaagttcactatttctttgtaagaagggcagtaacttgaataacaattcatactgggagcgcattaggcgcgcgaaagaagatgcaagttgtcaatttgaactttgccgtaagttacagtttcaactgaatcgaacttctaattttatcaaagatctattatggttgaaggatgacaatgacaacttcaaattagttcttcagcagcgtgtgacaaaaataaaacaaggttattattttgaggtggaagaaggtcccattattgtgaaatttccgctatgccatcccttactccttcgtgtgaggttcataattgcagaatgtatcacctctcaaggagagtccctcaaaaaatgtgacctggcaatactatatgacttcaactatgttgaatctattgataagttgaataccaaagttgaaaaactatggctttttgaaagaatacacctcaactgggcattgagatattgtaaacttgaacattctgaaattaacagaaagacgagggaatatctaaaaaaattcaacgatagagaaaaaatgagtgatgttattaaattgtgtggattccttggtgttttaccaaaggaaagaatagaaaacgatgaaaaggccggcgatttcatgcaacctgtatatatcaattatgattttctgtctctttcaaaaatttttacaaaattgaccgtgttttatttaagcagtgtcatcattaagaccatgaaagttttactggcaatggtaatggttatcttcaaatgtttttcaaaagttaacaaaactttatactattgtcttttgatatctgcggtaaccaatttgttctttgttggtaaatctattcattcatatttctccgtaaagtcagccgaaaccctatttcagaactatgccaatggtgatcagcgaggacttcaaatcatgcatcggtctttgacagtgcctgatttgaacctacttacaagaaaaatgatggataatgaccaggaaaatccagtattcaagagatttgacgaagacaaaaatgcataccagtacaaaggaacaaggcaagaaattgcaattaaacgaaaccaagtgctgacggaattaaaaattctacaaaatacggaaaaggaactcgtacagggaagttacagaaaattcataataacagaaagagacaaatgcatcaccactcagaatgaaatctttgatttatggataaacgataccaaactacaagattattgtatggcatgttttgcagagtacaacagattatctgccattccagtctgaatagtgccccagaatgtctactcttcaataatcagaaggaccccgtcttgtctaatagaatgggtgaactttttttatttcttggctcatgattatattgtaaaatacatagcattttatataattgtggtgctaaccctaagtacttttttttttcgccctttccgggtttctttttttcaccttttcgtttttctagaatttcgcaaagtatataagagaccataaacagttggagaaaaatatcacaaatttatcagcccaatttatggcagcttaaaaatgtctaggtcgatgctttcaacgatatctttatcaggtgattcttacgcgccaggtggatagaggaaatttgcgacagtaggtttactgtcctggtttccttgtacacttgtgatactcattttttgtctgccaataatatagtcctgtttatttgttatatgatgataaccttctcagctcactcagatcttttgatatgattgataaaaatttcctatccaacattcatcaatttatctgaccaaacaataaacttagtactatatagtctcgcaggcaattctcttgaataatttcaacttttatatcttacatgaaacttaaacacgatacatgtatccagttttcatctcgatctggttcgctgtgaaattttactataacactgtttttgaagtaggatttttgccaataagacatttcatagttcgtgtacaggccgtgatattcatctaatttgttcaaccacttgaagccccataactttgttttatggttaactattctggaggagtcatcgaaaatttcctcttctatagcatcctgaacttttaagcggttatattcatatacttcactgaatccctttttttctagtatattgatcaaatcagataatagctcgattccgtgaataacatatttcaatgatttgttcttttttgaaatggcaatttttcgcagcttgtttaacctgcccaaggattccagtactgtttcattctcatcaacaagaaaaaatttcaaaagatttaatgcttcgtggaccatataatgtctcgaattctgcgttttgacactttgttccttttctaagcgatttacctcctctgtatttatgacatcattcatccattcctcattatcttgttgatcattttctgtggcgttttctgtcttaatataattcccatctttatcgaataccccatgttttatttcgtcatctatattaaatggctctatattcacacctttttctaccttgctctctgaattaccgatctgataatctaagtcggctaagttttctttcttgaactctgcaatatccaaaagctgaattttcgatttctttcgctttctatggtcttcgacgtgatcttcatttttttcataggatttttcatccatttctttcccactattttcattatctgtagaatcttcaacgctagaatcagaatcagaatcatattctgccctgcttagctcttcatcttcatatatcgtactttgattatgtaactcatcgctaagcttttcgtcgtgttcacgtcgatcactatttcttttcagttttgagctgttcgggtattgcgtatatttcatatccttctacaaacaatatggtgcacttgagtgtttttatcaaagttttcccttgttctttaaaaggcagcttagcatggtcattccaatttgttcggatgcgcttcttttaatctagtcagagaaacttacccattaagtaattaaaatcgattattagggcataaatggaagaaaaggagactatgttggtagaatgtaaaggaagggaccctcattcacaaacaaggcagggacttttatgttactactgaatgttcatggtgatgagtgataatgtcctttagctaatagagtaagccacacttattcaaaggtcaatttggagtaggcttacaaatgtagtcttttctttcataaaccagtagtgttaaactttatgtttcttcaactttgacgcacaatatttggcggctattttccgctataccaaataaaatatatcttttgtataagaaaacaaactgctgaagaaaagaacatacagcaacttggacaacatgtccatcgaggaggaagatacaaataagatcacatgtacgcaagactttcttcaccaatactttgtaactgaaagggttagcattcaatttgggttaaataacaagaccgtaaaaaggataaataaagatgaatttgataaggcagtaaattgtatcatgtcatggacaaactatcctaagcctgggttaaaacgaacagcttcaacgtacctcttaagcaattcctttaagaaatctgcaacagtatctcttccgtttatcttaggcgacccagtatgcatgccgaagagggtggaaagcaataataatgatacctgtcttctgtatagtgacacattatatgacgatcctttaatacagaggaatgatcaagcaggagatgaaatagaggatgaatttagctttacattgctacgaagtgaagtaaatgaaatcagacccatatcttcgtccagcaccgcccaaatactgcaatcggactattctgcgctgatgtatgagagacaggcttcaaatgggagcatatttcagtttagtagtccctgagatttagtttgatatcgttagcataagctatttgtcacgttactatttctctccttcatttattcttccatgatatataaatttttgtcaagagtacagttattattatattatatcattattataattgttatgattactattaatattattaatgtttattatcaatgtttattattattattgttattacacatgaaaagtgaaatttcattacgcatattgtcttttatagtagatcgctgtcagcatcttcattaacttgtttggtgttattttccaaattcaataatctctttttcaactctaacacttcacttttcaagtcatctctttcttgattagtgatgaagagttccgctttcagatcatttattttgatgttgaattgattttctcttatgctgttgctattttttacattattggaactctcctcggtgcttctgagaccattttcgaaattttcactgcagacgccatttttgaacttcaattcatctaactcgtcgattaactttttattcaaactcttgtacttctctagctctctttgtgaaaccattagtgccttacttgcactgtccatagaactgatactttctttgtaatcattctgtatttttttgatttcattctcttttactaatacatcttgacttaatgagctgtgttccatctttaaagcatggtattcagaagatagtttttctttagatattgttagctcttgacttctctccagcaaatcgtccaatctattcgttagtttgttaatcactacacggtggtgacgactttgatcaccatagggttcaccgacagttttctcgccattttcatccgatacagatatcaaagaagaagaagattcaagaaacgaagagttggctctgttttctttccaatgactgatcaatgagcctaactgtgacgagtaattcgcaacattattgattatatcttcgttatgttgtttgctttcatttttcaacctttcattttctctactcaaattctcatgttctatctgtagttcttcaagtttttctttgtaattaggctctagttctaaggatttaattttttcgttctgaaattgtataacttcatttagattctctatgtctaagaatttgctattcaccaactcttctagctcattaactttatcttccaaggaatgattatctgcctctagtatttcacattttgattgcagtctgacggaatccaattcatctatttctttcgttgtcccagaattcttctgggattttaactgccatagctccgtctctaattcctttatgtgagctccggcttcaagcgccttttcgtgcgtcaattctttcaaactttgcaattccgatcttaatttctcaaatagtgccctatctacgacttcggtagtagcatctctatttataggaacgctagcttcttcatttttcgtatcagttggaacgtctcccattggggacacgtttttttcatcacttgcatcaataacatggttagcactatcatggcccgcggtgtcgcttttctttattgtaatatccacaggctcggacagtttgtcgatctccgtattattctgtgataattctgaagattcattataatgctttattttgaactgatctttggatggggagctcgccatttgagccacaccgatttcgtcgtcttcgtcagcaacattgccgtcctcttcaaccttggacatcgaagatgtgcctagtttgtccccgtttatctcttggtcgaaggtcgtcgtggaatctattttttcatcagcgtcaggaagatgttttatttcctctatattaccattttggggcgtttttatctcattacttggaagcgtctctaatattggggagttattctttatttggtttgcaggggtgagattatctccatagattgaagatgggatgcgctgatttccaactgttggatccatagtttcagaaagatcaggttctttctggatagtaggcgtatcaaatggtttgttggaagttattttcataaccggcgtttgtgagctttcagatggaacatatggagtcaaaatgttaggctcagcaatcaagtgagattcagaatttactgggtggctctgattttggtgttctgttgacacatttcgattgtgtacctccctgttgaggcgatcagcatctgaaaaatcttttggtgcaggtgatggagcggaagctagaggagctgctgaaattggtacgttcatatttttagtttgatgagaggttggggtaacgggcgtcgccaggtcaagattaccatttctcggagttggcgtatcagttggaacatccattacgcctggacaaaggtcctttatgcgggccaagtctagcgtataaacaattgtacctctttgcatatcaatatcagaggtatgcaagtcgtactcctcgactctagcgtaatcaaatttatctcctcccataatcaaaattttatcattttttaataatgttaaagaatgcccagaacggccttgcggaattccagccgtaaatacaggtaatttaaaccatttacgcgatttcaagtttaggaaatacacggagttcaaataagcatcatgctcatctttcccgcctacaacacacatcagatcgttgtagactacagtagcatgttcttgaactggaggaggcttttcacccgtggtatcaatgataaaccaatcatttattgcagggtcgtacataaacacatcatttactaaaccttgtaaggtatcgccaccaaatacccatagtttagaatcgtatgatatcatagtaaaattggtaataggtggtggtgtaaaggtccttggtttcaaaaattcccaatgagagtccggtcttctaaaagaagataagtcgtaaacagccaagtcgttgaagtaggtgtcatcaaattgaccaccaaacacgtacagttttgttttcatttgagttgtggcgataatcgaaattttatgaccgtaccttcccaatggacgtggtcccacgggtgccgggactgtccatttataggaattaatattcaaaaggtatatgtcatcgtccatcaaaccttccttattgactttgtgtgtgtcaccgccaaatacaacaaaggcattcccgcataatacagcagcgtggcctacccttggtggtggtgtagcttcacttatgtctatcgttgtagtggaaaatctggtggcattatcgaaggccgttaatatccatgtatcgccgtacacagattggtcatgaagtcccccaataacatatatctggttcttgtctgtaacatatgctgaagcaacatgtctataacgtggaaaaggagaattctgtaacttgattctattccatacggtatattctctctgttttgaaagctgcttatggagagtagtggacggtcctgagacatttcgctgttgcggtggtactgcgctcggttgaatccttgattcggatacctgttttctggcaaacataggtggtgaactagttttattaacattagaatggtaaccttgtgaaaattgacgccctttctgaggcgtttcttgttttgtgaaaaatttttcatttggaggagttgacagtgaagcttctctagattggtcagagatagaagcatcagaaggcgtctttccatgtttcttgtgagtgaatttcttggcgaagctgaatccagccatgtttgagttattttctaggtgcaaattgaagcaaacgggctctaacttttcctgaaaaattactgtgaatttgttaataagtgtaagtatcacaaatcaagcaaaacaattactttatagaacgagccctgttgcttttctatatcttattgtttcgtattttaaaggaatgcttgcttgtagtttactatcaacaaccgcgtcgccaagtccccagaagacgtgccgcgtgattccaaaggtgatgaagggtacaagttgtaaagttcaatataataggtaaggaaaaaggccaatactaactgtgcttttctcaattaccactacatggatccgaggataattaaatctatctcctagggcactgatatgaataaatttgacgagtttatagagtctaatgagaaggatttggatgtggacaccagtacccgaaatagtataatttcgatgtcacctgtgaggaaaactggacgaaagattcgttctgctagttccaatggatataggctagaacaccatcgtacgtccagtgcgggaagcatgcattcgcaaagactaatgacgcctaccagattaaatgaccaggaccatcccttacaagccaagccagatgctaggagggtggtaactcgtcattcttctgtctcagttccaaatgcaatgagcaagagaagatcacttattcaacccatggttgttcccactacaccagaatctcaaaacaacttaccttcagtaagtcattctgagggatcctatggaatcccattagagtcaaccactgtactttctagtgagcaagcgatggccagcggacttcgacggtctagaaatgggagttcgcagtcggttaatagtatgatagcgaccaccataccaacaaatggggtcgatgtaagtgcgcttctacaatctctcgctacaaaagagttagaacttctggaatgcaaacaaaagattgaagatttgaaaaagcaaacccagcatgaagagcaaaactatactcgtcgggcacgtgaactgcatgaactcaaggagcaagtgagtaaacatttggatccctctctaaatacacctgttaaaaaccgggctttttcaccggtttaccagaatatacctttggaatcacgaactgaaaatgctggtaacagcagccttcctagttctgtcagtaaaccaaagaacatgggtcatcaaagtactaatcagtcaagatctgtgtctccgcaagatattcaagaaaggcgccaaagggacgactcgtcagattcatccaaacagtcactttggagcaaaccattagctctgtttaatcagtttgataaaatcattcagcatgaaattgaaagaactctgaattgggatgactctctttcaggtacgcctgaggtacaggaagggacaccgactagtaatagcgagtcgtccgcgcaacagtacgataatgaagcacctggagctcgccaaaaatctccttcgcaaggatcagtctccaggtcgctttggagctttgttagcgatgtcaaggccggattactcggtatagaagaagaaaacgataatgatgttattactgataacagatgtgatcctgtatataaaagcgatagacagcatgaacagaaaaaaagtacacataaaattacgaaccgggggcaagcagaagatagtggcgacgattctagtttaaacatgaggaaatttaaaacgacaactaagttccagaaagacaatgctgggaataatagtctcacagatgaaagtggacatcgaacacgagaaaaaaaaagtaaaagaagtagtaacaagctaagttttattggagaacccgataatgataattcctccgtcaaaaactcagttgaaatgacagacttctaattcctttttcaaaatgacgtttattcttcacttgtcactctttttacgtatagctgtgaacgcagtatgtaatttaatactgttttctcttgaaagtggttaaaaagtgttatatatctgaaattcatggtttaaattaaagaaatttcaaggcccgttaagcaattctgtcttcaacatcatggaactcaagaccagcccagtttcctgaattctgaaaacaaaaacctacgtgtttttgaaggtttctttctgtaccgttatccttctttaaaactatagaaccatcactaatgctgcccatcagccccataaactttgaactgtttagtctttcttttacatctttattggcactattattatcgcaaaactcaattatatcggaagccaaacctttcatggcagtttcttcatcttccagactcgtacctgaattttcctcttctgtatggacatcttcttccaaactactggcttccagttccgaaaattcagcattaattaaagaatcaatgtggctgttgataggatgttctaaacctgttgtcttgaatatctgatggtcaaccacagggaaggaagcaatgttaaagtttttctgtgaataaaagcctaagggaaaatctgtctgagatgtccgtagcccgttgtttatattaagattcgcgatttgattttcgatgggcggttcaacattcttagggaagttatatctaaaatccttggcccaagaagtttcattgtcatttagatttggcgcttcaaatttgtaactttgatcctctaaggttctaggacgaatatttacgtaggaccgtgattgattcaaatcttctgagtgttgtagaaatttcagctcaattttatccttcagaatcggtggtgaattcagtctgctcccgattttgttaaaagagagcgtattgtccctgcccgtaaaaggccccttttctgtactactaataaatttattcacctcattcgtttggcatcggttactattcattgtttgtattttatatcatttgtccattgaagtttagacaagtatcaaatacccagttttcgtcttttcccttatataggtcgtctcggaaataacaatataaactccatggtgcggcgctatcgaaatcttttgttggcgggaggaattgaagacagtaagatgtaagtattacatactataggacaaatgcaaaatatgtacaaaatggcaaaaattacatagctcttccttacaactatatatagctatccaaagatgcacttgagtactcccttacatacctgattatactagatattacatatcaattaaattgaggttgttagcatattggtttcctaaaactggttgctgtgtttgagactgttccggttgtggttgctgttgtggatagaaagggaaattttgaggttgaactgtcccagttatatttgtaacagggttggctcctgcagttgcaggcacataataaccctgttgtggttgctgttgttgctgttgctgttgttgctgttgctgttgttgctgttgttggagatgattctgagtgtagtgagcctgaaattccattttatcaaaacgctgaggaatattcatcgatccctgcatgctagtaggggttgtcataacgctattgatcgagctcaaaggcattttttgttgttgaaattgttgttgattgtacgtttggttttgaaaagggttacttattatctgttgttgtagcggcatattggtattttgttcatcaaagtttggtcgtgaaaatgggttatttaagacattttcgtgtgcaggattccctgttgcgatcgtcgcggcgttgtgcaatgcgaacgggttgttagaaccagtttgtgaatgagagacttgttgattagaagcggcagttgtatcctgtgaaacggagtatcctccaaaccctgcacctgtaaatgtgggtgttaaatggttgttaatcgaatagtaccccgtttgttgggcacttacgccagcatcttgtacagggttgaagttcactgtgtgttggaccgctgcatattcaggaacgtttaaatttgcgggctctgtatgagcggttggtgtattcatcacctgtggctgagtttgagatacaaatgggttatttgcgatctgttgcgtttgattagccacagccattggaatgttagtatgcatagaagagtctgttccaaacgggttgtaagattgagccgccgtgacagtagttagagcaggggaaatcgctacttgttcgtttttcaattgtgcctctagtatccttttttgttcccggatttgctccaacctttcctgtgcagtagatttggctactacggccccagcacttccttgagaactgtcaacgggcacaaaagtgttgtgcgtcttatcatcctctatcagatgttcttctagcgatctgaccagtttggtagtgatatgcttgatgacgggtattttcaagcccgcagtcttcccgctcttcaagtacctgacaacgtgctcggtcaaatcaacaaacgtcttgtacaggtctagagttctctctgcattatgatgagatagttcgaaaaaagactccagcagagttatgataccttcgttgagagcattatatagcgctagcaggtcttgaataagcagcttgaaaccaaatatgatcaattcgttactcaaatcatattgtgtatacttgtttttaatcagggcttgtatttgtacctctagggactccacatgatctagtgctatattgatagagtgttgcttgtttctggagcttccgtaattgccactgttcagcttcagtgttcgatagccgtctctcacatagtcctttttgattttaccaaactccctgcatctcaccttcagataattatcgtatctatcaagtgccctcatgtctccagacgcactgccattggagccacgtatgttttcaatgtcaaaaaactccaggttcctagagtagtaccgcaatgcaacatctttggaaccctcccttatcatcaaatgaaccaccaacagcgatttatacacaatagtccacgccgtgtcattaattcgggaatccaaacccttcacgatctcatagaaatcctcttcattgctggtccccaacagtatcggatccagatacttctgtttgggcggggctgacttgatcttggtagcaccttttaccaacttgaaatatgttgtcatctcgcctcaatcgaaatttatactctagtatctgcgatatcgaacagtccctttatatttacgagacaggttttgtccttcctcccccaccaaaaagacgctataaaatactaaatatatctaatatcgctactgctcaattcacctaacgaatgattaccaccaagcatcaacaccatgtgcataccataccgctaactaaactcaccaacgctggaagcctgaataccaagtatcgaactgaggcccctgtgttaccaatccgtaaaaagtgatggaacccgccgctcgcttccaagagttatcatcatattcttcatcatattcttccatacttaaggtgggtagcgaggacccctcaattcccccacctctctgccagggcgtcatctttttctacaaaagccaggctgagtcacgtcagttgctgaccctgggggctgcattgtttcctacgaattactcatttgtttcgtgcgctttcctattgcgcgcatgactaggatggaaaaaaaaagaagaaaaagaaaagcgttgagtatataataagaaagaagaaaaagtccgagagaaaagaagcacaaaggtttttcctcgaggaaaacagtaaagtttgatacgcacatcgttgacatcgctgactgcaataggaaactgaaatagacggcaaaccattagttcattcgaaagaacgtattgtcgagaattatcactcactatatcagaaaattgacacacgaattatataaacgaagttatacagaaaaagattaaagaaaagaaaaatgtctacatcatccgtacgttttgcatttaggcggttctggcaaagtgagacaggccccaagacggtgcatttctgggctcctactttgaaatggggtctggttttcgctggattcagcgatatgaagagaccggtggaaaaaatttctggtgctcaaaatttgtcgctgctatctactgcgctgatttggactcgttggtcctttgtcatcaagccaagaaacatcttgttggcttctgtcaactcgtttctttgtctgaccgctggctatcaattgggtagaattgccaactacaggatacggaatggcgactctatatcgcaattgtgtagctatattctcagcggcgccgacgaaagcaaaaaggaaattactacgggcagataaacgccgaatttacaactcgaaactttgctttgtcaaagatatgtacgtaagcatatatatccggattgtataatattcataaaatagtaaagtatattttctttgcgcggtgttataatttgctcttttgcatttttccgtttttttcttacctttttatccccgacaatggtaatagtggtatattatataaagaggaaaggcctcgaggataatagaaggcaatgcaccatcaattgctttacccctggtccgcgacaaatggtgacagtcggtgtgttttctgagagggctagtttgacccatcaattgggggaattcatcgtcaagaaacaagatgaggcgctgcaaaagaagtcagactttaaagtttccgttagcggtggctctttgatcgatgctctgtatgaaagtttagtagcggacgaatcactatcttctcgagtgcaatggtctaaatggcaaatctacttctctgatgaaagaattgtgccactgacggacgctgacagcaattatggtgccttcaagagagctgttctagataaattaccctcgactagtcagccaaacgtttatcccatggacgagtccttgattggcagcgatgctgaatctaacaacaaaattgctgcagagtacgagcgtatcgtacctcaagtgcttgatttggtactgttgggctgtggtcctgatggacacacttgttccttattccctggagaaacacataggtacttgctgaacgaaacaaccaaaagagttgcttggtgccacgattctcccaagcctccaagtgacagaatcaccttcactctgcctgtgttgaaagacgccaaagccctgtgttttgtggctgagggcagttccaaacaaaatataatgcatgagatctttgacttgaaaaacgatcaattgccaaccgcattggttaacaaattatttggtgaaaaaacatcctggttcgttaatgaggaagcttttggaaaagttcaaacgaaaactttttagaaaagacacacatgcgagctttcgaacctcagatgctaatattacgtgttatatataccaaactttataaaatgacatagatattttatgctgtgatagctttcctgttatggagaagctcttcttattccccctgtcaactttcatactcttgtagaatttcctttatgataggtttatcgcttacgaatttagactttgatgtgatgggtttggcacctgttctttttccacaacctttgcgtgcctcatcaatagcgtttgatctgtcgggaaatttgtatttgtagagtgcatccttgcacattgtatagacccaattacgctcttctaacaggttcacgaacgattttatttcaggaacagagccgattgtactttttgaacctataatgatcagcttggatttggcccttgtcatggcaacattgactcttcttagctctttcagcagcgctcctccatttaattgagaatttcttctaaccatggaaataataatgcactttttgtcacgaccttgaaactgatcagcagtcaagatctctagcccgtcatacacatttttgttgaatatcttcttcagtaatcttaactgtgctctgtataacgtcattacaccaatatcttcgcatggtacgccgctcaataacattccttccacacattgtagagtcaattctgcctccccgtgattcgtaatgttatccttttcgctttgttcgataatatccgggcagttatcgtaatttaaaaataccacttttcttgtaggctctagtatatcctcaagccactgcttagagttagccgattcattcctatagcgcgacaaggcctcaggcattggtaactctaaagattgagcaaaaacttcgttattcccgcattttaatttattatcataaattaggaaattagacaaagttacaatatcgccgcacatacggtactgtaaagtcagttctgcaacgctttccggatgcttttcacagaaagtcttgaacagtgactcttctaacccacctaatcgagctgcgtcatttttaactaatggcggtagctggtaatgatctcctaccataataaacctatttccataccgcagaggtcccaaagcgacaggcattgaaatttgacttgcctcgtccaaaatcacataatcaaaatccttttcatttagtgtaaatagtatatcgttaattcctaagcaggtggtagcaacaacagaggtgctgttaattttggacaaataatcgttataacttttcactgacgcgtaattcgggacatatttttgcgtgtcaggatggaccttatgtttcattcccaatctcattatgctaatgttggtgttcctcaattttattaaaatattatccactgctgaatgtgtgtatgatgtcaaaagcacgcgtttcccctcggaaacgagaattttaataatttctgcgataacagtagtcttaccagtccctggcattcccaatatcaatgcataatcttcggccctcattactttgtctattgcttctttttgattcaagttcaatgttgtatcctttgaaagcttatacggaatgacgggatcatcatttgcatctctaaacttaggtgctctattatcaactaaaagtgatcgcagtatttcattacctccatcagatctctttgtcttccgacataatttactcctttcgtcaacaatatccacgccaggtgaaacagctggtaaaaacaagcttaaaagattaaatcgcgctaaagacaaactctgttggatatcatttttgtcgattctatatgtgaccaaattttgggtagctatgagactggattgttctagctctgattcgaccacactttggatggtagtgactcctttttccttatctagaagcctattgtttaataactttcgttttacggagataccaattttagcgggatttataaattgtacacgaccttggcacaagcaaaaatgaccctcctcatcactaataataacaaagtcattagcagcaatttgagatgataacatcgactgcgagttattatcatttctacgtcttgagaagcaatatatatacgctccctctgttttttcatgttcaaccacctctgacacaaccaagccagaaaggcaccttccacttctggattctcttgtggaaccatccaataagaaaagttctttatttacacatgttatacttgactcctccttagttattagatcattatattttgtaaaaaactctttgtagttggcgagattttgcgacaaatggtttgtcaaaatttcaaactcaccttctaccaggccactttcttctggtgtcccgtcctctagtagcttattcaacaccatgcatgattctttgatgaaacatgaatcacaagatgaatcgcgcagtaagggtggtaattcaaaccttgattgagcctgtccgaaaacctcttggagttgatgcttaaaattcatactcattctatttcgggacatgagaatatgtttaatggagtgcagaacagaagggaactttgtcatatttttatccctcgtaaaataaagaagaaaaaactctatcggtatctcatagcgatcatttaacagaagtgtataaataaggccttgaacctcgtatgaaacgcttctggattttccagttttcacttctaaaggaacgatgtgttttttattgttttcaacattagcttcaacagttgcatctaggaaccctttaagaccatatattggagaccaaatgttttcttcaatatcaatcacattggatatagaaattggctgtgttcttcttgttccggaaattgatgtgtagcaaccatagttacttttcgaaacaaatttattgacgaagtacaaaatgttttcagcatgttctttcataactaattctttaacgtactggatttcttcattacaaatgataattgaaaaagaataagtttctaacaaagaatccagcttttgtattatgatttccatagaaattttattatgcgagagcttgtatttgattgagtcttgcaataactcgtgtacgatattgcctaaagtcatgacaaggcttggttctccgcggggatcttgaaattgcatttgcagaattgaacgtcttaaacaacctactgaacttccgactgatgttgccgaaaataatacatcagggtttagcaccaacaggttgtcgttagccagttgagttttagggtttttgtcgtcagaaagaagccgtttgttttcaatatttttcccttctataatatgtattacatccccaacctcaaattccaaatatacccaaggatgtcgaacgacaacagaactttgttcgcctttgccgtctatacactctagtattttttgcgttccaatttttggcaattcaacactacgtaagcttactattactaatcgtactacgccgtctcttggagcaccagacttagctctgagagcatatgcggataaagtggaatcagtagcaattctcaaatcgtcagagaccattttctccactttgtctaaatcttgttcaatagtgttaggttccacttgtgtttgagtttcgttcaatagttcaattagtgaatcgtctgaaaattcgtctgaagaattgtattctattttttcattttttttaattctttggcaattactgtcttcttcattctcataaaatgcattgcctgttttggcttgattgtctacattttcatgatcttcaatttctcctctcgattttgtgttatcattcttcccacaactttcctgggctccacttttttgattggtgttgccttgaattgttatctgactctcactcttgcgtttctcaacatacttttgagttaaaatatctatcaaagagtcatcgccatcgttgctatctcctgttgaatccattttatctacttcttctgcattcacctctgcttttttttcaacgttgggtgccttgatgggtgaagatggcaaatcgctgaatttcgttatcgtcggttttatagttaaatcgccctctatatcatcgagaatatcatctatattacggagagactccctggtagatatttctgctggtttaggacgcacttgctcatttccattttcttgaatgagttgatttacgtcagcgttgggtacttggatatttgtgaaactaagaacagttttcagtcgattagggactataggtgtagaagagggattttggacatcttcgtagtcatcagagtattcggcagcgcttgttgttttgtcggacatatctcgttgtaaaggtgaatatttccatattacttcttccatggggccgtcctcgtcttgagtgaaatcgtgatgcctactcaaattagacatttcccgtttcggtttaacttgtgaatttggtaattgctttacgctcttgctaactgctttgtttatatcttttgttcttgatgtatttcgtacttgtgaaacggctattgactttaggacacttgcattggataccttggtgttcttcccatttaagttatttataggagcaaaagcatacttttttttcctcttagtttgcttagataatatcgcctttgaatcattttgtattatttctttttcctctgtcttcttcgcaggtgaaacagatatactcgcagacctcttgttcttctgtggcgttccgggcatcctgacgatctcttcaattgtcagtgtttgcttgcacaaaatgagtactcacttgagtatgttttctcccaattttgttttgaggctgccgtaatgattgtaactttatcttcaaaaatgtaacacaagttttgccataaatagcgtaagatcagttaaatatatataagttctttctgccgcacggaattgctttattgcgcgaaatgaaaacaagaatatccaatttctatatgaaggacataatggaatgggagtgacaacggaccattttctgtccgaacgatgtctatctcctttggttactttttgaaatagaatcacagtcaatgaccaattttcacatacttatagcttttcatagtgcggaaagcgtagctttgaagtagttccgaaattataatacatcatcgtgtggtaggtagcaactacgacgggcataaaaaatgcgttgaatattatacatacaaacttatacttacatatatatctatgaaataacagattccagtttattggggaatatattcagctaaatacatcgatttgttcggcctctaactcttcgtcccccgccaattcgctaaactgtaaaaagtgtactggacgatgcatctcattatagaattccaaaggaatgccgtatttaaaattgtagtcaccttcttggttaaatgctgttcccataaatgtgtagttccaaacgtttccagatggaattataaaattacctgtgatacggtcagagagaagtaattgggcatgcgtgctgaaagtaggctcaaacccttccgatagcacgttcattatatccttattttcttcaccccattggtaaccttcgtcggtcaggttataagcgcttaatgatactgatcccggggtggaaaaaattgaaatatcaatgcagtctcttttcttatccgcaaaaagtttagaatgagttgctacttcagacgcagccatgaatttaagttcttctgtctgggtatggatccaaccgagtagttcaaggccttcagtatccggaaggtctccgatgtcagggatgttgcttatctgaacggatcctacgtggcctaattgaggtaccagcacaacagtcttgatttctttcaccttcggatgatcttttgctgacataccataaataaaggccgccacctggattttcacatcggatatctcaataaacttctttaataaattttttggaaggacgtaaacattctgttcctccacgaaatcatcagccgaaacataaatgttttttaacctcaaatataatagtgtattagcaattgcagattttctccattcattctttgaactaaacgtttgactttcgtaatcagcggaagctactacaactatctcctcaccttgcgcattgatagttttagttttcataacagttgatgcacctgcagcttcttcgtcgttctgcttttctgacctggcagcttctaattcagccattttttgtctcttcacagatggtgccttgatattttgacccaatataatatctttaatttccgtttgagttaaggcagatatattgacattgtattttctgccgtactcagtcaaaatcaaatctctcatttgagattcgatagtgatccattgttcatcagtgaatgaaggccataaatggtacgatttgatagtgatcgtggggtcactgagtagaatcattttggcactttcctcgttcgtctttaaagctcttaaaagtagtgtaagtctagaaaatgcagtgtacgatgaaatacggtctaaccaatcatcataaatgttaaacagaaccatctgaggttcagtagctttcatcacaacatcagaaagtttatctattgacattgcagctgaaaatggtagtcgcagctctgttggcctgattgctatgttaggaaagtcaagcatgtgaacctctaaaggatcaagcattgcctttcttgtgacgataatttgttttggctgctcttctttgggcaaagatctcacaagagcactaacttcctcagctgttttccatttggccaattggcttaaacgtttttgaccggcccatacagaggtatggataattttcagaaacagatgcccagtctttggatttaaagtgaaaatgcaaccattaattgcttttgtagcaacgttcccttcaaaagtcttgtggacagtaactctatacacattagtgtcgtcaacgaagagtttaatgtcgttattgaataactcggcatagtttgaggagtttaaaaatggttcctgtacactagattgatatatttgaagaccttttctaatacgttcacgaaggacatataatgctgggttagctttcataattgttctcatactattttgtatcaaaggttttaatccgttgaaccaattaccataggcatcatacatgttataagccaaatcgataccgatcataacacctgttggggagggatacatgctgacattatctgttgtataatcgaggaattttgccctcacataacgagatatatcatgagaatcataatcaccgtatctcaattgtacatcaaaccacattttgttggtaatcaatcccttaaatgagtcatttgtttcatgtaatagggagggttttgaaacttcccattcatgaacactttccatagttatgtcagcggcagatgaattcatcttgtacgatttgcggggatgcactgtttctttagtcacagattcaatttgcaaaacatctagctcaccatcgagaatttgacaaatatcaaaaactatactttcatgtattttttgccacaaatgagcacggaatatttgaattaaagatatttttaacgtaggaattttaccatggaggaagataccagtcagatccaattgcaccaagaaaccgacatagacatttgctctgttaatagttggtgaccaccataaggtaaatctacgatttggaatttggcttaaaccagttctttgagcatgagttagcttcttaaattgcatggaatcctcaaacccggacgccttttcccaaaacaaaccttcccatgaattaaaaccagtccccttaaataaagtgtgttccaaaattgtttcaatacctcctagggcttgaatcacatcagttctataggcatttaaattccataatttaccgtcatggtgggagtttgtccaccaaaaggggctgtttctctctagagagtactgtttaaattccctacggattctgtgacctctgtcatacgctagagtatgtcgatctctttgaaataaagtgctaatacgaggtataccacgatcccacgatccttcaagttcttcaaaagctaacctcctattctgctgaatagcttcctgccttttcgttgcatactcggcccacaccctttgagagtctaaaaattcattttcccaagtagtgatgtaacggaagatagttgggattaatttttcatcctcgtgcgtcataccagcacgaaaatgcgtaattccagtatcggtctgttttgaccaacttaagtcagatgcaggaattaaaatatgagaagcactaatcatacccaacccaccaagttcttttggtgtataaaaaacagcaggtggaaatcttgttggcattttcgaatttaaaccaagtttgacacggttttgaattcttgtttctcctttcaccaggatatctaataacggctccgtggcaacaatggcttctctaaagtatgtgaaaagggatatcagtgaagtgttccatttagcggccactttagtaaaagtggttgaaccggaggccatcaatatgcctcttattctgctgtcaaattttttgatttcttcttcagatacctttaaatatgcttttgcagttctttgcttggttctttcgtcaactaaatcccaaacaccttcatcgttagaaaccacctcttccattctttgtcttggtaatattctgacttcaaaaccacacatagagaagagtaagttcggattgtttttactgtatacggaaacaaaagcattttcccatttaattgacgttaacgaagttggcaccctactttgaatttcccaaaacactgctcgccctaggttaacgtcctgacgtattagcctcatgcgcgaatctttgggccagcattttctattattgtatccgatgctgttttcaaagtttggatctggattctctgccaagtattcatcagtcaattcctctccctcatcttcttcaaagtgaaaaagcatatatatacgatctaaatatctggtgtaaagtctgatcggatgtgccttttctacttctttgctcttgaattgcataaattcatttggattgttagctggaccagccaaatctgtagccctttcctgacccaatagtaaaagatctataactagtccgtaatattggaatatgaaagaagcgaacttcaacccgcgtattaagccatatttgttgacgtgactcatatctttaaagttgataacaacattattttttgcagtgatatagtcagcaatattaggatctacaatcaggcgaagtaatctattaagtaaagtaaagtcaattttttcggccatttcacccaaagtagtctcaagcaaaactgcagattggcctctggatacatcccaaatttcagataggttgtttataccctgagtccacttgtataccagaagaggtggtatctctgaatcacttggtttaatccagtttgggaaaagctttcgttggtcagcttcgtaccataaatactgatcaagatatgcatcggtaatcttttccaagggatcaactgaataaacaggggaaatgttttgatagttttccatcatggttatatcaacaggcttaaaaactcgctgggtcaacaagtactttttgattctgttcaaagtatcgtgaggattatcataagcctcctctatcaacgcaagttcttccctttcagatgcatttaaacgtacttttgatgcgtagacatcttttaggtcttcgagggcaagaactaatatcttagtatcatttttgtaagttaaaggtggaaatggtattggtgaaaagctccttgattcaagccactcaaccataacagaaaatatggtcgtagcctcttcgggagtaatttcgggaccgtttttctgtatttgcctttgacgttcctgctcatttttgatccaaagtctcgttaaacgccccagattttttttaaccatagtcttttcgacgtgagctccacgctttatacgttctcgattgtaatgagctgcagatacccaggcatcagctttggattttatataccgttcaattatttttttgattggggctggcataccaggaacatcccatggaatattagccttccaacatctccaagcctcacttaaatgttgcagtatagttcttgcctttttctgtcgaatactctcaggcatcatttctaaaatgtcatccatgaccgagtttcgtaactcaagatcgtagtaggcgtcaagtctttgtttagttgtagttttgacaatttcattagaacggccttcaaattgacgtgtgataaggtttccaatatatctttcgagtagtggtatagtgcctcttaagaaatttagccacactctccacgcaggttgccaaaatccacaaccaggtccttttcccaaatttttattaaacttataatatatgatatgtttcagatctttacatgcgcggatttgatgcattactttatatttataacgataaataccggtcaattgtcctatgtggttcaaaatataatgtataccatctgctaactggaaggcatctacatttcctaacctaaactgcacatgtgtatctacaatcagtttcatcatttttagcaattcacgcatcaaatgaaatgagtttccaagtcttgactttttacgttcttttgtggttaaggttttagttggttttaaattgaaattgtagtcgagatgtaaataagttaggccctttctgtggattaataaatttaacatattgtgtccttgtcgacatagctggagtcctgcctctacccaatcaattgtagtttgttgaaaatacttggtattttttaaactcttcaataacttagttttgttgtggtttgttggcaaagtagggtgcaattcatttagcacgtagttcttcaagagcttttggtaagagaccttaactttaacgggatactcctcgtcaggatgttgcaaaaaccattttttagccagggcaacatcttgtgctctcaccatttttcctttagttctattaaatggaaaaggtgaatgatataacgacatcgcatcttttgtatttggcaaaataagttcttcttcttcagccaaaagaggtgcaaaatcttcaggtaaagtgaaatcaccgttttcctttgtatttgatacgttgagggatgaattattatcaataaagtgaggtattgggttcagcgatggatcaaaaaaaagtgcaggcgtgtcgtactcctcatcgttctggataatacacgacactggattattataccatggtatgcgcactgaacggggccgggaattatatagatgaggaaacgctaccttatattcgcttctaataggaaccctaaatattactctatctatagagttgaattcgttataatcttcctcctcttctcttgggtataaaggttcaaatttaggacctccagggattgcgttattaagggctttaccgttaaaaaaagattttttatcgaaaagataatagtaatttttgtcagttacttcatctctaagtggcgttgataacctatataagttcgacatttcaggtaaatcaaaactccactttttataagatgtaccattgacctttttactatcctcctccaagggccgggaatcgtagagccaatctttaacatattcatcatcttgagagtctaagggaagatttataggatccagtggctcgatattttctatgtgctgttcatatgacagaggtggttcgtcatcatcgaaaggtggaaatctcattcttttaaaatgtgttctatctcgtttttctctcctcattgctatccaagtagctgaccattgggcagtatatacaggctctattactcttggtgtttcattcacaaatgttatggctcctgaagtgtgatataaaactttaacttctttggcttgctcccatggatgaggcatgttctctaacaattttaaaatcgcgtgcggtaaatactttagagcgcctagaaaagcctttttatcagtattgtacattttggaggccatgtcactgtgagtattaataatctttcgcagatgttccggtggcatctcggctttaggagtatataaattgcttctctttgcctttttggtcattttttttgcacgctttcttgattttcgagtgacgaaagtatcttttcctatgtccaattttctctttccatgtaattctactttcttttctgctttagtctctaattcatctagacctggagggggtggtggcggtggtaatgtgaagtccacaatttcttcagcgtttatttcgaagttgcttggaggaggtggtggaggcggaaggaatgtatcctcatttaccgatgatggcaccatcggattatccagttcttcgatttcgtatccaggcggtggtggtggtggtggtggaagtgctaagtcgctgtcctcttcaaaaccaggaggtgggggcggtagtccactcatctttctttgacgctattttttttttggaaggaagttcaatcgcacaagtattttctatggtcttcgtttctcaaattgtattcctaactttgttgcttttgtactagccgtattacctcggttcatccttctgccatggtcactttaaatagctatatagcctggcatttataaaaatttcatatcatttagtacgaatagctatgtgtatgttcacttcactacatatgccttctgcactcccgagccagcatacgagcctcttcaatctcttgagacgttccactagatacccccatggcataatcataagccaattggtagtttcctgccttaatctcaaatattgccagccaaagcctagccttcacggtttcatctgttactataccttccagaagttcttccacatctacacatttcatcatgaacttcttacattcttgcaagtcttcaagttcttcatatagttgcgctaaccggtaatatattgaagtattttgatcgaccgtttgtgaagcttttatggatcttttgtagcattttatagcttctaccttatttcccgtcttactataacattctcccaatacttgccaaatccgacgatcccaaggtttcaaagtgcaagctttctggaagtagtaaagagaatataaatgcatgtccaggagagcataagcctggcccaaaccaaaccatgctttgaagtctcgagggcatatatctacggcccgacgatagcattctattgcggcatgtgaattgcttagttcaacaaattcgtgacccatcaaagtccatgcgtttgttgtttttttatccaaagttagtgctcgacggaaatacatgatagatttttcatgttcctgtcgggcactgtaatagttcgctatgatacaacatgtttccggtctaaatctatctatttgggagacgaattgcgccaaataggctaattttgaattcttctgcatgacgtatagaatattggagtaggtttccaaatcgttgagacggtacggatcttgtttaacgatgtcatcaaatcggctttctgcggtaacataatccaaattgttgtaactaatagtagcattgtaagcctttaaaaaagtgaaattggggaaaacttgtaacaaaaactctaaatcttcaaagtagtcctctaactggccattaagctcctcaaacacttttagcttgaaaaatttgatcattatattaaattctatcgttcgttgactaccaagattttcagaaaatttgaattggaaattttgatatagataattatttaaaagcaatgcatcgtcaaccttttgtaaacagtccattaactccagccagcaggaccagttaaaggagtagcaactcagagatttcaagaatgacgacattgccttagaaatattcttctcttgctttaagatgacccctcgtaaataatacaacagtgctaaccctaaatcggcctcatcatcgtctatctttatttcataagactccagaaatgtgttaatttccttcaaaatagatgatatgttcgattgtgactcatgctcattgctgaccatttttaaattggcgcgttggtgcccactttgatttatatcctcattcccactaccatccccatctttgttagctctgtacatttcgtccgtaaacttccctgtagttaagatattttccatactttcctggcttttcttatcccacgatagaaatttactgtataattttaagaacttaaggtatggattagtgacatcttttagaaaaaaaacgcatcgatcaaactctttagcatcaaacaacgtagaaccaaggaggtacaggtcatactcagtctctgataggccaaacccgttttgtggtatttcaaacatctgtttcggtacaccttgtttatttcttagtggcgattcatcggctaaagagtgtgtttgatcaacatcaatagcttctgcaagacctgctagcgcctctgctgcccactttgaggagccgtatagcttccatcgtgataattctgtggcagcctttcgtagctgaatacgtatatcatgtattattttatcctggctgtcgtcattcatggttctaaatgcttcacaatctgattctgatcagtatatatccagatttcagttttccgctcgctaatactcccttcttcctcttaatttgatgtgagtaccgcagtacttggtctgctattatgaagtgtttgttttacccgaagtgctttttatgtacgcgcattgaaaaataatagaaacttggtaagtagaatacttaagaagctgcagaagtgcagtatcttacagtaagaaacaacagcgactagtttatcaggtttacactgctcaagttatcaagttcatagcatgacaaaggaagaaggtcgtacgtattttgaatctctctgcgaggaggaacaaagtttgcaggaaagccaaacccacttattaaatattttagatatattatcagtattggcagaccctagatcatctgatgatctgcttactgaatccctcaagaagttgcctgatttacacagggagctgataaatagttccatccgcctgcgatacgataaatatcaaacaagagaagcacagcttttggaggatacaaaaactggaagggacgttgcagcgggagtacagaatcctaagagtattagcgagtactattctactttcgaacatttgaatagggatactttaaggtacataaatttactgaagcgactttctgttgatttagcaaagcaggtggaagtgtctgatccatcagtgacagtgtatgaaatggataaatgggttccatctgagaaacttcagggtattctcgagcagtactgtgcgcctgatactgatatacgtggtgtagacgctcaaatcaagaactatctagatcagatcaaaatggcacgtgccaaatttggtttagagaataagtattccttaaaggaaagactctctactttgacaaaggaactaaaccattggcgaaaagaatgggacgatatagaaatgcttatgttcggtgatgatgcacattctatgaaaaaaatgatccagaagatagattcattaaagtctgaaataaatgctccatcggaaagctatcctgtagataaagaaggtgacatagttttagaataagcacattttatttaaccagcctgcacaagttagatagagttatacatacttgttgagtgggagggaagaaagagaaaaattgtattattttttaaagagctttttaatattttatttgttctatctattattttcacttccccgaaatagtactgaaggaaaaaacatgctggtttatttagcgtttaataggatgtgtacgtactgagaatatcatcaagaatcagtcctcggccagagcatctagatatgtcgatagcttggtctagcgttttcaaaagagaattacggcttgaaagatttttaccaagagtatattcgacgaaagttcctgataatgcaccaagagcggctgacaatgaacaatggctagaaaccctaagacctataactcacccagaacagaaaaagtccgaccatgatgtcagttacacaagacacattaatgttcctctgggcgaagtcacttctgtcaactatctacaacggtataataagcataagcatagccagggcaatttcgtggatgttcgaatagtgaaatgcaaaagtggcgctggtggaagtggagctgtctccttctttagggatgcagggaggtctataggtcctccggatggtggagatgggggagctggtggtagtgtttatattcaagctgttgcggggttgggatctctggcgaagatgaagaccacatataccgctgaagacggagaagcaggtgctgccaggcaactggatggcatgcgaggaagagatgttttaatacaagttcctgtgggtactgttgtaaaatggtgcttaccaccccaaaaagttcgagagctcgtggaaagagaaatgcgcaaagacaataatgctacattaaggtctatacttggctcaacagccgtcaacttaagcgtttcttctggttctcatcggaaaaaaatacaactatacagacatgaaatggcggagagttggctcttcaaggacaaggccaaggaataccatgagaataaggactggttcaaagatttacataagaaaatggaggcatacgaccactcgttagaacaatctgaactgtttaatgatcagtttccactggctggtcttgacttaaatcagccaatgacgaaaccagtatgtctgctgaaaggtggccaaggtggactcggtaacatgcactttttaacaaatttgattagaaatccaagattttccaaacccggcaggaatgggttggaacagcattttttattcgaattgaaaagcattgctgatcttggactcattggtttgcctaacgctggaaaatcaactatactaaacaaaatctcaaatgcaaaaccgaaaatagggcactggcaattcaccacactgagccctacgattggcacagtttccttgggttttgggcaagacgtcttcactgtggccgatatacctggaataatacagggagcatcattagacaaagggatgggtcttgagtttctaaggcatatagaacgttccaatggttgggtatttgtccttgacctctctaataaaaaccctttgaatgacttacaattactgatagaggaagttggtactttagagaaagtcaagaccaaaaacatactaattgtatgtaataaagtcgatattgatgccgagaaatccgaatcatttgccaagtacctacaggttgagaaattttccaaaagtcaggaatgggactgtgttccgataagcgccctcagagagaaaacatagatgtgttaaagaaaaagatgtttaagtgtgctcgtcagtctgaatttgacaagtagatctgtacaactcttcggatgttttttttcttttatcccattcagcataatattatagcatttagttttttgccatagaagccgtgagaagaggaaaaaaaaatttttacctcatcgcggattgtaaatagtaaatataaactggcaatttacttagtttttgaataaataattgtataggaatattatcagtcgtataatacagacgctttagatctccgtagcatcatatcagaaacttttcaagatggcagactttaaatctttaggtctttcaaaatggcttacggaatccttaagagctatgaaaattactcagccaaccgctatccaaaaggcttgtattcccaaaatcttagaaggaagagattgtattggtggtgccaagactggttctggtaaaactattgcatttgcagggcctatgctgactaaatggtccgaagatccgtcagggatgtttggagtggtcttgaccccaaccagagagttagccatgcaaattgccgaacaatttactgcacttggtagcagtatgaacattcgcgtgtcagttatagttggtggtgaaagcatcgttcagcaggcattggatttacaaaggaagccgcactttattattgccacgcctggacgtctggcacatcatatcatgagcagcggagatgataccgttggagggctaatgagagctaaatatttagttctagatgaagccgatattttgctaactagcacgtttgccgatcatttagcaacatgtataagtgctctacctcccaaggataagagacaaacacttctattcactgcaactataacggaccaagtaaagtcgttacaaaatgcaccagtgcagaaagggaaacccccattgttcgcttaccaagtagaaagtgtagataatgtggctattccatcgacgttgaaaatagagtatatcttggttccagaacacgtcaaagaagcatatttgtaccaattattaacatgcgaggaatatgagaataaaaccgctataatatttgtaaatagaacaatgaccgcggagatccttagaagaaccctgaagcagttggaagtgagggtagcgtcgttgcactctcaaatgccccaacaggaaagaacaaattccttacatagatttcgagctaacgctgcaagaatcctcatcgctacagatgtagcatccagaggtttggatatcccaactgttgagcttgtagtgaattacgatataccttcagacccagatgtattcatccatagatctggtcgtacggcccgtgctggcagaattggtgacgccatatcattcgttacccagcgagatgtttctaggatacaggccattgaggaccgtatcaacaagaagatgacagagacaaacaaggtacacgataccgctgtaataagaaaagccttgaccaaggtaaccaaggcgaagagggaatcgctgatggcaatgcaaaaggaaaacttcggtgagagaaaaagacagcaaaagaagaagcaaaatgacgggaaaagtttgcgctcttgaaaaattctaaataagatttaaagacgtacatatcgtacaatctggatactgttttccaggacaactgatagatacaattttggcacatatgaagtatgtttctatataacgggtgagaaaatcgctgtaaattcaattacgtacaatcaccgacgggtaacttatttttttttctttttctcttgtagttggaaaattttttgaagctcatcgcattggaaaagaaaaattactagcagttgtgatgatttaactatgttttgaggaaccttggctttatcttttatttgtcgcctggtacataacactacattttattgtctaataaacgttgaggaatttgacaaaaggatggaattcacacctatagatccgcaccagcaccaaaatgctgctactcttctatgttgtaactgtggtaccccaatcgatgggtccactgggctggttatgtgttatgactgtatcaaactgactgtggacattactcaaggtattccaagagaagcgaacatttcattttgcagaaactgtgaaagatttttgcaaccacctggacaatggatcagagcagaattagaatctagagaattactggccatttgtttgcgtcgtttgaagggcctaacaaaagtcagattagtggatgcttcattcatttggacagaaccccattctagacgtattagaattaaacttaccgtgcagggagaagccatgacaaatactattattcagcaaactttcgaagtagaatacattgttattgcgatgcaatgtccagactgtgccagatcctacactacaaatacttggagggctactgtccaaattagacaaaaagtgcctcacaagagaacatttttgtttttggaacaactgattttgaaacataatgctcatgtggataccatttccattagtgaagctaaggacgggttggatttcttctatgcgcaaaaaaaccacgcagttaagatgattgattttttgaacgctgttgttccgattaaacataaaaagtctgaagaacttatttctcaagatacacatactggtgcatctacttataaattttcatattctgtcgagattgttcctatctgtaaagatgacttggtcgttttaccaaaaaaactggctaaatctatgggtaacatttctcaatttgttctatgttctaagatttctaacactgtccagtttatggatccgactactttgcaaaccgcggatctgtcaccatctgtgtactggagggctccattcaacgccctggctgatgtgacccagttggtggagttcattgttctggacgtggattctacaggtataagcaggggaaatcgtgtcttagctgacattactgttgctagaacgtctgacttgggtgttaatgaccaagtctactacgtcaggtctcatctcggtggtatttgccatgcaggtgatagtgttatgggttatttcattgcaaactcgaattacaactcagatctttttgatgggttaaatatcgattatgtgcctgatgtagttcttgtgaagaaattgtatcaaagaaagagcaaaaagagcagacactggaagttaaagagaatggctaaggaacacaaagatatcgatgcatccttagattacaattcaagagctcaaaagcaagaaatggaacgtgcagaaaaggactacgaattattcttacaagaattagaagaggatgctgaattaagacaaagtgttaacctatacaaaaaccgcgaagcaaatgtacctcctgaagagcatgaaatggatgaagacgaggatgaagacgctccacaaatcaacattgatgaattattggacgagttagatgaaatgacattagaagatggagtcgagaacacacccgttgaatctcagcagtaaaaaaacaccaaagaatggagagtagtatatactcttaacaaacactagcatttcagtttatctatatacatatatatggatgtaaaatgtactttatggaagaacaagccaccacatgttgaaaactagataggcaagcaagatttttcatttgtagagctcttacgcaagatttttaaacttccgcttttttaatccatgagattcctttggacaccctttccggcacgcaaaacaaaaaaattaagggaactcattattttacgatgctacttagataactaaagttcattatatttcaacaaatataagataatcaagaataaaatgtcgtcagaaagggtcttaagttatgcaccagcttttaaatcatttctggatacatcttttttccaagaattatcgagattgaaactcgatgttctgaaattagattcaacatgccaaccacttactgtgaatctagatttacacaacattcctaaatctgctgatcaagttccattattcttaacaaatagaagctttgaaaaacacaataataagcgtactaatgaagtgcctttacagggcagtattttcaattttaatgtattagacgagtttaagaatcttgataagcaactatttttacatcaaagagcattggaatgctgggaagatggaataaaggatatcaataagtgtgtttcttttgtgattattagttttgctgacctaaaaaagtacaggttttattactggttaggtgttccctgttttcaaagaccctcttcaacagttttacatgtgcggccagagccgagtttaaaagggctgttctcaaagtgtcaaaaatggtttgatgtcaattactcaaaatgggtgtgtatactggatgcagacgatgaaatagtaaattatgacaagtgtattattcgaaaaactaaagttttggcgataagggacactagtacgatggaaaacgtcccttctgctctaaccaaaaattttctcagcgtgttgcaatacgatgttcctgacttgatagatttcaaactattaattattagacagaacgaaggtagctttgcattaaatgctacatttgcttctattgacccacaatcatcctcaagtaacccagatatgaaagtttctggatgggaaaggaatgtgcaaggtaagctagcaccacgtgttgttgatttaagttcattgttagatcctttaaaaattgctgaccaatccgtggatttaaatttgaagctaatgaaatggagaattcttcctgacttaaatctagatatcatcaaaaacacaaaagtactactactaggtgctggtacactaggttgttatgtttcacgcgcattgatagcatggggggttagaaaaataacatttgtggataacggtacagtttcatattcaaatccagtgaggcaagcgttatataattttgaggactgtggaaagccaaaggcagaacttgcggctgcgtctttgaaaagaatatttcctttaatggacgctactggtgtgaaattaagtattcctatgatcggtcataaattagtaaacgaggaggctcagcataaggattttgatagattaagagcattaataaaagagcatgatatcatttttttattggtggattctcgagaaagcagatggcttccgtcgttattgagcaacatcgaaaacaaaaccgttattaatgctgctctggggtttgatagctacttagttatgaggcatggtaatagagatgaacagtcttcaaaacaactgggctgttatttttgccatgatgtggtagcaccaactgacagtttaactgacaggactttggatcaaatgtgcacagtaactagacccggcgttgctatgatggcctcttctttagcagttgaattgatgacttccttactacagaccaaatactctggttcagaaacaacagtattaggggatatacctcatcaaatacgtgggtttttgcataatttttccatcttaaaattagaaactccagcctatgagcattgtccagcatgtagccctaaagttatcgaagcatttacagacttaggttgggaatttgttaaaaaggccttggagcatccactttaccttgaagaaattagcggtttgtcagtcataaagcaggaggtcgaacgactaggcaacgatgtttttgaatgggaagatgatgaatctgatgagattgcttaatattttgcatataatagcattggtacatattgtggtgccactttccgtaattaagctactaaatttttgactctaacgtttataacattgaattattaaaatgatcttgctatactattttgcatacattattttttgtagttttaacaagaagacaaattcttgactttactcacaaaacataaacataaaatgtaataaagtcctcaatgttcaccgtatttttcaaaaaggatcagtgaaagtgtcggtaaagctacctttttgatactttctttttatgagaataagttgtatttctttattatgtatgatacgggcgttcaatcaatacgttttaagttcgttgctgacggctaagaaattggtaagaggagtagttccatcaatgtctaaagtgatatgataaaaactatacgatttgaagatctatgcgttcacttcacgtatccaagtttcccctcctaataattcacattaatttggcattcatatctaaagcgttgctattacccttcccctggtagtcgcggaacaacaaaaaacgccaaaataagtaatgaaaatgtaaacaaaaaggaactaagttgaaaagtcatcgaaagcgataccacctggttctttcttcattatagactaattgttgcgtgccaagaagttgtttgtgtatccataatatttattatcaaactgatctaagattgctttgtacacatcttgcgtgaaaaaatggaaatcaaagaggtagatgacagggcagagctactgagatataccaacaatattccgttacttggaaagctagtcaaccatcaaccattatggagtacaaatcctaagttaaagtccttttcgctagaaaaaatatcagcccctgatcaaaggcgtgtacaagaggcattagttgtaaaagacctattaaatgtattgattggacttgaaggaacatacatcagatattttaatgattatgaacctagtgacccagagacaccgatagaatttaagattgccaagaaaatggatccatcattcaaaacattcagtagaagaattgttaggtatggtaagcaatacatgatattaacaagggcgtatgaaaaatggtctgacacaagctttgggatggttttgcaaagatttgcttatgaaatcagaagattcttagaagacgtctacttaaaaacgttagttgaaaggcttgaaagggactttaacaaagtgccaaacttttctatcagagaactagaacaaatcattaatgaaacagaagtaaacaaacaaatggagttgctgtacaatatttatgaagaaatttttagagaaatagaagaaagaaggacgaaccaatcttcacaagaagatttcaataattttatggacagtatgaagaatgaaagcagcttgcacttacgattaatggtagcatttgacacaacagtatatccggtacccaaaggtggtgccatattgaaaatttttcagcaaaaaatactggaaaatttgggtgataggtcaagcgtaatgtttttgaagaagctattgaataatataagccaagactattgcacaatgctgtatgaatggctaacacagggtattttaaacgacccttaccaagaattcatgacttatgatgatttggaaggtaagacggataacatatttgacacaagagacagagcgtgggatacgcaatacttcataagaaaagatgttttgttgcgggattgtgactcagaagaggataagaatctactattcaagatgttaaggaccggtattttactcaaagttgttcgagctagcttacaaatacccaccataccttctaatagcagtgatataaccattcaagaaatcaatgatttcgctgacttaatggagggttctaatcttgaactttacgtggataaatgttacagcagagccaatgaaatatttttaaagctattttttcaaggttacgatttgatcaatgtattaaaacatttgcaacaaatttttcttgggtatcaatctggtcataatgttttaaagtttctaacaaaaaatatgggtgagttgaccaaacactacaggaatgataataatgcaaactatgacaagctgctacaaaattttgagttagagagacaatccgaaaatccaaacaacctgatgaggcaactcctgatgatacagttcgatacagaaacacttccacaagtcttatcgcactacctccaaatttatccagaagtacctgagaataactcagcaaatgacgacagcgacccattgatgcacgcgaataatttcaagaatatgaatgccattctttttgatgaattaagcaaagaacgaacgggagcctaccatggatccaatctagaactatatactccaaaaagcgcaatttatcatttaaaatttgacatcaacataccttatccattgaatattattattagtaggacatgcatgataaaataccaaataatcctgcgctaccaactagttttacaataccactcaaggcttttggatgagacttggatggacttaaacaaaacacccagctggaaatacagaggctattcgcacactgtgaagaggaggatagtaagggcaacgagagtgctgcatgctaagatgaaccacttcattaaaaccatcatggaatatttcaaccaaaacgtaattgataaagaggtatactcattagaaaagtgctacagaaatcctactcttgccgttgccatccaaaatgagctagaaggtggattaacaaatataatgacaaatcgttgcttgtctgacttgattccactacagttacaaatatttgacattgtatataagttttgcaagttcatcaaatctatgagagcaaaattatgtcaactggaccccgtactatatgagaaacacaaaagcgggatgatgaaaacactaaacgaaggctatcgtacaaacaatggcggtcaggaagatgttggttaccaagaagatgccgccctggaattaattcagaagctgattgaatacattagcaacgcgtccagcatttttcggaagtgtctcataaactttactcaagagttaagtactgaaaaattcgacttttatgatagttcaagtgtcgacgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataataatggctgtctctaaagtttacgctagatccgtctacgactcccgtggtaacccaaccgtcgaagtcgaattaaccaccgaaaagggtgttttcagatccattgttccatctggtgcctccaccggtgtccacgaagctttggaaatgagagatgaagacaaatccaagtggatgggtaagggtgttatgaacgctgtcaacaacgtcaacaacgtcattgctgctgctttcgtcaaggccaacctagatgttaaggaccaaaaggccgtcgatgacttcttgttgtctttggatggtaccgccaacaagtccaagttgggtgctaacgctatcttgggtgtctccatggccgctgctagagccgctgctgctgaaaagaacgtcccattgtaccaacatttggctgacttgtctaagtccaagacctctccatacgttttgccagttccattcttgaacgttttgaacggtggttcccacgctggtggtgctttggctttgcaagaattcatgattgctccaactggtgctaagaccttcgctgaagccatgagaattggttccgaagtttaccacaacttgaagtctttgaccaagaagagatacggtgcttctgccggtaacgtcggtgacgaaggtggtgttgctccaaacattcaaaccgctgaagaagctttggacttgattgttgacgctatcaaggctgctggtcacgacggtaaggtcaagatcggtttggactgtgcttcctctgaattcttcaaggacggtaagtacgacttggacttcaagaacccagaatctgacaaatccaagtggttgactggtgtcgaattagctgacatgtaccactccttgatgaagagatacccaattgtctccatcgaagatccatttgctgaagatgactgggaagcttggtctcacttcttcaagaccgctggtatccaaattgttgctgatgacttgactgtcaccaacccagctagaattgctaccgccatcgaaaagaaggctgctgacgctttgttgttgaaggttaaccaaatcggtaccttgtctgaatccatcaaggctgctcaagactctttcgctgccaactggggtgttatggtttcccacagatctggtgaaactgaagacactttcattgctgacttggttgtcggtttgagaactggtcaaatcaagactggtgctccagctagatccgaaagattggctaagttgaaccaattgttgagaatcgaagaagaattgggtgacaaggctgtctacgccggtgaaaacttccaccacggtgacaagttgtaaagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcgggccacgaccacagtgatatgcatatgggagatggagatgatacctgttcgatgaatatgctattttcgtggtcatacaagaatacgtgtgtcgtctttgaatggtggcatatcaagaccctgcctggactgattttaagttgtttagcaatttttggtctagcctacctctatgagtacttaaagtactgtgtccataagagacaattatcccagagagtattgttaccaaatagatctctgaccaagatcaaccaagccgacaaagtgtccaatagtattctatatggtttgcaagtgggattctcattcatgctcatgcttgtattcatgacttataatggttggttaatgttagctgtcgtgtgtggggcaatatggggtaattacagctggtgtacttcgtatagtcctgagatagatgacagctccctcgcctgccattaagatggtgacaaatattacaaatttgatactatttgtatctattttgtttttatccgggatttttcgtatttcttcctcattcatacccttccctttatttgttcccactgagtataatgataaactacgttaacattacatgtataatatttagcactcgtacgttactagtctttgacacaagtttatatatccccccctttatgttatcgtttattggctacagcctcagtaatcaaaatagtccactatttctatatcattaacttctgcgtcgccaagatgttaatcatgaaacgatctagttcttcaacagtttgccagcgaccattcgagctaatcttgaacaaaagtaatactatttaagggtgggcgcgggttgttataccgttttgagacgatctactataacgttatatttaattatataagtgatgaatttaatgtcccgtccacaacacgaaatcgcacctcatttcaacgcggcaagtattaatgttctgctttatgaaagattccatgaacccttttctaccttttaaattcctcttttcactcttaatcacatgatattacctttacataggaagcgccagacatctttttgccgagaaaagccattatgcaagataatcctgtagcctcatatcaaggataaatgccactgcaaaaacgcagtcgttatttgggactgtatttaaatgggccactgtttttatacaagtcgaaaatacaataatacagaaaattcaagcaggaagcgagaaataacaagaagtaactaggcatgacagtgaatgacaaaaaaagattggcaatcataggtggggggccaggagggttggcagctgcaagagttttctcgcaaagtcttccaaattttgaaatagaaatatttgtaaaggattacgatattggcggtgtctggcattatccagaacaaaaaagtgatgggagggtcatgtatgaccatttggaaaccaatatatcaaagaagttaatgcagtttagcggctttcccttcgaggaaaacgtccctttatatccgtctcgaagaaacatttgggaatacttgaaagcctattacaaaacgttcattgccaacaaagatgctatcagcatccatttcagcaccgaagttacctacttaaagaagaagaactctcaatgggagataacatctaaagacgaactaaggactactaaatcggattttgacttcgttattgttgcgtctggtcactacagtgtccctaaactaccaactaatatcgcaggtctcgatctatggttcgacaataagggcgcctttcattctaaggatttcaaaaactgcgagtttgcccgtgaaaaagtcgttattgtggtgggaaacggcagttccggccaagatattgccaaccaactaactaccgttgcaaagaaagtatataatagtataaaagagcctgcgagcaatcaactgaaggccaagttaatcgagactgtccaaacaatagacagtgccgattggaaaaatcgttcagttactttatctgatggaagagtacttcagaatatagactacattattttcgccacaggctattattacagctttccatttatagagccctccgttagactggaagtgctaggtgagggtgttactggcgacaagcactcgtctgtcaatctgcacaatttgtgggagcacatgatctatgtaaaagatcctacgctgtcctttatcttgaccccgcagttggtcatcccgttcccgttgtcggaactacaggcggctattatggtcgaagtattctgtaaaagcttaccgataactacaactttcgactctaatgcctgcggaacgcacaacttcccaaaggaaaggacctggaatactatgcagaactacaggaactactgaatagcattccacgtagggtcggtcatttcgaaccagttgtatgggatgatagactgatcgatctaagaaacagtagttatacagacaaagaagaaagaaatgtgcttctagcggaacacgcacaagccctaaagaaaaaaaaagcaccatacttcttccggcgccacatacttaacgtaaaaaggaatgtacttgtatagaaaaaacacatattgtgccgcttaatatttcgtttccctcatgtatataccttatcgctgttaaaataagaaatcttcacttctgctatctttttttttcaaacattgattaataatccggccgtccgcagattgcttacgcagaatataccgtaccgccaccgtaaaattaacgaatacttaaatttccgcctcttccgtttcggcaatagcgaaccttaatgtaagtttttaaaaggcagcgccaaaaattgctctgaaaggcctgcagtgcttcgcggctacgcagttcccatgtaaaaaaaaaagaaaactttctttttgaatctggaaaatccgcacaggcgcgccagcataaacctcagtatcctgcaaaggccatccttttaaagatcttaacaacgtatgaatctgaggcagagagaaattaagcgataaacgttccttttagactttcactttcttggccgtcatttaaaaaaaaattatctaataatctctaattttaagttgaaatcacgctaacatatgactatgactattaacctttttatgtggaaaaaaaaggaagaatatgttgtaaacgtattttagccttgttcccggaactttaatcactctggcaactttttaagtagtctgtctttttctcggtcgtatattcctcaaaattcaagaggaaagaggaagtgaagaagaaagcctagaaaaaaaaaataggcattaacacaaaaacgcacctaagggactgaggaaaatcaaaaaaatgataattgcagttagtaaatcttcataatcgacgcccacttattctttctttatagtaccgggtaggcgggtaattcatacgtagctgctgcgggagaactactatgtatcattccctgtttatttgtatgaattattatttaatacgtacattcttgtaagcccttcttcaacaaaacaaacaaataaagcgagaaaaaagggaaccacgaattaagataattaatcaaacaatagataggaaaaggagatcgacgagtaagcgtaagaatgatggatatcagccctacctgttatgggtacatcgacgacgagcaagatctagcccttgttttccagggcgtattcaatggaaatttgagatgcatcgaacggaggccatatgatgcagaaaaggttgaattagtcaaccccggaaacatttttgttttcaacgaagagaaatccggcatcaaaagatggacagatggtttttcttggtctccttcaagaatttcaggcaaatttctcgtatatagagagtataataggctgggttccacgcacgatctaccgctgcataatgtacctgagtataatatcttcgagagggctcataggaagtatttttatactggactactgaaaaaaacattttctctaaaattcaatatggatcccaccgacagcactaagctggaaacatttcatcttattgcgtactatacggaaaaggatattcatcaaggaagtttgaggagaccttcagaaaatcctttcttccataaatttcgaccttcacagaaactattagatgctttacaaaaagttgctgtaggaaatggcagatctaacccgtctaaaaataatgagagaggcagaaccaaagctcataattataaaacgcgcaggtctttatcatcttctccgagctattgtgatctcttgagcaattataacaaccatcctggaaatattccagttaggaccgcagttcagttacctttaaccaccttcaataacgctcctcgagaaatgcaccaacagcagcaccgacaacagcaacaatatctcttacccatagatgaacagaataaattacctctcccgtatatgcagcaccagccacaaccaattggtgtttacaatcctaactatcagcctggattgagacgtacggtctcacaacctatgattttctgcaatacatacaatactctcccgcaacaacctactgcagcaccttatgaacggcgtggcgtgtcgccttcagtgatatactcctccaatacattgagcccaataccataccaaaatatcgatccatactcttcgaggtcgggtcctgaatgcaatcactctaaggcgcctatcgccccaacaatgatgcccccagtacaccatatacttgtgcatgattaccgacaaccaaaaccagtcacagattctattaatcctccaaatgtaaacataaccacctccacaaccaacaagaacctagatggcatttatattttgccagctcctcgtatgaatcccccggctcaaacacaataccaaatgattcatgcgccagacagcatgcaacatccaccaacatttagtaaaaacaacacatcaagcaatcctaaatcccaccaatactcaaagtagaagatcagcatcctttcaattgctgaaaggttcacctaaagtaccgctcatattccaaaaggattcttcactacatagaaagggcagccaattgtgtgtttttcagaaagggttttaaaaaaacaggagggtgcttgttcttgttgttccctaccatcgatggatttcgaaaaactatttataggaccatctgattttcacctccatcattgtatcatatactaacaagcatatccaaatttgtaattctatcatgaaatttccagagaaagaaacgcaagggaactgagaaatcaaacctaaaaacggttcttggcattgttatgaaaaatgaataaaccaggggggcaaaacaatcgagaaccccaatcaaaaccatgtgagatacccacttcgaaagttactgatattataactcttgtgtcctctcttctaataccttactttcacctttctcacgtagttaaagttgcaacaacacattttgtcctcatccaatttcttctatagaatatccgtttgcctccaggagtgaagaaatgatagcagtaacactgtgaaagcgagactaagagaaacgacttaaagctcgaagacttcttgaggatacgtttatgtttctgtggcttcttcttcgcggcgcggttctcgcgtataggaatgttctaagacaagaaggcatgaagttatgttaacagattctatatctactcgctacgcatatataaacggattcatcattgaaacaatggtacttgtggtaatgtgtacgacgatttcaacccgaataaaagcaaaagtgcaaaaaaaaaacaagaagcgcttagcactgttgaatcatttagaacactactaatgctggtaatacactcaagaatgaagagtggcttactccattgttgatgcaaaagttgtaaatttcacgaattatttaatgcgttccttgcaaccttctattttgatgaacatcaggaattgaaacaaaaaaaaggcttcaatctcaacggaaaacgggaagaaaactacactcgattatactatatatgccaagaagattctccgacagattgtctacttaatttcacataatatatcttgttttactagcttattatatagcgtcgcatttaattcatggcgccatcacccgcagggaatataacgacaaggccgataccacgggaaaaatagggcgagcggaaatactaaaagaaaaataagcttccgaaataaaacaccgacaatgaagttcttggcaaggttcggttatttcctctacgtaacaagaggtataatatccgagcgtacagggctaaaaaattaatacaaaggtgtaaaagaaggacatggatggtcccaattttgcacatcaaggcgggagatcacaacgtactactgaattgtattcgtgcgcacgatgcagaaaattaaagaagaagtgtggtaaacaaataccgacatgtgcaaactgcgataaaaatggggcacactgttcatatccaggtagagccccaagacgtaccaagaaggagttagcggatgctatgctacgaggggaatatgttccagtgaaaaggaacaagaaggtaggaaaaagcccattgagcactaagagcatgccaaactcttctagtccgctatccgcaaatggcgctataactcccgggttttcgccttacgaaaacgatgatgcacataagatgaaacagctaaaaccgtcagatccaataaatcttgtcatgggggcaagtccaaattctagcgaaggtgtctcatcgctaatttcggtgctaacatcgctgaatgataattctaatccttcttcgcacttatcctctaatgaaaattccatgattccttcccgatcattgccagcttccgtgcagcaaagttcgacaacttcatcattcggaggatataacacgccttcaccactaattagcagtcatgtgcctgcgaacgcccaagccgtaccgctacaaaacaacaatcgcaatactagcaacggggataacggcagtaatgttaaccacgataataacaatggcagtaccaacacaccgcaattgagtcttaccccatatgcaaacaattcagcccccaatgggaaattcgattctgtgccggttgatgcatcctcgatcgaatttgaaactatgtcctgttgctttaaaggtggtagaacaacatcgtgggtcagagaggatggctcgttcaagtcaattgatagatccttactggacaggttcattgccgcatacttcaaacacaatcaccgtctatttcccatgattgataaaatagcattcctaaatgacgccgcgacaattactgatttcgaaaggttatatgacaacaaaaactaccctgacagctttgttttcaaagtatacatgatcatggctattggttgtacaactttacagcgtgctggtatggtttctcaggacgaagagtgtctgagtgaacatttggcttttttggccatgaaaaaatttcgtagtgttataattttacaagatatcgaaactgtacgatgcctattgttgttgggtatttattcgttttttgagccaaagggctcctcgtcatggacaattagtggtatcatcatgcgattgaccataggattaggtttaaatagagagttaactgccaaaaaactcaagagcatgtctgctttagaagcagaggcaagatatagagtgttttggagtgcttactgctttgaaaggctagtatgcacctcgttgggccgtatatccgggatcgacgacgaagacatcactgtgccactaccgagggcgttgtatgtggatgaaagagacgatttagagatgaccaagttgatgatatcattaaggaaaatgggcggtcgcatttataaacaagtccactctgtaagtgcagggcgacaaaagttaaccatcgaacaaaagcaggaaatcataagtggattacgcaaggagctagacgaaatttattctcgagaatcagaaagaaggaaactgaaaaaatctcaaatggatcaggtggagagggagaacaattctactacaaatgtaatatccttccatagttctgagatttggctagcaatgagatactcccagttgcaaatcttactatacagaccatctgcattgatgccaaaaccgcccattgactcactatccactctaggagagttttgcttgcaagcctggaaacatacttatacactgtacaagaagcggttattacccttgaactggataacccttttcagaacattaaccatttgtaacactatcttatactgtctttgccagtggagcatcgacctcattgaaagtaaaatcgaaattcaacagtgtgtggaaatactaagacatttcggtgaaagatggatttttgctatgagatgcgcggatgttttccaaaacattagcaacacaattctcgatattagtttaagccatggtaaagttcctaatatggaccaattaacaagagagttatttggcgccagcgattcatatcaagacatattagacgaaaacaatgttgacgtctcttgggttgataaacttgtatgacatatgttcaccgagttttgtcatgtcgtcatactatacggcagcggcttgttgctgccgtttaatgaaacagtttttttcacgacaagattcttctattgattattcacatatgtattttaatgaaaaatgagtactttataacacaaccctaatgacaaatgaaaaagttgattgccatgaactcttaaagcgatttatgagaacaattaattgattatatatatatatctttgcaattatgtcgtttgttgcaagatgcttctgaaagtaagtaactctataagatagataatgctacaagacgccaaacgcaagtgagtaagaaataagagctggcaggtcttcgccggaacactatcatcaaaatcactacaatttagcggcttagcacaatacgcgttttcaacttcctacgctagcgatgacaaaatgtctccaagaggcggaacttgcgacggatgcatggaaatatcttacgtaatgaacttccgtaatgaacttccgtaattcaagatctcttagcatctcttgttcaatcttcagactctactaagtgttcttaccaaccattggatgctcattacaaatgaatgaatatattgcacggaacggaagcggcatgctttttccgtctcgtgtgcttagtaaagcaaaacggagtagaatcggtaagaacttcctttttgggttggaaaatcattgccattgtttggacacctttctttttccgtattgttcgagcaccgcgtttctttttgggtacttgatgaggtagcagattcctggaacgtgctttctctcgaggtaacctgccttgttcctcctggtgactttctaaaatataaaaggaaaagcatatctctagtttcgagttttttcttcatactttatttccttatgttaaacggtccagatatagaataaatcatcatattaagctaaatatagacgataatatagtatcgataatgccatttgttaaggactttaagccacaagctttgggtgacaccaacttattcaaaccaatcaaaattggtaacaatgaacttctacaccgtgctgtcattcctccattgactagaatgagagcccaacatccaggtaatattccaaacagagactgggccgttgaatactacgctcaacgtgctcaaagaccaggaaccttgattatcactgaaggtacctttccctctccacaatctgggggttacgacaatgctccaggtatctggtccgaagaacaaattaaagaatggaccaagattttcaaggctattcatgagaataaatcgttcgcatgggtccaattatgggttctaggttgggctgctttcccagacacccttgctagggatggtttgcgttacgactccgcttctgacaacgtgtatatgaatgcagaacaagaagaaaaggctaagaaggctaacaacccacaacacagtataacaaaggatgaaattaagcaatacgtcaaagaatacgtccaagctgccaaaaactccattgctgctggtgccgatggtgttgaaatccacagcgctaacggttacttgttgaaccagttcttggacccacactccaataacagaaccgatgagtatggtggatccatcgaaaacagagcccgtttcaccttggaagtggttgatgcagttgtcgatgctattggccctgaaaaagtcggtttgagattgtctccatatggtgtcttcaacagtatgtctggtggtgctgaaaccggtattgttgctcaatatgcttatgtcttaggtgaactagaaagaagagctaaagctggcaagcgtttggctttcgtccatctagttgaacctcgtgtcaccaacccatttttaactgaaggtgaaggtgaatacaatggaggtagcaacaaatttgcttattctatctggaagggcccaattattagagctggtaactttgctctgcacccagaagttgtcagagaagaggtgaaggatcctagaacattgatcggttacggtagattttttatctctaatccagatttggttgatcgtttggaaaaagggttaccattaaacaaatatgacagagacactttctacaaaatgtcagctgagggatacattgactaccctacgtacgaagaagctctaaaactcggttgggacaaaaattaatagtgttaaccgtactttgtagcaccatttctttttcttctaatttatataattaatgaatatatatatttgggataaatagcctttaatgaaatattaacagaacttttttgcttgggcagcaacagatttatatctttgtggaaaggagtaaactgggctttcactttagatcattattcacataaacttcttttagaatatgtttgaatgtaaatccacaaaatggaatcggtcattctacatcatgaatattaatttaccttctttccttttatatgctgtcattcatcatcctattacattatcaatcgttgcatttcagcttccattaatttcgacgactgtgtcccaatcctatgtcatcttcttacaccgcgtgtaataatatagtagtaacatgactactagtcactatatggtagtttatttttatcacaacagattgaagtgtgcagagtttatatccctgcgttttatattgattagtagcataatgtaggaagttgatatgaatctgagagtgtgaccatatggtggtagaaatgagtttaggtacaatattaaatgcgatgtcaaaattccaaagtatacgctcgcacccacgcccactttcttccaatatactacgatataaatttatgttactatatgtgcgacagtttctactgcagacgtggattgagaacacgtaaagtttgtgctgggtagaaattgaaaggatatccccttaacggctgtgctaccgtttatgttcgtccttatcctctcctgttaaactgttataaaaatcgttacatatcttgcattctgtgaccaagtatttgttggccttagatttatattagggccattgcaattaaactggcttcagttctcaatgaacgaaggatttttggcacgctaaaactggtgtgaaggtattgcacattcaaataggctcttttattgatttgtcttgaaagcttttggaataagatctagaataaggactacccgaaaaagaacaggatacccagtaaaaacgctattgggtacctagagaagctggtttgtcactgtccacacaaaatgccctaataacattctgaaaggttctgaccgtacatcttcgcctgcggttgcattgaggtcgcctcggtcataaagtgaatatgcgacccgatggttgctcaaatgttaaatgcaggtaaaaaataagaccccaggaattaaatagtaagatttaatatatatatatataacgggcacaattcgttcatcaaacatgcagcggagtttcaaatttgctataatatagaacatgtttaattcaaccaatcgaaacgtacaggcgcacactatattcaagcagtaaaactactatctgaacattgaggtcgaatatatatattataggcataaaatctcctaccaaacttgcatcaaacctctaaaattactattatatattcaacttatttaacgtgcccaatggaaatgcactggataaccctcgttgcatttattgctacattcttcaacctagctgctacctcgatcaacaatagttccctccctgatgttgatcttactaatcctttgagattcttcactaacattccagcaggacttaattttaatgaagtcatttttctcgaaagaaacggattctatcttggtggaatagactctccctcaatctaccacttaataaatggtacagctgtgtattttggggatgtcagagataatatcatgccgggtacagttggcactactaggaatgttacagatgtcgactatggctccttactgacagagtatggttatgaagctaatacagattatgtctcgcgttggatcgccactcatgtagtaatctctccattgaatgctacagagtttttccaaacacccgtgccagtaccagtgccagtgccgataacaatactgcaccaacaggtgaactcaaaactacattagtcaggacccgttcagcccgttaatcgtgggaatctctgtactgagggtcaactagtgtatgcgactgtgattcagataataccttaagcgtcgaaacctcataccccctcatctggctcgggagccagtatactatatatatatatatatatatatatatatatatataaattcctaaaatactctcacacagaagcacaataatgagtgacgcaaatgcaatttatgactaattcatcaccaaagagaaatatgcagcgttaactctcaatctaagaatatgtaacagattttaatctcacgaactagcgactttaattgttgtaccttattccttagtaacgttagtagtgtctaatattttactagacggtgccacgatttcagagatgttagatcaaaattcctttcttaagaacaaggatatggcaaagtatggtaaacaagacgtacaagagtgttaaagataatgcatagaacacgctcagtgtaagcaagattagtacaactgctgatctggagccaagacaacaaatatcacatcccgtttgtcatgttaaagatagcttatcataagttagctgagacactcaacctcatataaaacaaaaactgattattttggtgaaataatgaatcttaaagcttgatagtatttgtattgaattactactcacaaactatttaaaacatcaagccaaatatatgcggagcacagagaaatatttgtgaattatatcttttgttggaaagacaagcaactatcctagcgacattaggattgccaagacatccggttttattcagacccttacatcagcagcagcacgttccatcttttcaaacttcctgccaaacatttatgaagacatgaaactctaaaatgtcatctatttatagtagtcatattactattatattattacatgcggtgtaagaagatgacataggattgggacacagtcatcgaacttaatggacgctgaagtgcaaggattgataatgtaatgggataatgaaacatataaaacggaatgaggaataatcctaatattatcatgtagaaatatcgattccattttgaggattcctatatcctctaggagaacttctagcatattctatatacctaatattattgtctttgtgaacaatggattcccacaaattatctcaaaattcacaaatatctcattctcgcattccaacagttatgttactcattctattcgtttgttatgtgtgttttatgaacgtttgggatgacgtattgtcatactgacgtatcttattttgagatacaacatagttgtatttttagcctccttagcttagtggtagagcgttgcacttgtaatgcaaaggtcgctagttcaattctggcaggtggcattataccggtattattttttttccctttgttcttatttctctatcatttataactttatgattttttaaaggttgaatggtcaatgtgaaaattaaaactaaaaacatatagttgacaagtgagaaaaagagcaaaagggagaaaagaaattgttagaataaaaccatgctgttagaattgatttcttatgcaggaaccgtttcagggtttctttttttaacactttcaattgcatcgggtttatactacattagtgaacttgttgaagaacacacagaacccacaagacggtttctcacaagggctatttatggtataatattaatattaattctgctactgttactagacggtttcccgttcaaacttacacttttttccattgcatgttacatagtatattaccaaaacttaaaaagtttcccatttatttcgttaaccagcccaactttcctattaagctgcgtatgtgtggtcttgaatcactacttctggttcaaatattttaatgatacggaagttcccccacagttcaaatttgatccaaattatataccacgcagacgtgctagtttcgctgaagtagcctcattttttggtatatgcgtttggttcataccatttgccttatttgtttctctgtcagctggtgattatgtgctaccaacgactagtgagcaacatatggctaagaaaaatgatgacatcacaacgaacaaccagccaaaatttcgtaaaagggctgttgggttagctcgtgtagtcatcaactcggtaaggaagtacatctactctctagcccgtgtattcggttatgagatagaacctgactttgatagattggctgtttaggattgcctttttttttaacatgtagttagtttttctttatttgaatattctaaataagaaatatgtgtaatgctctgccaactattttgcacaggaaagaaaaatcaccaatacaatactactatattttacccaagttaatacgggaaagtatattttcttttccatatttttcttttttattgacgtttgcattttttagagcaactagtaaacaaaaaaccagtcaggcccagtagattaagtattgtcattacatagacaaaggcaagagaaagagagcattttctttcggtctctagttatgtctgttaaagagcataacgaagaagatattattggtgatgaattacagaattcgaggcaactctccattgattgcgactcagttaaaatttcactaaggaacacatattggaccaaagactatacaacaggtatcaaattattcataaaacatatgaagagagaaaatgatttgctgattaaagacatcaaattttacaatgattttgtcaacaaattttggaaaccaacattgaacaatttacaaaaaatggaagcaaccaattcaatgaatagcaggctgctggaagtgatgagcaaacagtttaatataatatcaacagagcaagttgaaagagattgtaaaattccattgcaagaactaagagatcttaatgagagcttccttcgtgaggcagaaaacgatttgtcatctcgttattcagcttacattaaggatttagtcgcagctaaagaggcactaattggatgtgagaaaagagttcagtctatatataaattgaaaaaagccaatacgccagtggaaaattcttcctctgtttttgataatggaaaggatagtgcaccgttaaccaggttgaacttcgtatgcgagtttccttacactttagacgagaggttaaaatttgaggattgcgaccaatttatgtcatttttgcaaaccttgaagggaaaagtcatcctggagaaaagtgtcttttccgttccaggattgtcaaatcaaagtttccaaggcaggtcattgatcaaagaattgaaaaaacttgaacccagactaaacctgtccttatttaatatcgataggataggtaacgaattcatccaactgggtataatacaagaatattccctgagtttttactctagcaaagtttctcagtttgaccaggaaaaatactattactggaacagtgaagtccttgctacgcaagagagtaatggtaatgctggaaacagaaaaaaaaaatcgtatggtgagttaacacactccgacaatgaacacgaagaaaagtccaacgtttcatctatcaaaacatctatatccgattggatccgcaaagttagtcaacatgataatgatgattgcgatgcagcgggaagtacagatatgaataaaaatgagtggaagagtttaaaacagcaacttgaatcatcacaagatatttttttctccaagtgttgccagttggaatattctaaagtgcagttggaaaaaaccatttatgattattgtaaaaattactctaaaatggaggacggaatcaaacgagctctagaatcatcaaacatgatgtttcaacaaaaatgtgaaaaatttactgactcacctgtgtgttctctacaagaagcacaactgccacaggaaactgccaatgcggatgtaagagggtttttcctcagggataatggcataccctttcgcaggtggaatatcctagaagcgagtgatccagtcgacgcttgcaaagaaatctccataaaaagcgaaaagtttttctgtggtagtgaaataaataatgaactggctgctcttgatacgttaggggcaataaagattatactgcggcagattgaaaaggaaccaaatgctaataaagtcatacaaagttggcacagggatattgattttgtaagggtttctaatttgaaaagagacttattgggggaattcaaaggatcgaaaactaccgaaaatacaaactctataatcactgctcatttttttgaaaactcgcacagctatgtcactaatgatctcgtcggactgataaaattatggctgttagagctacccgacagcctaataccttcaaaccactacgatgacttaattaaggccgaaaaatcgctaacatccctatgtgaacagtttccgacgagctccttaaggtttctacaagaactagcaaaccattttcaattgatcaatagcaaatactcacttccgccgcaaacaatacaagatttgtttagagacaacagtgacatagacataccattggcccatcacttcgtaagaagaacaggcttacagaaccctatcgacatcaaaatcttgtcaccaacattatctacatttttcatcaacgaaagaactgtagaaactttgcaaacgttgatcgcaaacaggatcacgacggcaactactgcgacactcactgaaccgccgacgataattataaaggatacaacggcacctatacactctacccctaagccaccgccaaacgacaaggatggccatttcatacctcggccattcaagactagttctactccgacaaccccagagagacctaaacgtaagagtggtttattccttcccatcaacgtcaacgatgtcccttctacataactccatgcatgctacatagtaactacgtaaatcacctgctacctctctgttctttcgtcccgcctcgaggttgtgctgcttttgtacctattgtggctgtcggtgttacattacggtgcctcggtgttacgcggtgcttcgtcctggtggtccacgcggccttgcgctttggccttggtgggcttcgaggctgtattatataaatgggcctgatgttcgttaaaagctgcagtattgttcctgagcttgtttctttttcaaaggtttccttttttcttagtggggtcctttcttacataataaagtaaatagcctgatacatataaacctgtattgttgccattacagaaaaaagccactttctatacaaaaactacaataaaatgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaaaggaaatctccaacctggacataaaccaaaaaaatttaatgaaatagattagttatagtaaaagtaatcataataataaatagataaataaatccaaatgcaattataaatagtatatgaagttatgtgttttctaaaatattaaaggtttataaacggggtcccgaaactatctccatttctttttttttttttacgtaaggaaaggcaaacaggcgacacaaaatcatgaagtcagaaaataaaataaaagtgaaaaatttcacaatagtgcctattatcatgatagaagtagagtagaaaagctagcaacaatgagaagctctggcacatatgagaatgatccttctggggaaataacctcaacttccccaaagcagtcgaagcagaaaaagcctaccaaatttagggaaagaatgcgcaggtggttacaaaatgggaaaaataacaaccaccaaggagaggaggatgttcctgaaatatttaacaagaatttttatccgcaaacaggcatgacagctttcaacaataatgataatggtgaggttcaggatgttacaaacaatttttttttgcccagtgaagatgaatctggtccagttcaaagtagtgttaaaacttttttaactggtaacaatgatgaagattctaacttccaacaaaaccagaatcctaaacaaaagtccgaacttccaaagtcaccttaccggcaaaaacctacgcaagaaatagcattattgaaagatcttttcgttaccaacaaatatgacgatccctatttgaattcttccacaaggtttggtaacataacttcaacttttcccagtagtttgtcattgaggactgtcaccttacaaacaataaaaaaaagaattgactgtatttctgcaaaaaaaaaagaagtgtggaagacagaggaaaaatttctaaaagatatcttaatgtggttacagagttcaaattttgaagaccctgatacaatatcattaatacatgaaattgaaaaaatatttgaagaggatatccattttgaacaaaacgtgtcggattgcttaaaagaaatctcaaataatttcgaatatatctgcatgcgagaaacccaattgataaacgaaggaaacatactaaaaaatgacttaaaaaagtacgcaaaagcaagggaacataaaggcgaaaagcatgaagatactgaagtcttgagggaaaaagtaatatcatcacaaaaatcgtttgatgttacaaagaggcactataagcatgcaatttcaataacgacaagacagctatttatgaatttggcgtttgagtactacgaaaattgttcagatatgaaggatatttcgagaaaatacctacaagaatctttgtccactttacaaactatcgacacattgagtttttcggaagaattagaaaaaattagaaagagaagatttgataagttttgggcaaaaactaatcctgatccaacaaacaatattcaaaagtttgttaatatgagaacaggagtagcaggttttaatgattccttaatgaatcacttgtacgggaaactaagtttcggggtagcgccagttgaagaagaattacaaaactcacagccggagcacactgatgtgcctgaaaatgtttggaatgaggttctctctgattataattcaatggatggtaatccaattacttcaaataaattcctttctgcgaaagaacttgagcccgatcaattagttgaacttctcgctcaggaaaaagaagagaaagaggcaaaaaatatcagctcttcaactgcagaagttccatcgatatcgcaacctgaaataaagaaggagaatctcgaatcaaatgattccttgattttaagaagcacgaaaagaaatgtaaatgtcaatgccgctagtttgaggaatctttccattaaaaaaactcaagtcaaaccggagtctgcaagtgaagaaagcaaagttcttgctgcagctttaaatgatgcaaaacaaaacttggatgaaaacgtctggagaactcctatctaaaaaacaaacgaatatagtttgaacactcattccatgttctatgcttattgttgtacatttattatttatatattcttaaatatatttcgagagatctatacataaacatcaatttattataattctacacaaaattacatttaaatattaatggctttcttcaaaattcaaaaatctttttgagaaaattcatactccttcagatattggtttcttatcaacgcttcaatttttttctcttgaatatatataatatcagtatcggttaaagctttagaataatccgtctccatacatgatgttttctcgaatgtaaattctgtctcttcccaatccaacatatattcataatcaaagcagtttgtaaataaataaccgtcgaaccccacaaaaattggtaatctttcaagccagctttcaactttttcggaacaaggcatgttttgtgttgtccgtggactgaaatatgtcggaatttcaaatccattattcgaattatgtaaaacactccagttactaaacttgacatcttggcaattaactttttcaatgtgatttaaataggataaataagggtttggtaatggtagcgtaccgtggggatacaaatttggcaaacaattgattgaagaaagctgtggtgacatactgtcagtaactcttattggtttttcgtatgcaggccactgttcgtgttgtcgtcttcttaacgctggattgaactcaggaaatgttgtattctgtatcttcccgcaatctggtggtatcttattaattatctcagcaatcggagagcttcgaaagttgttcattttatttagcttcgatgttttagtctccttcagttccggtgcggaaagctgtgtgtaaccttgattcatttcgataaaatttgcgtttttataaaattcccaaaaatactgactatggtagaaaagatttcaacgaggaaggtggtaaagatcaatgaagtatcttcaatcattatgtaggttataagtaaatgtttttgttttcaattatgttccatagtttgtggtagtttttctttgaaaacgactgtgtcggccagaattgctgtcgcatcaccaaaaaaaaaaaaaaatgatacaaagactggggatgaatgttacgtaaacaggaaaaaaaatatgtcgaaggagagagaaaaaatatttaacaaagtgcatgcctctaaacgtcgtaattggtctggctatgacaaacaaaaaaatcgatgttaaaatgttccaaccgaggatcgaactcgggacctttgccgtgtgaaggcaacgtgatagccgctacactattggaacagacttttaatattctgaactttctgctttactaaacatcgtattattatacgaacatgaaacaataattaacaacaaattccagaacttgcgaccagctgttaaattcacaatcagaccaattttttactcgacttttattatataatagattatatatatatatatatatatatctcttttgcagctaaatgaaagaaaaaaaaagaaatggcacatatcaaaaataatcaattctctcgtcttcacacttgtagatatttacaatagaatcgtgagaattggtggccgcaatcatcattctatgaggatggaaagccatcgaagataaaaatgcatcagaagtggaagagtaggacagtgactttgggattcccgtagcggctaatgtacttgttacgccattattatgtgagtttttaaaagaattcaaaagatctccagatgtcgtccatatctttatttgtttagtccctgtcgcaattatcggagcatgctcatgaacctgcatgcacgtcattgtcgttggtttttgttgcgaaccgtactgagaagttacgttttgatcaacaaacgattctaccggatcttcggaccttatatcccataactctacaacaccattggtagctccactgaccaattctctgtaaccacctctttgtaaatgaacattgttaatccaaactccctgcttatcatttccagctctccagcgacgtatcatggaatctcttggatcgagacggcgatcatatactctcagggagccatctgcaaaccctgctacgaagatattacctgctagctgatcagccgtcaaggatgtaattaaagatgatgtttttgcaggaatgtccacttcaaccgtttctgtatgcgcatcccagacacggataaccttaacatcaccagttgttaacaatgatcctcttatttgtaaccattcggttagtaaacctgtggatctaggtgtcaataacatatcggtcaagcctctccaggcggatacaattttaaaggtgtcgacatcttggtagtctctgtatattttgataacaccgtctgaagaacctgtcaataaaagggcggagtcatcctcgttaatgagtttcaggtcagtaacttttgtgccaaaaggagtaccattggagaatttggacaaagtctttcctttctcccaatcaaaaactgtaatggtacttctatcatctgcagtaatcagctgatcttcaaactgggcaaacttcatcagttttggttgacttttgttatttaaactaatcaattttttggaccaattcccataaatcgataattttttctccccctgtgtttcctggataatagtttcatttctgttacgtctccacaatctagcattatactcaacactgccaggttcatccgcctcttgctttttcatttgtggttcttgaaaatattcacgtgaatagtctaaaaaggaactatttaatggcaattgtaagggttctgtatgcttccggaatcttggagtctcagctgtaggataaatattattattgccattcaataaatataagcccgagggacccttttttgaggtatgcgatttcatcgaagtatttgatgattgagtatcagagtcactattggattcgctaaaaccaagactctggaaaagtttagctaaagatgtccgcattggatgagatatctttgggtcatgctgttgttgctcttttttgaatgcattattatctaccctctcatttggtgagaatgatcgtaatgaactttttacaaattgaacctgcgaagaattaaatccaaatttaccagtttggtgagctttcgagcttcttttcaacaaaaatttttccataactgcaaatggtccaccaagttccttatgggcgcttaattcaagcaaaatataatctataacctgcttggataattccttgttctctaaaaagggatcttcggctagaatcaagagagatttccaaacagtgtagaaaatggaaccctgactaactgaatacttatcggaagtgtttcgagtattgatatcacttttctctaaaagttttatttcttccaacaaatcattgaatacaactacaataaaaaagttagagtaacgactcacaatatgcgaaaaatatacgactagttccttacggactaatgatgaaccatcattgattaaaggtaagattgagatcaagttgccaatttcctgtctttttaacttcctcaaatcaataacttctagttgattttgcataacttgacaatgacgaatctgcttttcaattttcatctgctgctgctcaagatgctgctgctgttgctgggactgttgttgttgtagatgggattgattttggagatgctgtaattgcgaatgtaattgctgatactgttcttcaaattcttgttgcaatctcaaaattacctctgcatcttgaaatccagatatgaaatgcttcaatgcaaatatagaagctgttctaacttcaggtacagggtccttcaaagattttagtaatatttcaacagcaccagtattcatacatacaaacctgtttaaggggttatcagcaaacaataaacctaataaaataacacaccactgtcttagtaggggtatctcagaattatcaatataaaagcacaacttgttgaccagttccaaactaaaacaatttttttgccccagaggaaagtttcgaacgaatgatgccaaaacaaagacagccatagctttttgttcatcggtggtatcattagaatgataaaatggaagattattgtggcccaagttggatgttctatttccttgctggcgttcataatatcttgaagatggaccatttatattctgcgatgcagtcattgtcaacgggttcccactatttatcatggctgagccatttgtagctgacatgccattaacaccccaatcaggtactaacactgtaacaaaatacatataacccttttctttgattaattcactttgcgtgtttttgtaatctattgacatgatacgggcccaaataaaaactaggatgggcttcaactcaggtgctggactttgtagcagcttcaaaacgtaggggaagatacctattgaaagtgacaggtagacagcccacgggcctaaatctaaaaatctggataaaagtaccaacgcacgtatacgatgcacttgcgaaagaagaacctgtaaaacgataggaagctgctcaggcgggtgtctgacatttgaagcatatttcaaccacaattcaaaagcagtcaaattttgttcaaaaaatcctgtaaattgttgttgttgttgttgctgctgctgtaattgttgctgtgagctttgcaaagatatagattttcttgattggagagcagggttatttactagagacattgtacttaaattggccactgcaaatctcgattgtgtttgaatacttccggctttcgtatcttgggcattcgacttagagctgccaccattctgtaaggtttcttgttgttgtagaatcatctgactctctaaggcagtagcgggaggagcatttttcagatcaatgactattttagtcagtacttcatccatggctaaatcccaagatttccacattggatgtgtggttatactatctggtaattctggatcagatacaggatggcaattgtaccacggcattattcttttggctagaagaaaatttctgaaaagcgcagcaatcattaaatcatgtctgaataattttttgaaaagtggtcgggggagggatgtccatgcaattgtgtccgttatagctgtaaaaatccaatttagttctcccaacggcgttctcctatccgacaacattccagggatattgacgttgggtattttggacttgaacgagttcttactatcaccaaacggttgatttgaagtactattttcgaagaaaattttatatttagaatcttttaagggtgactgcatgagaaagatacggatgctaatctctattggacaggtcaaacaacaactaaacaaatctgcgggtagttccggactcataagtaaaagttcatcggaagtgcaagaggctaattggaaacaatcttgataagctgaagttggtgatggcgcggcaacatcatgatttccctcttcatcatctttaatcctcttttgcacaaacttctgaaagttgattaatatattttcagcactgttgcaatcatagacaaatatacatggcgcacctaaccaagtttgcaggtcatacaaagataccggaatatattgtgtataacctctgttgaaaacccaaatttcacctgattttgtaggcttaggcacaccatgtccgttgtagtggaaaagtatcctatcttccttagaagttcttcttagcgagttgcaaaaccgtttgacatcctctacacaaggatccaagctttgtttatagcgtgttctcaaagacagagtttcgtactgtgcttgtaagtttttaccaatttgttctattgctttcttcgagtcctggaaattcaatgggtctacccatgcttcaactctggcacagggatgtgtcttcataacatcagggggatcgacacctaaattcaagcataataaaagggccgcacttactgtcttctgtcgatctttcataatcttccaatcggtaatcggctggtaataacgatttacatctcgttgtttatcctcttcaggaatcggatttccattagttttgtgtcgtttatcatcaaagtagaatatgaaatcattcgcgagtgattgtaaaagttggtcactttggtattgctcttcaaacccatgtctcatcaccgtattgagtggctttaatggctgaggtccataaatctccggcattatgtatcttttacccttctctgcatgcaataggattcgctaaatgtaatcaaaggaatctacaaaccaaatgcattcgaaaataactttacaagttttaaaatcctctatatacttatgtaaagtactacctattgatgatttattaaagtatttttgatactattaatgctgccttgattatcatctcatagtgcgggtcaccttgaaaaatccaaatataagaagcgatgccattataacctctggagaatgataacttaagagctttttaatagctccaacccaagctattgctacaggtagaacaagatataatggccagttcgtcacataaccctgtcattcttttgaaaagaatcttatcgctcacagaaagctcccctttcattttgtgcttagattctattgcccagacctcatacaagctcatccaagaattcgtccaccagagcaagagtaaaggaaatgagtatccaattgtgtacatttcgttcgaaacagtgaataaaccatcgtactgtactcaatttattgacgctacgcagatggattttgtacatttagtgaaacaaattatatcatatctaccggctgctactgccacacaggcaaaaaagcacatggtcattatcgattcattgaactatatttctacagaatacataacaaggtttttgtctgagatcgcctctcctcactgcacgatggttgcgacttatcataaagacatcaaagatgagaaccgtacggtaatacctgattggaataacaattatcctgataagttgactttactgcagtttatggccactacaatagtagatattgatgtggtattaacaggcactctcgatactgaggaggtgagtgaattgttaaacgaatttagaattcctcgcgggttaaataacgatatatttcaattacgacttgttaataaaagaaagtccggcaggtcattggaatacgacttcatagtaaattcaaacacccacgaatatgaattattatcaaccactaagcaagaagaggagagcagtagtaacggactggagacacccgaaatgttgcaaggattaacaacattcaacctaggaacatccaacaaacagaagctggccaaagatcaagtcgcattgccttttctggaggcacaaagctttggacaagggggtgctattgtttatgagtacgaaaaggatgacgattatgatgaagaggatccatatgaggatcccttttaaaaagtagaaactgatggtaaatagtgagtgcttccagattatgtaaactacgtatacttcatacacatatctagatgctagattgttagtctgttttagtcttttttttccctaggaacttttcctttagctttagcaatttgtattttaagccagattgcaacgtaatcttatcggcctcttcgacggtgaccattctcttcaccatcaaattgtatagcataccgaatatgagtcccatgattgtagatgttagaatgatgacgttatacggcatactaaaatccggtgtagacagggataacaatagggtagaggttctcatttcataaagagacgatgaggactccaaagatagcacggtgattacagctgcatcgatttcaaaaccatggtttgcatctggtggatactcggcaaattgcagaagagctttatcgaattgataagtcattacaatgtccgtattagctggaattaacatcgtgaactccaagtggccaggtctttttctatcggccgcttgtaaatagtatttatctaagatgatatcgttttcttgcaattgcggagaggtagtagaagtaatttgaagagaggataggtaaactctcatgaaccatggcaatgattcgaaataaatcaacttcacaggggtatcattgtcgttatggaaaacaatacgcattccaccacgatcttgtccattaccagtcagagatctgcttacgtgaattgggacaggaactatgggagtaactttagtagtgtccgtcgattctaaaataaagtcgtagcccgaaccaccctcattttgatcgtttgataagtcaaagcaattatcatgtgtgctgaaaatagtatcgtcaactgacaaaaacgcagtccaggtagaacggtcaacttctgcacaaattcttgtgggcctattagcaaacaggttgccattgtttattggtctggcaaacagctgagacagcttgaagtgagtctgcgaaggttccggtagagggaagcattggtaagaatcaaagggtttatccgtgtcacaacgcaatgtgttcccatccaaaggtttggggataggtctctcacctcttgccaaggcggagggaacgtgtgttaccatttctatgcgtgcgtccatctcgtagtgacaaagagcatcttcatcttcagaacaaatagtggcaatatccaaggaaatactattccatagagagtcgaacaatttatgaccatccaagagagatgtcaaaccggatttgcccctagtaggcaatagttttatgaacggcgtcaagttctcggtacagatgggttcattgggcaacgatgctcgcatcaggtacagtttctcggtgctattgaaaagaggagctcctatatcagaagcatatgaccgccggggaaaggtcgtccttgactcgtcgataaaatttaaagaagaacaaaacaatccgctcaatgaattggacagttttttccaattatggaacgcctgttcctgatccatggcctgcacttgcgaccacaattccacacctgaggcacctgcctcttttccagcatgtggcaactgtccccacgacagggcatcccagaatcctctggtaaatcttaaatgaaactgacgcgtggcagtagattccaacaatggtgggatggcccgtgggaaagtcgtgtagtgctcatacgcatcatatgacatggatgatacggccgggtcaaacggttccgattgcagttggaatgcaaatgagagtagcagatcattgttgggcagcggcttcaacaccagtgcttcgtcgtacggataccataaactgtcatttataccaatctgcgacaccgtgtcttctgcgaacacacccagtagtagagtgcccagcatgaaataggccagtgtgaggatcatcgtcgtcttgcctatgctttgtttgctttgaacacttgtttccgctctccttttacttattggctactaaaactacgtgtaaaagatcgcccagcgcaaaaaggtccggcggtttcaaataatctcgaactattcctataatatgcaaaatagtaggtaggaacaagtcgactctaggcagataaggaagatgtccggtaaatggagactagtgctgaccgggataggcaatccagagcctcagtacgctggtacccgtcacaatgtagggctatatatgctggagctgctacgaaagcggcttggtctgcaggggagaacttattcccctgtgcctaatacgggcggcaaagtgcattatatagaagacgaacattgtacgatactaagatcggatggccagtacatgaatctaagtggagaacaggtgtgcaaggtctgggcccggtacgccaagtaccaagcccgacacgtagttattcatgacgagttaagtgtggcgtgtggaaaagtgcagctcagagcccccagcaccagtattagaggtcataatgggctgcgaagcctgctaaaatgcagtggaggccgtgtaccctttgccaaattggctattggaatcggcagagaacctgggtcccgttctagagaccctgcgagcgtgtcccggtgggttctgggagctctaactccgcaggaactacaaaccttgcttacacagagtgaacctgctgcctggcgtgctctgactcagtacatttcatagcccatcttcaacaacaataccgacttaccatcctatttgctttgccctttttcttttccactgcactttgcatcggaaggcgttatcggttttgggtttagtgcctaaacgagcagcgagaacacgaccacgggctatataaatggaaagttaggacaggggcaaagaataagagcacagaagaagagaaaagacgaagagcagaagcggaaaacgtatacacgtcacatatcacacacacacaatgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatgggttgcaaaccgtccacgactacgacgtgtactgtcactacgtagctggtttggtcggtgatggtttgacccgtttgattgtcattgccaagtttgccaacgaatctttgtattctaatgagcaattgtatgaaagcatgggtcttttcctacaaaaaaccaacatcatcagagattacaatgaagatttggtcgatggtagatccttctggcccaaggaaatctggtcacaatacgctcctcagttgaaggacttcatgaaacctgaaaacgaacaactggggttggactgtataaaccacctcgtcttaaacgcattgagtcatgttatcgatgtgttgacttatttggccggtatccacgagcaatccactttccaattttgtgccattccccaagttatggccattgcaaccttggctttggtattcaacaaccgtgaagtgctacatggcaatgtaaagattcgtaagggtactacctgctatttaattttgaaatcaaggactttgcgtggctgtgtcgagatttttgactattacttacgtgatatcaaatctaaattggctgtgcaagatccaaatttcttaaaattgaacattcaaatctccaagatcgaacagtttatggaagaaatgtaccaggataaattacctcctaacgtgaagccaaatgaaactccaattttcttgaaagttaaagaaagatccagatacgatgatgaattggttccaacccaacaagaagaagagtacaagttcaatatggttttatctatcatcttgtccgttcttcttgggttttattatatatacactttacacagagcgtgaagtctgcgccaaataacataaacaaacaactccgaacaataactaagtacttacataataggtagaggcctatccttaaagataaccttatatttcattacatcaactaattcgaccttattatctttcgaattgaaatgcattatacccatcggtacgtctagctttgtcaccttccccagtaaacgctgtttcttgccgacaaacaatgtggccctctctccgtcaatctgtaacgacccaaatcgtattaaagtttcgccgtcctgttcactgaaccttccctcatttggagaatctctcctcgccagcgacgcaaagtccttaggcaactctagttcaccttgaatctccagcatcatcatcccaagcggtgttatcaccgtggtctgcttttctcttgactgtgtcaacttctgccattgactagcatctatatctacactaggcattcttttcagctgtttattgggctgaatgatagtgataattcttttttctatcactcctttggctatattagtggttagcttactaaaaaagattaaaggaaaaatgaaattcaagatgctaacgttgacatgtatattttaagaaaacaaaaatcatacaaagaggagatcggatataaaagaataacataaatatgtttagtgcattaggtaaatgggtccgaggctctcgcaatgataaggactttgtgacgaagtataccgcagatttatcacaaataacttcacagatccatcaattagatgtcgcgttaaagaaaagccaatccatcttgagtcaatggcaatcaaatctgaccttttatggtattgcgttaacggtattggccctgagctacacatattgggagtaccatggttatcgaccataccttgtggtgactgcgctactatgcataggctcgctaatcttgttcaaatgggcattaaccaaactctatgcattttataacaacaataggttacgcaagttggcaaaactccgtgcaattcatcaaaagaaactggaaaagttaaaggaagagacccactataatgctacaagctcaatcatccaacggttttcttccggtgaagatcaaaacgacgatgccatggtacttctagatgatgaattaaatgctaaataccaagaattaaacaatctaaagacagagctagaaaaatttaagaaggaaagccatgtaaagggcctaaagaaggaagacagcgatgcatggttcgacaaaatcatcagcgtactggcaggcggtaatgaattggactcaacaagttcgctctctcccttcaaaaaaatcatatgtccacagtgtcattggaaatccaattgctacagattggccagtaagccaatcatctttatctgtcctcactgtaaccacaaaatagacgaagtaaaggaaagagaagacgccattgaagcaaaacaaccggcacagccttcgcagtcggagaaggaaaaaacaaaatgattttgcgttagaataactacgtacccctatataatatatttttatatcattatttagacaaggacatgatagcgttgactaagtcaccattgtgagctttcagggctttgatggcttggtttttggaaacgttagtttgttgaacgactaactcgatatcatccttattcaagtcaccggcatcaacttcaccttcttcgtcatcttcttctgctgcggcgttgacactgccttctgcggcggcttgcatgtcagcttggatgtcttctggggacttggtagcgacgtcttcgttagatggcataataccgctagcttgagcttgttgttgagcagcggctagcttttgggtaaagttgtcaaccttagcttcaccgaagacaacgtagttaccaccggcagatctgaagacttctggcttttcaatagcatagatttggttgtccttcttcctgaaagtgactctgatgatacctgggatttgcttcaaacccaatttgccaatcaattctctggctttcttttcgttcttgtttaagacggtaacgttggcgttttctgggatagcagacattatcaattgagtatgtgggtgtgtggttgcttgtaagggttgctcccagaaggagactttaccttagttcttgtttaaaataatccttttcattcaactttttgtcatttttttcttcggcgatgaaaaattttcaaaaaaaaaaacagacctaacaaaagggcaaaagacctattatactatatgaccgaaaaaacttacgccctattaaataaagaagaaacctaaagaagataaactaaaaacccttctaatattaggtcacaataattgaaatttcactgcaactttccctttttatcttaaaggatatccacttgactatcctcagtaagagttgatcggaaatgtgtcatgactacgcattatcacgtaggcatatatatgtaaattcggacgggaaagctggcagtctactatatgtccctttttaccaggccttttctaaggagcccccggcagttttctgtagcaaggtatgtgtattgggctagaagccctgcccttcgaagtaacttgagaataccgtcaatagcagcggcatcgctaagagcatattctaatgagtctaaaactggaagggatgctcctcccgacaaaaaatcaaaaaagctatcaaacctgaaatacattactgaaagggattccctgctggtgcagaccaacaatatttttactaagctcaaaataaacatacgatggttcttgaaaaagtccacccggccgttcaattcagacgatataagtgcgttcatctcatggatcctcgtgagcaacattttcatattcatcttctggacaaccacctttgtatctttgatcctttacttaatcaataccgtgtttgcacaagaatacctcgcaagcaagattggtaaatttattactaagaatgagtcgttgtcaatcgttttcgagagtgccattgtaccagactggtcgtctgggaaaatcagctttcaaaaagtcttcgtctccaggagaccaaaggtctcgcgcggctttaccaagggttcacagcaggatgccctgcaaagggcgaagttggcccttagtgagagaatattggttaaccaacaggactttgataatggcaattatacacagtttgatctgaccattgaccaagtcgacatatcgttgaatttcagaaagtggataaatgggaagggtatcctagacgaagtgaccataaatgggcttagaggagtcatagacagaacacacgtggtgtggaaaaaggacgacgatcctaagaactatctgaacgtctaccagccgggcgactttgaaatatcaaaattcaccatgaacgatgtcctttgtacactgtaccagccaaatgggttcaggccattccaggtgagtatatttaattgcgatctaccgcaattgagaaaacattggttgttctacgatatcttgaatgcgaacaatatcaatgggacctacgacaattcaatgttcactatccacaagaagttcagaaccgatgatcagcatcaggaccccacgctgctatggaagcaaatgacaaggtttagggtagacaatctcgacatcgatcacctgaacgccggtatcgaaggaccctttggatggatcaacgaaggtcgcgtgaacatgattggcgacgttcttttaccagatgacgatgccgcgtctgactcgctgcaactgacagaaatcctcacagagatcggtgaccgcttaatcaaaaaagcgaaaaggtacacttcatcccttcctctggttgggccaggattctccccggccgttgatgaaattgacccgaacgactactttattatggacttttctttaagactatacaatgtcaaagccgaagtccctctgttcacttctggcttaacgtatatcaatagtgcattgataaggcctattgtcgggtacatcaattctcacaggacatacatcccaatcaaatgccgcattgtaaagaaaaagtctgattttgagggctcctggaccatatatgattcataccttatgcgggatctaagtgcggaagcgtacgatgccttcgccgactacgtcgctgacgatgaaaagaggacattacgcttgagaagggtgggcttttggtcactgcaacttatactccaggtgattttgatgagtctcggtgctatcgcgtgaggaatacctactcctgtcactttctgtacatatgcatttacatagcatcgttctttctatcagtttatctaatttgtgacgcatctttcttctttctacactgcggaaaatcctatttgaaaaaaaatagacgaaaaatatcaggacccacccccttatgaaggagagaaggggaagaggagctgcaaaacaaaaaggtgaggcttcttctgtccagatttttgtgagtgagagagtgtgtgggaagagaaggaattaaaccaaacaaaaattggaaccaacaactgttgcgtttgcgtgtgtgcataatatcaaaaaagctacaaatataattgtaaaatataataagcatgactcgtcccccattggttcgtggaatcttttcgttaggtctttctgtagccgttttgaaaggtgttgaaaaaacagttcgtaagcatttggaaagacagggatggatagagccccagaaagtggactatgagttaattttcactatagataggttgaaaaacttggtagataataagcgtgaggctttaactgcggaacaacccgacgctggtgaactgagctggcgtaaagtatttaatttcatttccagacaatccagcgaattggacacacgaatatacgttcttatactactcctatcctttctactacctatcgcgtggactgtactggacggtgatcgcgagaccacgctagaagataaggataacgattgtaatgtagatcttattgaaaacgaaaggaggctgaagcattacaacgatggtgaaagagcagtattgcaatttggtaaaaatagatccgaacctattatattaagctataaggacatgaacgttttggaaggggaacatgagtttacctccaaagaggaacacagtaacagccatttgacaagcaagagcgaaaatgcactaaaccaagtagggagtgaagatttgttaggttgtcacctggaaaagcaattggaagaagacaaaaatgaaccgaatggagaagcagacggtgaggatgataataaccgggaaaaggattgcagctccagttcagaagttgagtcgcagagtaaatgccgaaaggaaagtactgcagagcctgactctctctcacgggataccagaacaacctcttcccttaaatcaagtacatcattccccatatcattcaagggctcgatagaccttaagtcgttaaaccagccttcatcattgttgcatatacaagtatctcccacaaaatctagtaatctagatgcacaagtgaacactgaacaagcatactctcaaccatttagatactaatgtactatatttccgtcatctcggttatcatcgtcacttacaacgaggtgcgaaaatttttttcttctaaaggtgagaagaaaacatgaaaaattttgaaaaatttaacgatgagatggagttttcaagtaactttatgtagttgaaatacatattagtactccgttgcaatatataacgccgggcattctccacgtatatacataccgtagtgcacaatgggctcctctttggatttggtggcgagcttctcgcatgattccactcgttttgcattccaagcaagcgtcgcacaaaagaacaatgtggatatttatccattaaatgaaactaaggattatgtggtcaatagttcattagtgagtcatattgactatgagacaaacgatatgaaggtttcagatgtaatcttctttgggtggtgtagtgatttgatagatacgcagtcatccaatatcaaaagaaaattagatgaagatgaaggaactggtgaatcaagtgagcaaagatgtgaaaactttttcgttaacggatttcctgacggaagaattgttgtttactcttctaatggtaaggatatagttaatatcatcaagaataaaaaagagattttgggagcagacacagacgagtctgatatatggattttggatagtgataaagtcgttaagaaattacagtataacaattcgaaacctctaaagacttttacgctagttgatggtaaagatgacgaaatagttcatttccaaattttgcaccaaaatggcactttattggtatgcattattactaaacagatggtttatattgttgatccatcaaagagaagaccctctactaagtatagttttgaaatatcagacgctgtagcatgtgaattttcttcagacggtaagtatctgttaattgccaacaacgaagaattaatagcttacgacttgaaggaagattcaaagctgatccaatcatggcctgtccaagtgaagacattgaaaactttagatgatttgataatggctttgactactgatggtaaaattaataattataagattggcgaagccgacaaagtttgttctatagttgtaaatgaagatttggaaattatagatttcacgccaataaacagcaagcaacaggttctaatttcatggctaaatgtcaatgaacccaactttgaatctatttctttaaaagaaattgaaactcaggggtatattacaataaacaaaaatgaaaaaaataatgctgatgaagcggaccaaaagaaattagaagagaaagaagaagaagctcagcctgaagttcaacatgagaagaaggagactgaaactaagataaacaagaaagttagtaaatcagatcaagttgaaattgctaatattctctcatcgcatttagaagctaattcaacagaaatattggatgatctgatgtctggaagttggacagaaccagagattaaaaaattcatcttaaccaagatcaatacagtagatcatctaagtaagatatttttgactatatcaaagtcaataacacaaaatccatggaatgaagaaaatttacttccgttgtggcttaagtggttgctgactttgaaaagtggggagttaaattctataaaggataaacatacaaagaaaaattgcaagcatttaaaatctgcattaagatcttcagaggagatcttgcctgttctactcggtatacaaggtagattagaaatgttgaggaggcaagcaaaattgagagaggatcttgcacaactatctatgcaagagggtgaagatgatgaaatagaagttatagagcattcaaatgtaattagtaatcctttgcaggatcaagcatcgcctgttgaaaagcttgaaccagattcaattgtttatgcaaatggagaaagtgacgaatttgtcgacgcatcggaatacaaagattgatcaagcattttaaatatatttaagtatatacaaagaaaagtttcacatgagaagcactgattgatgcagctattaattttcaaaagattacgttgtcttcatcatttgagacgggtcatcgcaagaaaatttttcaatattaaactataataaaatgtagtaaaaaatagatgcaatactactattcaatttttgtggttttccagttatcaaactaagtatagacaaaatttgagcatgtcagaggaatttatcgcagtttctactttggctagaaacctggaaattgccaagggtaatgagtttcataccattttggcgactttaagatcaccagtttatatcaatgaacagctgctaaaatccgaattgagcttccttgttacaaaaatcctaaaacttatcagatcaggcaatgactttgatctttggaaaggatgtcacacctctgttgtgacttgcgcctataatccactggtcttatcgactcatggaggtcaattgcttgctgccatttattccagattggaacagaagacgggtttctattcttcggttatttcttcatcacatggaaagcagctattcaatacccttatttcttctgtagcgattatcattgatttaatgaagaataaacctacgttatcgagagaagcactggttcccaaattaaaggctatcattccaacgttaattacattgtctcaatacgagcccgaacttgttctaccagtactacagaggatattgaagagaaacactacaacatttaagccatttaccaacaaattccgcactgtgttaatcaatttaatcatatcagactatgcttctttaggcactaagacgcagaggcttgtttgcgaaaactttgcttatttgcatttgctgaaaattcaggttagtgatactagcgatgacgaaactcaagcacatcacaaaatatatgctgattctaattggagaacaggattaatgtccatcttatcacaattcaagcccataattcaattatgtggagaaatcttggattttgaacaagataatgagctgtataaactaattaaaagtttaccggttatcgatgaatccaataacaaagaagaatttttaccctcattgaaattagacttcaacgcacctttaactttatgggaaattccacaacgtttgtccttattggctgacatgcttgttgctttcatctctttaccaactccctttcccattcgagttccgctgggtggtattaattccctttgtgaagttttgttgggagttagtaacaaatatttaccgttaaaaaaagaattgcgtcatgataatgaactaaatggggtcatcaataccatcttacctcaaatacaatttcaaggcattaggttatgggaaattatggtttcaaaatatggcaaatgcggtttatcatttttcgaaggaatcctttcttccattgaacttttcattccattaaaaaagaaaagtaacaatgaaattgattttaatgttgttgggtctttaaaatttgagtttgctactgttttcagattggtaaatatgattttgtctcatttaggccaccaactgaacataatcagcgtcatatcccaattaatcgaagtggcgttgttcttatctcatgataaaacattgattgattctttattcaaaaatcgtaaaagcatcatgaaacaacagactaaaacaaaacaatcaaagaggagtaaaagtgccgaaggtgcattttctgatatttatacgcacccagagctatttgtgtgtaaaaattccatgaattggttcaatgaaatcaatgatttttttattactgcactaaataattggattttgccttcaactccacatattcaaattttgaaatatagtatcacgcaatctttaagattaaaggaaagatttggttatattccagaaagctttgttaatctcctgcgttgcgaggttcttcacccaggtagtgaacgtgtttcaattttaccgattgcaatatcactattaaagaatatcaatgatgatatgtttgaattactgtgtcatccaaaagtgccagtcggtatggtgtaccagttgcacaaacctttggacttaggcgaagacggggaagtaagggatgatatcaacaagaaggaggttgaaacgaacgaatcatcctcaaacgccaatactggcctggagactttaaaagcgttagaaaatttggaaaatgttacaatccctgaacccaaacacgaagtcccaaaggtcgtcgatgatactgccatattcaagaaaaggtcagtagaagaagtcattgaaagagagtctacatcttcacataagaaagtgaaattcgttgaagaaacaaccgtggataatggcgaagaattgattgtaaaaaaagctgtaagccaaactaaggaagaagagaagccaatggaggacagtgaagatgaagaacaggaggagtttgaaattcccgctatcgaattaagtgatgacgaagaggaggaggaagaaggagaataataatatcaaccagattttgtttggttatatttcgactagaatatatgtatgcatatgctaaaattgtacataggcatttacgaatgaaaatagtgtagaggtatgaacaagactaaattctaaaagtttagaggagtgtgatcaatttgtcgatagctgtttttttggcttgtggagaaggagatttttcgccacataaatattggctaaataagaattttccgacgagttgattattaactactcccatgacctcaaattcgttgtttttactgtcatgatatgaaaattgtaaagcgccgttggctaataattcgatgatcaaatcgtcatttttcctgacggatcccttacgtgaaaaggcatcatttaactcacttaggcccttcgccagtgtgtctttattattggccacatcgggatgtttagaaatagttttgaccaggccctccttaagatgcttaaaatctgtattccttacgggagttatcttggctagcattctcattccagaatccagtaagtcatcaatcatcataacggattttgagtcatcacgtttcaataatctagctagattctccttaggagtcttagaatcatccacatcaaggaaatatttatgtaaataagtttcatttagagtgtctgaaacaaggttttcgtcattttcagctagataaagacccaaggcatagaccttgaacctcaaaaacgtgacgtgcctttgaccatatcccagtaatttaaaagttgtagagacagggaaatttaaagcagtaatcgttagtgggaaatctgatacgctagagtctacctgtatcgattcagtatgagaaggaaaagcatcagttttatcgtcattttgtaccggacgatcacggtagtataacgaagtagcgagcaatgttgacgccgcaaaccagggccaatagtggaacgtcgaattagaacgcccagggtatttagtggctcgtatactagtaaaatttcttttgaaacattgccaatggttggttgatggagatttctgacatttagctagtgttcgctggagtgattttagcatattggcgcaccttcctctgtccatgaagggattctatcgcggttgtaacgccgtaagagttttgaattgattttttcttgtcaaaaccgaatagcattgtaaacattttgaggggtccctcctagaaaaattgagtcgaaaggaaactcaaaaaaacatcattagagtatatgtgcagcttttggaacagcgtatgtattatgtaattgtatgtagaagtcggcgaaagtgtcctaagatagagagacgagtgcatcgattacttccttcctagcctccggagaaggaggatccacagcagctaggtagtgggcaaataagagctttccaataaggggttccttcactgtgcccaatatcacaaattcatccttctttcttgcgtagtaagacaaattcatagagcagtccttattcagctcaatgaaaaaatcatcatctcgagccacaagtccttttacgctcctgaaacagtcatgcaattcttggaatccagcttccagccggtctttgtcttgagactgagaatctgggttctttaggacgctctttttggtgccgtccatcaataacttgaaggaacctgcttttatcggagtattcttggacattagtctgattccgctgtctaagaggttattaatcaggataggggccttagcaggatcgttcaaagccgcacgcaaattatcctgatgtgagttttccggtgatgggggtgccgcagtgtcgatgaacgcctgagacaggaactttgagtccagtacttcagagaccagatgtttgtcttcagcggccacatatatgcccagaccatatgctttgaaagtgatcgatgagacacaacgtacacccttaccaatcagctcatattgcgtggagaagggccactgtggggggcccatcttcttagggaacgcagagatggatgcgtccactgcaacgctggtggcatccgcctttttgatctgggaatcgtcataccatttcttcgcgaatatggatgccagtgctaaccctgttaacacaggcactactttgctgcccttcttgttcacacgagcattgcccgctgtagtagagtagtgagaataccattgtggggccctcctcatacctacctctaggcaatttgttttcaccaaaactttactgattaaacgcatgtttccatatacctggccttctgctaagtagacatgtattcaacaaggggatgtaaccacacgctgctttaataccaacaaatcggccgctgattagtaataggtgcatcattgcgaataccgagaaagggtccattatacgaactaatcattctatacggcgtccttcctgttcaagcacctctctgattagttcctttgattgaggcgctgatgttgcatcaggctgctggagcagatttagtttctttaacgtctcctctttaatattttcgatcagtttttctgttgtttccactgaggttgtgttagtaattagtgcgggtgaaggttgggggtagagtgttgcggtgaggtgacatacgttccagctgcattcgatgtagtattgcgctgcgcaacttctgccgttcttcgggagtgagagccggtatcatcgtaaccgagtgcggcagctgcccttttgctgatgttgttgccacttcttgtttacaattgtattctcttgaagttatatggcattatagctgccgggttatttccgccaggcgggttttcgccaccggaatttacaactaaatacacacttatatcagacttttaaagcgtaaagaaagaagggaaaagtcaataaataactcagcagtaaccgcacaatggtattggaagctacagtgttagtgattgataattcagagtactctcgcaatggcgactttcctaggacaaggtttgaagcccagatcgactcggtagagttcatatttcaagccaagagaaacagcaatcctgagaatacagtgggtcttatctctggtgctggcgccaaccccagggtgttatctacgtttaccgccgagtttgggaagattcttgctggactacacgacacgcagatcgagggtaagctgcatatggccactgcgttgcagatcgctcagctgactttgaagcatcgccagaataaggtccaacatcaaaggattgtggcatttgtgtgtagcccaataagtgattctcgagacgaattgatcagattggcaaaaacactgaaaaagaataatgttgccgtggacatcatcaattttggagagattgaacagaacacggagcttttggatgagttcatagctgcagtgaacaaccctcaagaagaaactagtcatttgcttactgtgacgcctggccccagactgctgtacgagaacatcgcatcttcacccataattctcgaagaaggatcctccggtatgggcgcctttggtgggtctggcggtgattccgatgccaatggcacatttatggacttcggggtagacccatcaatggacccagaactggcaatggccttgcgtctgtctatggaagaagagcagcaaagacaggaaaggttaagacagcagcaacaacaacaagatcagcctgagcagtctgaacagcctgaacaacaccaagacaaatagtagtgtacaaaaatatctatatgggtcatatataaaccaaataaagcatatataacatctcccttcactcttccaggtttgagtacgcttcctctaaataggggacgacttgctttctggtggcctcgacgttcagttgcttaaacatcgccacacctccatcaagattgcccccaaataattgaagttggagcttgtcgctaaccctttcaatgagttcacgtaccacgttagagtctcccaatatgaccaattctctgtgtgaatcaccagctttcctccatgaagtcaacagaaccaatacatcgagccccctctccgcctgaaatcttctgcattggttgacgaaatctgcttcaccaccgtgttcattgaatagccaagacattctttttactattgatgaaagaccaatctctaaccctttgtgtccctttccttggaaattgaattgtttgtagtccttctttagaatatcgcttaccgaaaatcctttaatatcgttctttcttgattttatctctttataaaactcactgctgtcctctaaaccttgcgcagacacttcattaaccgcaccactaagaacagcttggcatctctcgatagctaatttatcactttcctcgactttgcgcctcatatttgaagtgtctattaagatggcccccatcaaaagtggtgcaatgttcatcaccacttcacggtcaccttgcaatttttcataccagtagttaaaaaccagcgatgagcaactgccggacacttttacaatccgaggttcagcatccaaatgtttttgcaagtcaaaatggtggtctataatgccaacgacgttatctatataatttttcaaattctttggtgtatcgttattatctaccaagtaagagtttaattcagtaccctgggagacattttgcttcaagctctttaaatcttcaatgaagaataattcctcctccttaattttcagtttttctaggacatacattacgtctcttcttaaactgaggtcttctctaggaatgtcgataattgggacaataaagcttcctttctttttctcctccgagtaagtaccttcattatatatgtattggcagtacgaataagtgattgcactagcaattgagtccatatctgctgactcgttaccaacacatattgttaacacatcgttgcttgcaatttttgaaattggcagtgattttaagtgtgccaaaaattcaggaaccgtctttctcaaaggcgacatctttcttaacaatcggtgttttgaactttttgattatttgtttcaagtggctttagttaattatgtacacttcgtttcttttttctactcttaaaagtgaaaaaaatgaaaaatcagcggcatgtatagcatacagataataggaaaaaggttgtgagttattcttcgagactatttcgactcgtattctaaattagaattcaagtaggtggataatgtgacaaaatgaatgaaggttagagctttacacagagtattatcctcggcgttttctatcaaagcttctggttattccatacttttttcaaggacagcagaaacatatgccattttacacctcctgggaaaataatttgtaattttctagtgactcaatgcttgttgaaagtgatcttgtataatgagtgtacacatgagatgtgcaaatttcttcattacttagcgagaagtgtacactcttgaatataataacactaacagtggaatcatcggtaataataatactattgatcgtagtgaaagcaaaacacgactgtacttgagttataaattttgttgctgtagaaatttcagtgatcattcattagcaacttattaagatgacgattatattttacggttcttttcacaaaccattatacttgctaaaggttgtaaaagtcatacactttttaacatcaagatttcagtacaacaatttcttacatgtaaaatcgtttgcaaattaagttcgccaaattgtatcttaattaaaatctatgtgttcagaagttgaatattggtaaaaagaaacaaaatgtataaacgaacgaaaaaggaagtgatcaaaatagagtaaggaaccaaggcattaggttcacccgaacgttatcatatatacgctcatattattccaagaaagacacatttgtctagataggtttcggtaaaggcgtccgtagttagagagtagatggcactaacttgaaagcaggaaaacaaacaattgtgttccagagcaaactcgaactttctatctgaaccattgcatgacgtaaaattattattacaaccataatgaaacatttctacagtatatctttaatattattttttactttagtgtccttatcgatcagtcgctctttcgccaactagccgccaattgcaaaagccgataagcttatttcccctcaagccgtcaacaagaactacagcaataacaaagagagtgaatgcaataaaggtgtgcgcaacagtgtaaaatgatactaaagcttgtacactgtttagttgctcttacaggattaatctttgcaaagccgtatcaacaacaacaggcagttttagcgccgtcgcaggatgtaccattaagagatatccatataggggatataaattttatccatacaaccgatactcatggctggttggggtcccatctatcacaaaacgactatgatgctgactggggagatttcgttgcatttgtagatatacttagagaaaaaattttacgacagtccagagacgtaatagtcatcgacactggcgacaaacgagacggtaatggtttgagtgatgctacttggccccccggcctacgaagctcggagatattcaacatgatggattacgatcttttaacgttaggtaatcatgagctatatacagctgaaagtgccatactagagtatagaggaacttctcagtcctcaaaattcaaagacaaatatgtttgcagcaacgtagaatttattgaagatgacggaacaagggttcctttcgggaataaatacattacattcgagactcccataatgaaacaaagagtcctggcattatcatttttgtttagttttcaaagagcaaataacagagccatcgtaacaccaccattggaagaaataactcaaaaaagctggttccaaaatatggttgagacaaacagagaggaggaaatcgacctaattattgtctttggtcatttgcctgccactgaccctacagagcgtgaaatgcacaaaattcatgctctaataaggaaatactacccaaatactgttatacaatattttggagggcacactcatatcagggattttgtacagctggactcaaaatctacttgtttacaaagtggtagatttgcggaaactgtgggattcttgtcaattaatatgactgaccctgtggacgccgaaagtcctattttctcaagaaggtatattgactttaacaaggaagctttcaaataccatttgagcaaactagggcatgactcgaatgttccagtctcaacgaaaaagggtaaaactatttctcgtttggtgaatgatctgcgccatgaactaaatttgaacgagaaactggggtacattcctcaaacttactacgtttcaacaaggccattaaactccgaagagaatctttatcatttgatcacgcataagattttacccaatttaattcctcccaaaaactatgaaccttcgatgagtcgtttcattttgattaacactggctctgtcaggtacgatctttacaaaggcccatttacaaaggatactgagtatatagtgatgccattcaataatgattggcgcttcatcacagttccattggtcgttgcctccagggtggaaacctatttgaacaagggccctgtcattgcctcattaggaataccatcatcgtctcatcacaaacagcattttggcggttttcagaagtgtcccttcatcaataatccaaatttaagcgaaggctacaccacagaagacgatttcgggtgtcatggtgatgacacacctcacaattcacaaagagaatacgatatccccaatgtagtgcaatgtaaagaggtgaagaaagtgcaagaagaggaagctgatccgtcgaagatggttcatgttatcttctattcctttatggaactcgatatattaaacgccgtaaattctatcataaatgatttaggattacgtatggagaacttgaccaccaatgactgctcccattatggtggtgattcaaccaaaaagttattacgggattacttttctcaattttagagtattctgccattttttttatttatttatgcacatcgtttaaaaaagttcatttgcagcggaaattgcacctttgctctctcgtccctgtctctaatgaggcacactggttacacatttcatgaaaaaaaaagaaaaattgtatgtataatgcttgtcactttttttataattgatatatgtatatgtatatgtatacatacatatatatagttgatttagaatttatttatattaaacaaaagacgaagagagggcagataacaatatttaaaatgtttacaaaccttgttgagctcttcttctgtcacgttcttcagcaatagacaacttgatacccttaccctttggcaaagaaatgtaaggcttaccttgttcaccaatgacgaagacattgttcaatctagtgacgaaagtgttgtccaaggagtccttgatgtgaaccaaatcgaaaccaccatcgtgtctttccttgtgaacgatagtaccgatacgacccaagttacgaccaccagtaacgtaaaccaacttaccggcatcgaacttgatgaaatcagtaatcttaccagaggccaaatcaatcttaacagtgtcattgaccttgatgtttgggtctgggtatctgatagttctaccatcgtgggtaacaacgtatggaacacccttcttacctaattggaccttcttgaccttacccaatttgtaagaggcttcttcatcggtgatacggtggacagcgaatctacccttgacatcgtagaccaatctgaagttttcattggtggcatctagagtgatgacgtccatgaaaccagctgggtaggtggtgtcagttctaaccttaccgtcaactttgacgtgacgttgcatcaagatagccttgacttcacggccgttcaaagcatactttaatctgtttcttagaaagacaatcaatggcaaggattcacgcaatttgtgtggaccagcagatggtcttggggcgtaacaaccggacaacttgtccaataaccaatggtgtggagctgctaatctctttagatgcttctttctatatgaaaaatcgtattaacattattaaacgtactcttgttagtaaaaatatcccgcaatgcttatctgttacttaacaaggataaagtttctcatcagaattctatcttccagatagataaacacaactcttatattctttctttagtccgcatcgtcactttggtgcaaatcacttgtaccaatcatgagagggtacccatcttcaaagaaaactattatcttgttttgccaactcttcatttttttaggtggaaatcaacatacggtcctctagccatctttcctcaatagtggtgtatctattgttatacttagtcgacgttatatgaaaaagaaactattctaaatcttacaatatcactactattaactctaccgataataaaacaaagcgacttgaagcagctccaaatcctagagaaggaagatacgatgccattgcgctaacgaaaccacatggatcctccacacaaccacttagtttggcaaatcccaagaccaagaggaactttcctcaccattcggggcaggtgacgaagcaagagcgaagctggattctacgctggattagtgaagcgccagcgaggaatgctagaaagaccagcccaggaacaatagaaaattacgcggtaggataatctccttgacggaaaaacgctgtgtgacactgactagcctgaaaaaatagaaaaaaaggagatgcgccctgcaaaaagcgcaataacgcgcacacaaaatgtctgggtgaaatgtatggatgcataattgtctcgaaaataattgtttaaagagaataaccataaaacaggctgaaaagcaagcactgctcaatgttagtttcactggcgactctatctcaccatggttacactattagtacatttggtatagactgataggtttccgttgtgctttaacgacgggtaacgatttatttctggcgtgtttcagcgactattaataataagcaataaagaaggacgcgtttttgaatatgtattaatgggtcaagagtaaccatgataatttcatatttccatggattggttacattcagggaaatagaatggtttgctgcttatgggtgcttctagcattgttgcttcatctcgatcatgtagcatgcgaagacgatgcgtactcattcacttctaaagaacttaaggcttacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatgaaatcactcttttagatagacctctacagcttttacataatggcaccagtaataaatgatgaacgatttcgttaccctcggtaaaaccggccaaaaaaaaaaaaaaaaaaaaaaaaaaatgttctcaaagtgtaaacttaatcaaaagcttatttgtttgttatctgtttctcatcggtttcgtttgttgcttaaagggtggatcggtcatttacgataacggttctttctgcatattccgatccttaaaggcttacttattcacattacgggtccaatataacatagattgttgtgctcagctcatccatttcgctggtcgcttatattctcttttttgttttattcttttctttccttcaaggttctttgcaacagcactgaaaatagttacaaacaactttgcgccagttcccgcctgcttattctttttccagctctcttctactttatatacccttttcgtggtcctttttcctaatttgcccctcttcgctttttatcgaaaattttacccactctcacataatcacctaagggcatctatttaataaggtacagtcaaaaatttactcttttggcaactgtttataagaagaataagtctgagaattatactcgtataagcaagaaataaagatacgaatatacaatatgatgaatttttttacatcaaaatcgtcgaatcaggatactggatttagctctcaacaccaacatccaaatggacagaacaatggaaacaataatagcagcaccgctggcaacgacaacggatacccatgtaaactggtgtccagtgggccctgcgcttcatcaaataatggtgccctttttacgaattttactttacaaactgcaacgccgaccaccgctattagtcaggacttatatgcaatgggcacaacaggaataacatcagaaaatgccctttttcaaatgaagtcaatgaataatggaatatcatcagttaataataacaacagcaacacccctacgattattaccacgtcacaggaagaaactaatgctggaaatgtacatggcgataccggtggcaattctttgcaaaattctgaagatgacaacttttcttccagttctaccaccaaatgcttactctcttccacttcttcgctatcaataaatcaacgagaagcagcagcagctgcttatggtccagataccgatattcctaggggtaaactagaagttacaataatagaagcacgtgacctagtcactagatcaaaggattcacagccttatgttgtttgtacttttgagagttcagagttcatttctaatggtcctgagtcactaggcgccattaataataacaacaataacaacaacaataatcagcataatcaaaaccagcatattaacaacaacaacgaaaataccaaccctgacgctgctagccagcatcataataataacagtggttggaacggttctcagttaccatcgataaaagagcacttgaagaaaaaacccctttatacacacagatcatcttcccaattagatcagctaaactcttgctcttcagtaaccgatccgagcaaacgttcttctaattcttcgtcgggttcttcaaatggtccaaagaatgatagttcacatccaatatggcatcacaagacaacgtttgatgttttgggatctcactcggaattagatatttctgtttatgatgctgcccacgaccatatgttcttaggccaagttagactgtatccaatgattcataatttagcacatgcttcccaacaccaatggcacagtttgaaacctcgcgttattgatgaagttgtgtccggtgatattttaatcaaatggacttacaaacagacaaagaaaagacattatggcccacaagattttgaagttcttcgattattgggtaagggtacttttggccaagtctaccaagttaagaagaaagacactcaaagaatttatgcaatgaaagttctctccaagaaagttattgtcaagaaaaatgagatcgcccacacaattggcgaaagaaatatcctagtcacgacagcgtccaaatcgtccccattcattgtcggattgaagttttcctttcaaacaccaacagatctgtatttggtcactgattatatgagtggtggagaattattctggcatttacaaaaggagggccgtttttcggaagacagagcgaaattctatatcgctgagttagtcctagcgttagaacatttacacgataacgatatcgtttacagggacctaaagcctgaaaacattctactcgatgccaacggtaacatcgctctttgcgattttggtctttctaaagctgacttgaaggatagaacaaacacattttgcggcaccacggaatacctggcaccagaattgttactggacgaaaccggctacaccaaaatggtcgatttctggtctctaggtgttttgatatttgaaatgtgttgtggttggtcccctttctttgcggaaaataatcaaaaaatgtaccaaaaaattgcctttggtaaagtcaaattccccagagacgtactgtcacaagaggggaggtcttttgtaaagggtttactaaacagaaaccccaaacatagactcggtgccattgatgatggaagagaactacgagctcatccatttttcgcagatatcgactgggaggccttgaagcagaaaaaaattccaccacctttcaaacctcacctagtctcggagacggatacctcgaattttgacccagagttcacaacagcttcaacttcatacatgaacaagcaccagccgatgatgactgctaccccgctatctccagccatgcaagcaaagtttgctggtttcacctttgttgatgagtccgccatcgatgaacacgttaataacaacagaaaattcctacaaaactcgtactttatggaacctggttcctttatcccgggaaatccaaacttacctccagacgaagatgtcatcgatgatgacggggacgaggacatcaatgatggattcaaccaagagaaaaatatgaacaacagccattcgcagatggacttcgacggcgaccaacacatggatgacgaatttgtcagtggaagattcgaaatatgatttctcaatcgctcctcttgcccttcctcttcttttccttttctttttatttttttctaatttttctatcttttatttctacttctattattaatttgtatcttctaatcgtttttcccactttatcgaaacatttcttctatttatatatgtaaagtatgtatgtattttcgttttatttaaactccaaaaaatgaataattgttcctgcaaatttctagtttatcacgtctcataatcactgcttatacctcaccattccattgtactttgacatatttacccctcatctatatataatcagggcttaagtaaacgcttcgctgtgatttcccaaagtcggttcggaaattataggtcggttatatcatccgaaaaaaaaaaaaaaaaagtttttcttaaatgcataggtttaaagtcgattaaaagtagggctaacacaagtataagcagggttttgctataatagggatgccataagtgagggcagggctcatcgatgcgcgtacatggattttccgaaattctgaattttttctttctttaactatgagcaaaatgtggtcagctttactgagcttaactgtcatcccatcgaatgtgacaagattgaaagtgcttccaggatctgaaacatttgtcaaagttttactaacattacacagatatccctggtcaccttactatcttccaacatcttacctaggcttgctgcttttgtttgggtcatatatttaactcgctcattagaggacattctgttttttccaagaccaacaaaaaagcaacgaaattgctgtattattaaaggactgttatagaagtttttttatcctctctttgtttccattattcttattcctattttttcgttgcttacttttgatatccactatgagcttttccaccataaatagcaacgtcaataaaaccaccggcgatagcaataataacaccaccgagaacagttcgactgcagaccttttaggaatggacttgttgcagagcgggcctcgactgatgaacacgatgcagccaaacaactcttctgacatgctgcacattaacaacaagactaataacgttcaacaaccagctggaaacacaaatatcagcagtgctaatgcgggagcaaaggctccagcaaatgagttcgtaagaaaactgttcaggatactggaaaacaatgaatatcctgacattgtaacttggactgagaacggcaaaagtttcgtcgttttggacacaggaaagttcactacgcatatattgcctaatcacttcaaacattcaaattttgcatcttttgtaaggcaactaaacaagtatgactttcacaaggttaagagaagtcccgaggaaagacagagatgtaaatatggcgaacaaagttgggagtttcagcatccagaatttagagtccattacggaaaaggtctcgataacatcaaaaggaaaattccggcgcaaaggaaagtgcttttggatgaatctcaaaaggctcttttgcatttcaatagtgaaggcactaaccccaacaatccttctgggtctcttttgaatgaatccaccacagagctgttgttaagcaataccgtaagtaaagatgcatttggaaatctaagaaggcgagtagacaaactacaaaaggagttggatatgtccaaaatggagagttatgctactaaagtagaactacaaaagttgaactcgaaatacaatacggttatcgaaagtttgataacattcaagaccataaatgaaaatttactcaacaacttcaacactctgtgttccactttggcaaataatggtattgaagtgccaatatttggcgacaatggaaaccgtaacccaactggtaataccaacccagcaacaacaacagctatccaaagcaacaacaacaccaacaatgcttctccggcaacatctacagtttccttacaactacctaatttacccgatcagaatagcctaacaccaaatgctcaaaataacacagtcacgctacgaaaaggtttccatgtactgttggtggaagatgacgcagtgtctatacagttgtgttcaaaatttttacggaaatatggctgtactgtccaagttgtcagcgacggtctttcagctatctcaacactagagaagtataggtatgatttggttttaatggacattgttatgccaaacctagatggtgccacagcgacatccattgtcagaagttttgataatgagactcccatcattgccatgacaggtaacattatgaatcaagacttgatcacatacttacaacatggaatgaatgatatcttggccaaaccattcacgagggatgatttacactcaattttaatacgttatctaaaggaccgtattcctttatgcgaacagcaattaccacctcgcaactcttcgccacaaactcattccaacaccaatactgctaattcgaatcctaatacgattaatgaacagtcgttagccatgttaccacaagataatccgtcaactactacccctgttaccccaggtgcctctatatcttctgcacagcatgttcaacaaggtcaacaagaacagcagcatcaaattttccatgctcagcagcagcagcagcatcacaacgccattgctaatgctaggtcagacgtagccataccgaatttggaacatgaaatcaacactgtaccacattcctcaatgggttccactccgcaattaccacaatctacacttcaagaaaaccagctatcataaaattttacaaatagccttgcgtctaagttagcagaggacattctgtattcctgaggagtttctttatatttattatgtgatcttggaggattatcattttcttttcgttcaatattttatccccttcagttatttccagttatctacatcaaaatgtttgaattttatttctttctgccgctctcaaattcactctcatttcttttttctttgtttttcttatatttactatatatatatatatatatatatatatatagccaaaaacaataacagacacagtaatttagtatgcgtttatctcttatctttcatccactgcgaccgaaacgtttgaatcgaatctgactgaggtttttcttacattcccttgtgtatcaacagtttctggtatgtctaattcaaattcttttccattcttcagtatttcttttaaatctggctgggcctctctcatggaagatttacgattaccagttgatttcttagagccatcttcactactatcattggaatctattttttctactcctaaattagcatccgcattctttttctctagatttggaactctttcaaatgtagatagttcattttgacagcggtcacactggcataagaagccccagttaactcttaattccctacgcctcaacctcaccccatgtaagggattgacgtacgtaatacgtatttgttcccccttctttattggtttccttgcatgcaacctcagttcctcatgttcttctacttgctcaatataggcgtttggttcacaatcatggtttatgaaggagatccaatgatatacctggccgttatattgattgatattgaacgtcccgatcatggtcaaaaatttctcgaaatctatttcttcagaagcttttggaaatgcaccgcaaaataattcgtagcacttctcccaaacagtctcgtcatcaatattcttctcaacgccctttttggtaccattatcagattcctcttcagtatgtacagttgtaccattcagtaaactaaacgtactgccgataccgctggcgtctcttaatttaattctttccctttgtgagatgcttgccaatttttgccattgctctttgacctctcctgtagtatccaaaagcatggatccatatataagaccaactgaaaaggcagcggtaaaacaatatttctcacagtagttaacaaatcttttccaattaccagcatgaagaatgtctattctattcgatctccatgagtggtataaaagctcatgtaacgacgcatgtgcttttttacatttttcactgcaccaaatagctttgcaaacttcacaatccaaataatggaccataattttgtgctgggtcaaatcatatagcgccttaccacatcgagcacatgcctttccattagatattaaaaaaagcttgtccagtggtggaatatatacgataggtttattttctttcaggatgatttggcccttggaaaaatctcttttagcgaaaaggccccttccatgttcgtcatcaataaatttcacttcgaccttagcatcagaatctagggcttttggaaaatgtattttatctttatatagagaaacggtctctagatctgtgtcataaagatggtgctcatttagaatttttcgaaaacgagaagcactcaatttccacgattgatttctttccgtaatcctgtcataaagatgctgaatcgtagcgtcttcagttccgggctcttccttccataacaaaactacgtcatcacagatctcttcctctgtgggagttatctttcgaaaatcagagccattttctgtaccattatgcactgcagattgatcgctatcgtttaaggttcctattttgatagtcaatgtcatttttgtgccacttttcgttattttgtatcagtgcacgcttggttatttacctatttagcttctattgttatatggagaagttccccatgattatgatatcaagaaagaaaaagaaaaagaaaaataatacgaaaaaaaaaattacgaagctaaaataaaaaaaattacggcaaggaaagggtttactgataaaatttgttatcattcttgctagtcagtaagagcatatctgctcaagtagacaagggaaactatcgcaggtggtccggaaagtacttgacaatcaaatgctcgtctgaaagccaatgaggaaaacttgtagactgtactaatttttcaagagaaagaaagataccgtatgtttgactattctaacgagatttatgctacaaactcctcgagaagcaaactgaggtagaattacccacccacagcgcgataagtcacattggcgccctggacttgacgaatactcctatcaatagtaaggctcgcaaaccgcccgtccatatcaagccattaaattctgttattatccttaaaagtgaaatgcgcaccacaagcttgatggcatttccttctgcacttctcaaattgatagcattgccttgcgagcagtagataatttagataaagtgtatcttgccagggccttcccaggcattaactagataatgtgttcttttttagctgaactgtaaagcgtaaatgttaacgctggataagtaccgcgtgtacggttgattgaatgatcttactgatagaggccaggcggttgatactttgtgcagatttcataccggctgtcgctattattactgatgaattggctctctttttgtttaatggcccatccgatccatattgccttcttatgactcaaaattctattgtgtttgccggtaccggcctttaagctttgaaaaaaaaaaagcatctgaaaaaaatggcactataaagagagctagtggtaacaactacatgttttcgttagaataaatcaccctataaacgcaaaatcagctagaaccttagcatactaaaacatgttgcagagacattccttgaagttggggaaattctccatcagaacactcgctactggtgccccattagatgcatccaaactaaaaattactagaaacccaaatccatccaagccaagaccaaatgaagaattagtgttcggccagacattcaccgatcatatgttgaccattccttggtcagccaaagaagggtggggcactccacacatcaagccttacggtaatctttctcttgacccatctgcttgtgtattccattatgcatttgaattatttgaaggtttgaaagcctacagaactcctcaaaatactatcaccatgttccgtccggataagaacatggcccgtatgaacaagtctgccgctagaatttgtttgccaactttcgaatctgaagaattgatcaaacttaccgggaaattgatcgaacaagataaacacttggttcctcaaggtaatggttactcattatacatcagaccaacaatgattggtacatccaagggtttaggtgttggcactccctccgaggctcttctttatgttattacttctccagtcggtccttattataagactggtttcaaagccgtacgtcttgaagcaacagactatgctacaagagcttggccaggtggtgttggcgacaaaaaattgggtgctaactatgccccatgcatcttacctcaactacaagctgccaaaagagggtaccaacaaaatctatggttgttcggcccagaaaagaacatcactgaggttggtactatgaacgtgttcttcgttttcctcaacaaagtcactggcaagaaggaattggttaccgctccattagatggtaccattttagaaggtgttaccagagactctgttttaacattggctcgtgacaaactagatcctcaagaatgggacatcaacgagcgttattacactattactgaagtcgccactagagcaaaacaaggtgaactattagaagccttcggttctggtactgctgctgtcgtttcacctatcaaggaaattggctggaacaacgaagatattcatgttccactattgcctggtgaacaatgtggtgcattgaccaagcaagttgctcaatggattgctgatatccaatacggtagagtcaattatggtaactggtcaaaaactgttgccgacttgaactaatgataatgaaggtaaacatcccctccccccccaaaaaaaaaaaacgagaattcctctcagaggatctgtttttctctcactttattcacatagatacatacttttttacaattcctgttgagtttatttattataagaaatattggattactattattattatagcttatgcaagccattgtgcggcttcttacgctttttgaaattgttgacctaacaacttggcacattattgaatttcatagagactgcttgtaatttagttgccaaggtatctcgctggactttacatgtaaaatgaatgcggcaagatacccaagagagttgattatgccaaaaaaaaaaaatctataaggatatccctggtattttctgaagaataaattctagcgtagttcagaagaggtgcaagtacagtatgaataatggtatgccttccatcatcgtggcatacaggttcaggcatgaagagatgattatgttccctcaccggtccataatcctgatttaaacagttcattagtatatgttcagccaacacaacaacgagaagctttgtagtgaaagttttccacgatctatatttagcattctaattagcggccccaagggaacgtatataaacataaacaaacggcacgaactaaaggggcaaattcaagttaacccttttacactcagtacatcttcaaagccagtcttctgtcaatggaagaatccagaatgcctaaaactagttatttaaacaaaaattttgaatctgctcactataataacgtacgtccctcttaccctttatctttagtcaatgagataatgaaatttcacaaaggcacacgcaaaagtttggttgatattggatgtggcacaggaaaagcaacttttgtcgttgaaccctattttaaggaagtgattgggattgatccttcttctgctatgctttcgattgctgagaaagaaacaaatgaacgtagattagataaaaagattagatttattaatgcgcctggtgaagatttatccagcattcgaccagaaagtgtagatatggttatttcagcagaagccatccattggtgcaatttagaaaggctgtttcagcaggtttcctctatattacgaagtgatggaacttttgcattctggttttatattcagccggaatttgtggactttcccgaagccttgaatgtatattacaaatatggatggagcaaggattatatgggtaaatatctgaacgacaaccaacgggaaattttgttgaattacggtggtgaaaagctacgttctttattgtcagatcgatttggagatattgaagtcacaatttacagtccttcggacccaaatgcatcaacagtaacggctgaaaacagtcagtttctctggagagcagctattactctcaatcaatttaaagagtttgtgaaaagctggagcatatacacttcttgggctagagataatccctcgaaaccggatattgccgatatattcattaacgagctcaaagaaatctgtcattgtgaagatttgaatgtacctttaaaaatagagtggtcaacgttttattacttatgtaggaaaagagaatgaggtttactaaattaaaagaaatatataaaaagctgatttttttctttttttaaatatttcccaaatgctaataaatattaaaatatggcaaaaagaaaataaggtgttgttgcgcagttgggagtaatttaaaaccgtcaacatatgctctaaaaattttattggctctaaattccgacctctgaatgtaattatgttttaaagcgatacgtaaacttgttactgttaacattaaaagataatgcaatcatggtaacataataaagtctcaaaaaattcttaatattaactataacatatgcacttcagaaagctgtttccggatcatatctcattataaaaagctcaatttatagaaaaataatgcgacagtgcaaagtaaacaactaaatttggtgcctacaccgcaaaacgatatcgagtcttagaagtatatacctcaccacgtctcaaaagaacgcagtctctccatccatcacggttgattgcgtcaacatatctgccttgttcaacggcaaagccagatctcggcgtaaatccatcacacaagttgtcacctgtgtaaaataggacagttggttctgttgttgaaacctccaatgaaagtcgtgatgccggatgataagccttgaaggcagggacgagcttgtttacacttactgagtctgtcgttttcaaattcttattttcatcaacaatgaaagcgtagtcataaatcgggccatcatcctgcagaatggtaggtttggaggagtcaaaagtagcaatttttctttgaacgattttaccggttggaattagtgctccttcgcttacttccaatgatttatctgagcagagcctaacctccgtaccgctaatggattttttatccatagttttgtttaaattgaagtacgtgtgattcgtcatgttgatgggagtagcctcaccgctgaccagttttgcctcgtattccaagtccaaggtcatgtcagcaacgttcaatgtgtactttaagtttacagctagatctcccggaaattcattgggcagtgtgcggtcatccaataacgtaaattcaacaatgtaaaggtcatcaagaggattttggactttggatgccttatacttcttgagatggaaggagctgatgctactgtggttggtgtttccacaattgttcactgtcaactgatgaggtccatcttccatactgaacatgcccttgtaaatacgatttgcataacggccaacagtagcaccaatgtagttgtagccatctgatatatagccatgaatatcagggtatcctagaacaatcgattcgttgttcactttcaagtcaagcaaagtagcgccaagctctgaaattgttgcttgaagcttttttgcatcaccaatagtgatgacttcatattcaccgccagccttattatttgacattatcactttttggctttttaggtgaatttacttattgcagtaacataatgtacaattgagttccagtacttcgtagtacattctgattttatatctcagagcatccaaggtgtttacgcatgaataaccaaaccatggaggagttacttttacctttttttaagatattcagctagtaactaattgtcggaaaaacttaacaggtacaaggccatattatcacgtaacaaacctaatttttgtacgatattagtgcccgagaatttctccgtagcgtaattttctgcgagaatttctgcgcagtgcaaagatatgcgacctgacactctttacgaaactttacccctcccccacctccacctgcatttatcccgtcaaaaagtgtcaatcacctggatgcataaggaggaaaaattattccaaggatgttggacaacgcgaattttggaagtgacttctcataagcttctgatctctactatattcttgtaatttggtggggtagtgcaggcttactgtgcgatgagcaaatccagcgtattgctcacagcgataggcctttgaaatgatattgtttgaatgcaaaacgcagaaatgatattcaacttcataatctcattaaacaagatagcatgccaatagaattccattttttccgattcttaggccatttacaaccaagtatcaactttcgtataattttatttccataattatacgcaaatgctgcagtagttgcacatagaatgatgatacgacctaataaaggaaaaggggaatctgttctgagctgaaaactgattcaaaactcaatttggacactcggttcgggtgctggccagcaatagtttagtgttatcatgtcataatcttcctcataggtttcaatgtaatatcgataattacaaagtagttccttttcatttaaatttatatgcaagaagataagagttgatgtagcagtgcaccagttttgctttacaattcttacagttttatgaaaaataatctccaatatgccatgctgaactggcattctttttgagtgcaaaaggaggttttggaaaaacaaagtcttcttctgcgtgttactctgaaaatgttgaaaaataagctgaatggggcattacatgttttcatccaaacatgccttgtcaataacgagattcgcgacgtattcttttagtattctgttcctttttttttttgctccgcgcgcacttgaacatcttgcatatttttcttttctgttttcatccagaggttgtgttctaggactttctgacggaggaatatcatcaaatcatcacaataagatcaattgcatgggttccagcacttagccaaatgtacaaatcttgatatttaccggagaccaacccttagtttgaagtgtgcgctaccagggaatcttcttcggtcattattttctatcttcacgataatcgatcctcctcctatacgttaatatcgactgatatctaaatacatcgttgaagaacggcggaaaaatacttattttcaggttgtcttcgttttcactcacgatagcaatatggatcctttcacagctcctatcaccgctgtagttttttatgacgcttaatttcctgttaataagtaaataaggtaagttgaaggtccttcatactgtgatctgcaataaaccacatggctaccgcacttcttgtcactatcctatgtggagaaaacccagaaaaaactttaaagcgtgattgaaatcaataatttggcaaagaactagaaccatacgcaagaaaaccttccaactttggcattgtacgcagaaatgagacacgttcaaagcacaggtcttgaaatttaaaaaagtttctcaaaagttctcccaaaccttcaatttctattggtataacagtattctaggaagaaaacaggcgaagaaagtttctttactttcttcctttaatagactttcatgaatatcaaatgctgttgttttcaactaaatcagacaagcaaaggcgattgctaaaagtgaacatatggaaaatatatggaaaaaatctagaggcaacaaacgttcgggtttccttttaactccgagaaagaaaaatcattagaacttcgtgttaatcctaatagagttcaaatatgctactagtcgtcagaaacctcagttacatgattacacattctaagacttcacaagtgaaaaatttcccgacgttcatagcatgttacgtgatcgcgcaggatgggacaattaaacgatctttgcagtggagaaggaataacttccggttgcagctacttgtcaaacagaacactggtatggataagataatagtcagatcttttattacttatgaaacaatgtcagtaacacagcgtgtttaacagataatgttcttttaacaaaattaaatgaggtcttttattgtgtgtgtcaagttgacaagccgcctttattgatagatccccactaaaaataccaggaaatgatgagctcgagtctttgtgcctttctcatcatggaccattcgcacatgcagtgctgcacaacaaaagataaatcaccagtattaggtgactttcaaaacactagaatttaggcactttcaacccagcccagcgcgtagtaagaataaagtaggggaaaaccttacgaaaagcctctttcttttttgtaaaaaattctgtttttaatagccagttctttagtgattacaggtaagagggtttcatattttagaagtgcagccatgatgaagcacttttgctcatttattgcgagaagtttaataagtagtatggttccattttcaagaatcgaggcactgttccttcccaaccttggaatcatactccgaaaggatttcaagccgatttaaattcacctggtaactttcctacggtttggcccaaggtgattataattaacttgcggcttgttttcagcctgcgatcgaaccttttttacgcaaaaaaaccttattaattaaggttttgaaaattttcttctttccgggagattttcatgtagcctcgagcttctggattctcacgggattatctcgcgttacattttttactttcttctttctttttgacttaggatatacagatgatacgtcattgtgtcataaaacccgctgttgtgcaacaaaagggaaaaagaaaaatactcctttttaggtcttataaatatttttagcagccatcaagtccggctttcaaacttaatttcaccctttttcacggcaccctcgagaattacactttggttgcatgcaggagtacgcgaaatgcagcataagctacacatctatgcgtagatcgcttaacctctaaaggccgtaaacttttattttgttttgcgctcattaaaacctagtgggagctggtaggaaataagctagtagcttctatggatagaatggaaataaacgtaggtgtaaacactattggtagagaagttcctctggtcaaattttcatgggagatacgttaaatctttcacagtcttatcgttttgaatcactggacggttctggtattctgcttcatatttcgacaagataataaatataaaaagagcaccctcatgatttcttgctctgcagtaaattccgcaaatgattttctttaaattgattagcaccactaaaaaaaatgacaattgcacaccactgcatatttttggtaatcttggcctttctggcactaattaatgtggcctcaggagccacagaggcgtgcttaccagcaggccagaggaaaagtgggatgaatataaatttttaccagtattcattgaaagattcctccacatattcgaatgcagcatatatggcttatggatatgcctcaaaaaccaaactaggttctgtcggaggacaaactgatatttcgattgattataatattccctgtgttagttcatcaggcacatttccttgtcctcaagaagattcctatggaaactggggatgcaaaggaatgggtgcttgttctaatagtcaaggaattgcatactggagtactgatttatttggtttctatactaccccaacaaacgtaaccctagaaatgacaggttattttttaccaccacagacgggttcttacacgttttcttttgcaacagtagatgattctgcaattttatcagtcggtggtagcattgcgttcgaatgttgtgcacaagaacaacctcccatcacgtcgactaacttcacaatcaatggtatcaagccatgggatggaagtctccctgacaatatcacagggactgtctacatgtatgcaggctactattatccgctgaaggttgtttactccaatgccgtttcctggggcacgcttccaattagcgtggaattgcctgatggtactactgttagtgataactttgaagggtacgtttactcttttgacgatgacctaagtcagtcaaattgtactatccctgatccttcaatacatactactagcactatcacaactaccaccgagccatggaccggtactttcacttctacatccactgagatgaccaccatcaccgatactaacggtcaattaactgatgaaactgtcattgtcatcagaactccaacaacagctagcaccatcacaactaccaccgagccatggaccggtactttcacctctacatccactgagatgactactgtcaccggtaccaacggtcaaccaactgacgaaactgttattgtcattagaactccaactagtgagggtttgattactacaactaccgaaccatggaccggtactttcacctctacatccactgagatgactactgtgaccggtaccaacggtcaaccaactgacgaaactgttattgtcattagaactccaactagtgagggtttgattactacaactaccgaaccatggaccggtactttcacctctacatccactgaggttaccaccatcactggtaccaacggtcaaccaactgacgaaaccgtgattgtcattagaactccaactagtgagggtttgattactacaactaccgaaccatggaccggtactttcacctctacatctactgagatgactactgtcaccggtaccaacggtcaaccaactgacgaaactgttattgttatcagaactccaaccagtgaaggtctaatcagcaccaccactgaaccatggactggtactttcacctctacatctactgaggttaccaccatcactggtaccaacggtcaaccaactgacgaaaccgtgattgtcattagaactccaactagtgagggtttgattactacaactaccgaaccatggaccggaactttcacctctacatccactgagatgactactgtgaccggtaccaacggtcaaccaactgacgaaactgttattgtcattagaactccaactagtgagggtttgattactagaactaccgaaccatggactggtactttcacttctacatctactgaggttaccaccatcaccggtaccaacggtcaaccaactgacgaaactgttattgtcatcagaactccaactactgccatctcatccagtttgtcatcttcttcaggacaaatcaccagctctatcacgtcttcgcgtccaattattaccccattctatcctagcaatggaacttctgtgatttcctcctcagtaatttcttcttcagtcacttcttctctagtcacctcttcttcattcatttcttcctctgtcatttcttcttctacaacaacctccacttctatattctctgaatcatctacatcatccgtcattccaaccagtagttccacctctggttcttctgagagcaaaacgagttcggctagttcttcctcttcttcctcttctatctcttctgaatcaccaaagtctcctacaaattcttcttcatcattaccacctgttaccagtgcgacaacaggccaggaaactgcttcttcattaccacctgctaccactacaaaaacgagcgaacaaaccactttggttaccgtgacatcctgcgaatctcatgtgtgtactgaatccatctcctctgctattgtttccacggccaccgttactgttagcggcgtcacaacagagtataccacgtggtgccctatttctaccacagagacaacaaagcaaaccaaggggacaacagagcaaaccaaggggacaacagagcaaaccacagaaacaacaaaacaaaccacagtagttacaatttcttcttgtgaatctgacatatgctctaagactgcttctccagccattgtgtctacaagcactgctactattaacggcgttaccacagaatacacaacatggtgtcctatttccaccacagaatcgaagcaacaaactacgctagttactgttacttcctgcgaatctggtgtgtgttccgaaactacttcacctgccattgtttcgacggccacggctactgtgaatgatgttgttacggtctatcctacatggagaccacagactacgaatgaacagtctgtcagctctaaaatgaacagtgctaccagtgagacaactaccaatactggggctgctgagacaaaaacagcagtcacctcttcactttcaagattcaatcacgctgaaacacagacagcttccgcgaccgatgtgattggtcacagcagtagtgttgtttctgtatccgaaactggcaacaccatgagtctaacaagttccgggttgagcactatgtcgcaacagcctcgtagcacaccagcaagtagcatggtaggatctagtacagcttctttagaaatttcaacgtatgctggcagtgccaacagcttactggccggtagtggtttaagtgtcttcattgcgtccttattgctggcaattatttaataaaattcgcgttctttttacgtatctgtgtatcttttctttgctaaatatacgctgacatgaattattttttaactgtttcttctccatactttcaaatattcaaattgaactaaatgataattcttgcgcttcctattttgaaaaagtagatatgtgtatcataaagaaaacgttactattattgtcttaggcaacaaaaatccatgaaaagaattttaccgttatcgataccattgtatttattttatttatttatttaattttttttttttttggtttatatcctgcaaacaacacttcgaattcaattcgatatttcataagttacaactaacacttatagaaaccgatgtatgagtacttattattaacgaggaaaaatggcctattttgtttagcaattaatgaaccatcgccaatttttgctttaacaattattgccattttcagtagtactaacgtaagatctagtgtggttcgcttaggatgtttttgagtagaaatctgcttacatgccacacgcagtacttgaaacttgaaataatggggataattagttatttaaagtatgtgcttgttcttttatatttatttcgaattcttttgcactagtatttaaaatatcagcagaggcgtaaaagtgcaccaaaattattgtaaaactacttgccctaaaattgatacttcatacttgacatattcaaaaggggtccaagtatagatgcatcaaaaaaaaaaaaaattatccgatgatgagcaaatggtagcttttcgttccccaggaagtgtagtagttccatgaagtctaatgagactttggaaaaaggtttgtcacgagcaccgaactactgtattttggaattttgataaacttcaaaacgggaacgaagtgttaaacttagatgcggttgttttaagctttaaaagaggaaaataatgactggtgataagaagtcaacaacgattcaaagcaggtgaatttccattacgtttcgcttttcaattgaaaaaaatttggtggttattcgtttcttgcttgacctcttcattttttatacttctgtgatgagaagcaagttcgaggattttacgataaagcctactggttatatttgtataaattagaacgttgtccttatttctcttttcgaacagtatcaaaataaagtttttgattagggctagattctcttcaaggaagagatacctcacgtctgtaatatctaagagctaatgtttcgatcgaactttcctttgctttttttctggatctcataatgtcccactgtatgtatgtgccctcgcacagctttgctcatcatagacattaatcattggttgtatgataaaaatatcgcaagaattattctaacgttcagattagattccagccatatttctgacatttgttttattaataaaaatttggcgaatgttttgataacttgataactgctggtatttcattgttgaaaaggcatgatattagatgcacaaagtatattataacttatgatcagagatataggaacaaaaaaaagggaaaattcatatctatatgtgaaaataccattatttcctctcctgtttaatattctgtccttaattttcatattacattatcaacttttgcatttcagtgtccattaaatcttgggaccattttctcaatcttcatgtcgtcttttcacaccgtatataatatactggtactataagtactagtcgatagatcgcagttgagtcttattccaacagttaatgattcactgagctttctgttgctgtagactttctgaggcatcgtcgctctcttctatgtgatgctacaacggaactaggcttcttatatatcgtggtcctacaagatcttggtatctcgtttgcttactttgaagcttcactgatatatagtatttaagccacttttatgttcatggataatcgtaattgtactacgctggtaccagttatgaaccctatcaaatcatcattgaacactgctatttttaactaatcaagatatgtatgcggcgtactttataatttcacgacactattgaaagcaaactaaaaatcaagtaaatacctatccaagttgcgggctctggatttatgtggccttaaattttcgacctatggttcactattcaatacgagaaaaccaaaattaggtacaagtactgattgcgttcgtgatttgaaaagcagcgttaaaagattacaagattttgcgtttccaggccgacacttaactttaaggtctcgacttggtaacatgagttgccaaaagtttttttctcctatctgaatatggggaaccggaatctgtctttgacctgactttcaaattgttgcatatgtaaaaaaaaaacagaagaaatattatcttctccttctagcgatgcaaaaggattcattacaaatcgtcgcaaaggctgacaagttgcagtatattcacattgcttatttgaagtacgtttgtatacacatcgatagtattcattaacaccacaactgctgtgtatactatgtcaaacagcacaataaagcccgtcattttcgtacccgctcatttccaataggtatctaaacttacaaatgtggtacactacttcgaattcattaatcgatattgaatgctaaaaagtctgcgatttcttcctcaacgttcaaaaatctcatccaaggcataatcccacatattgaagatcgctaccaattgttacaggcgaactgaagttttggaaatgagcttgtacttagtaaatttctctttgcttgcatctttttcttccatgccaaaaaataaaagatactcattttaaaaacgcagccatattgactaagtaagtaatcataatactatgagtaatttttgagtactgtgctcatttactagctgcttttctgagaaagatcctcgataatcaattccaggttagtggggcgcttctacggcctcttctaaccaattgttccccgtgagttgctttctctgaaaaccttattatacattagagttataagaaaattttctttttcccgtagattaacttgcagtgccgaacttctagatgtcacaccagaccgtttgacaccgccattttccttccttttcggaaaaatgtgccgataaatggtaagacgcgacgccactgctacgaatattacgcttatgatgaagcaaaaggaaaaagcaagttccccttaaattcgtataactgtttcatcaatctttagttctggcatttgaaagttaattaaacttttcttcgtggtttctacaggagttctgcatgtgcgtaattcaaagcctgtgaaggaaaaagtattgtcctaaacaacggtcgtagaatacgtcaactgtagtttaaaatattttctggctctactcggtgcgataggtctggctcttttctatttacttttgtttggagttgttgaggccgatacccgtctagatgtaaatatgaaataacagttcgaggttttattacgagaatgaaaagggtaatggattggagcatgtgtaaatgtcaatagcagaaaaaatttaccgcaaattgtttcgtagtcttatcttcatcggacactcaagggttgcataatttttacccaaaggaacagtatacttttttgataaaaaaatcttgttacctatacagtattgcaagcattttcagaaactcgtcttttgagttctaaatgcatcatacaacaacaacaacaatttcttattactgtgtccttttgggatttttcagccttcctagcttacccaaaatagcctctcaaggtgaaaaaaccatgcctgcaagcggatctaaggatgagtagctagattacaataaatcctgaattttctctgagtgtcaactttgtcatcgcttgttaaagggctactacgctgaaaaagaacctgaactctgttaataggttgaagattttatgacttggtatactattccatacggctgctctcctgattgcggtgggtcattgctataacagtaaaatcaaggaagataacaggaagagtaactttagtacaataaatctgttgtctcccgaggattataattgttcggctttcacactaagttgaaaagggggactcaggaaatgacagggtacgttttagtttctccaaataaatcttccacacccagcttcaatgtggtaaacggaggaaagttgattaattgatgttggcacttatatttaactgatgtagagaagaacaacatactactaacgtcacagtcaattgtgccagttttccaatcaagtatttcgagataatgtaaaagtaattgatatatgttcgtactggtttcccaatttccgggaaaaactatgtacatgggtgcaattccttgtggttatttccttttaggttatattgccaaccacatcatagtactatttgcggtcacttcagaagatatgtttgctcctttgatcatgatatagaccaggccaactgtaccgcttcaggcttcaaagcattaggaataagcaccactattacacaaccatagagctactcttactgtcacgtaggtaaaacacttgctactacacacactcgtagtgactcatctgactatattgccggttgttaagaggcaccagttaagcacgccatcaagggtaccgaataatctcttctgtatcaagtattctacctttatgtctgacccacgtattatgtggagcaattacgtatttttctcatatcagctttgtttttactcaactttgatatcttagagaaacagatcttgatgttacagcaaggtcaggaaaatattttgacaaaaacatactagtttcatccttagtagttgattctatgaatgctgtacttgaaaatattgttcataaaatccataagttttaccaacggtataatatcctgctattaaatctgcaattgcttttgcgaaaagaaggaaaacatgcaaaacaaaagcaaaaaaaaattggcaccccaatttcttataatataataatataacggaagtacaccatgctttcaataataagatgtttcctgaaaagggcaactatctgactagttcagagccatgcaaaagttaaggatgaaaatgccaaataagaagatattacggagtacattcatttcaaaaagaagaatgtatactgcttagataagaagatcaagtttttatatttccgaccaaataagccatcgaaaacttttgatgcaccaaacaccgttcttgagagccaagcacagatgcaattgttctgcccttcttccaaattatgaattgtgcatcatatcgtaaggccagccacataaaaaaaaggagcaaaaaactcagtatacaggcgaatatccatcatacagtctagctgccctcactacttccaaaaaaatgggctagtgttgtacggtttatgccatatatctagagttagcataactatgcactaccgcttttcgaacaaaaagtttgcgaaacctagttcattgaatatgacttacccaaaatggataccaagatcctaataataaagtcaataacttgaattttaggtgccattatttccaacaatcattataggctaactctaccagcagactagaataccgttcttctagttgagcacatggtcaaaatagtcaataaaaaacgcccagaaatggctgtaaattagtgtttgtagtacacaaaataatttcctaattccttccaaatggggttttcaaaaagctgactcacgtaattgatcaatacttcactaaagaagaatcatatgaataaaactaaaatcaacactaactgagagacttagcggccaaagcttaatcatcattacatagagtatatgaagggagtaagtgaatatgcaagggtgggaaacggcaaagcatttttatgcaaaaagcgtatttacaaatcccgtaaactcatgatgtgaattttgtaaccagctttagctgagattatttcttttgcaaaagaaatattcaataaattaacaattttcaaataaattaccaatcaatggtcgataacttgcaagagagatatcatcatttggcttttgtgataaatttacaaaacgtaatgttgtatcgagatatattgagttacaagttttcgtctctttttccgaagcgccagactcccgtataaaaaataaggtttatagcgggcattatgcgtagatcaggacttaaatttttcattgcagaagtccaatttcagactcagtatggtttgttgtagtgctggtgtaaaagatggtgttattacttaagactgatttggttgctcaggtatttcattcaataaaattgtgaaagagaacctggaatatagaatggaaatatatatcctgctactaaccccaatggaaggtgacgatcacttcttgtgcgttccaatcccagtttttgaatgtgcgagtggaaaaattctagaggaacaaattgatattttcaaatcagaattcatcaaatatatgtactctgtaaaaaccaaggatgtgatgaagttgagatattgtctttatgggaaattgacttctttgtttaatatgaataatgcaattttactcctcagctcaagtagtgtaaagattcagtagccgtcatcaaatagactaaaaattaaaaaataagattcaatgtggtatgataatgatagatgagaagaaattgcaagaaaacgaataaataccttgtctctttgcactgaatatcttaaaggacatacagtcgcaataacgtctactcattggtgtgtgtcaaaaacagtacgtttattatctggacagccaaaaaataagatctattcaaacatggaatatagcgtatttttatttaatcacggtacaatggagatatttgcatgcctatagaaacaagtaatagttatcatattattttctagattttgtcactgaacttttccactaatgaatcctatcaaaattatatatccaatatggctgcattcccaactaaatattaaaatgccgctaagtataaaatgtctccgcatcggtaaaaagcattacaaatgcgtattatactagcgagaaaaaagtataagtatcaatgccaatcaccctctgaccataaactttctaaacatgaataataaaggtgttgagagttattatcctaattgatcaattaatttgaagcaaagttattatgttaaagaaaaagggatgtcacaatcctaactataatttttgcactatactctgtaggcgtacaaaatggtttgtaccgactatattctctttatttttgacaatcctttacgatatatgattaagaataccatgttatttttatgaaaatctgtgatttttttgttttcatacactttttatttttgtcacgtagtgcactttgattaatacaaaaaaaaatgctgcaaaagcatcgactacataaattcattaggacgcattcctcattaccacctgggtctaatttttattttgaaattgatattattctttatatgatgaggtaaaaagcattatattcgttgtaaactcatatacttatcctcattttaggcaccatcagggactaagggctaaagtatcagagccgcatttcaacagtgtacagagattttagaaacattatcacgcactgccttttgctttgtttacccgtaatgagtatacagtggattttctggtgctaaagcatattgccctttcggcaatacttgatgccctaaacattttcatcctggaacatacgagtaagagcacatttatgtgcctatattcctcgttttttactggtgctgaatttcttattttccacagataacaatcatgttaataaattatgcactgtgctaatttttcaattaaggttctattacccctctatcaccgacagaaacacgtaatgatgtgttatttccattataattccgtaagaatggtgtttataggtagtctaaagaacgtgcatcagagaagaatgactgtcgcaaaaaatgactattctttaccttttcaaacttaactgagatagttatctctattattaccagtggcacacacgcgaactacatcactcaccactatcgtcttaggaactcaagattttatagtaatgcagccgaagacattcaagtcctgagagaaaatgtagacattttaagaaaagtaccggaaataaagcacatgtaaagcattgagctctgtactctataaaaattagctgcattcaaacaacaatgtttgaaatttttgcaaaagttattgaaaaagattgctgttttcagccttgttcagatcatgtctcaaaaatgagaaactggaactctcataatcagtacctcgtatttttttttccttatagtttcgttattaaaaatttttttgctgctaatttaagtacgcttttggtcataaatgctacccaccagttgaattattgacatgattaaaatacatttcagaactttacggattaaaaactttaaagaacctttcaatccatgttgctggagggccatgaatccacgaattacagcaaaagaagacagtaactacttagggttcaataattacttgcataaacacacactaacaaccaaatcgtactaaaatttgcaattaacaaaactccatcatatcacgctgaattatgtagggcttcttaatgcaataggttgcctgaattttgcttactcgtgctgccgggaacacttagcagttgggaggccgtttctcccatatatttcataattttctgtccttcttagagtaggatgctgaaaatcaaaagaagaccgtcaataggaccagattttgtgggtcaattttgggccagacacatgataccctaggaagtttaacggtatacaactcaaggacgaggagtattcggaaactaccggtttttaacaagctgcaaatttccagtagctgttttggttgcgactacggataaaaattcatactttaggaagtgaagcaagataaaaaatcatgctgcatcctaattcgtgaagtttgttaggaatattattgtaaacaaggaaccgtttcagtaaacttgctctctactcttctaagctgtaatttaaaaaaagcgataaaacaatgattttgattatctgcaacttctggaaactcgagatactacgctagacgagatacctattaattgttttcctaaaaaatcaggaacagttcctggcagctttcggctccttcttgttctggaaaggatcttcaaatccgcttccacgtagcagtcctcgctacgacttcttctgaagtattttgatttttggctgcatttaccttttattgccgaaaatcttattttccaagaaaaaagcttattttgcattaagtttaaaaaatttcttctttcccgtagattgacttgcagcgtcaaaattccggaggcctcacgagattttttgacatcggtttttgacatctctttttccttcctttttctttcttttcctgcgcacgccgataaagaagtagtacaacagacaacgtcaaaatgatcctcttgtgatgaagcaaaagaggaagagtatactccttttccgcttgtacaaatattttttttgataataaaatttggcacttcagagcttatcgtatcttctcccggagttcctcaagacttatacttcagcccgtttaggaatgcataaaagcaaataggattcgttacaactgctgcaggactctttaggactgcatcaaggtaagcctcgctgcacctaaacgcaaaatgtggttgtaacctttttaatttttttcttgaacttgttgagtcgtaataaatcgtttctgggaagtggaaggtaataatgtaatggaatcggcgttactcgcatgtgcagatatcagcgacaaaaagtgttgtagggacgtttcgataccaaaatttcctaaatacagcgcaggaacatcactacgctaaacaaatcgtagcgcatacatctgatcgaaaaaagacagttcccaaaacaatgacatatgaagagaccagcatcaaaattttcatcattaacagcatggctaaaagttattgtttaatatacccatacctgattgacgaaccaagaaatgccttatcactatttatttttggcactcttcacctacctggccacgtccaatgttgtttcaggaagtacacaagcatgcctgccagtgggcccgaggaaaaatgggatgaatgtcaacttttataaatactcattactggattcaacaacgtattcctacccgcaatatatgacttctggatatgcctcgaattggaattaggttccgttggcggacagacggatttctcaattgactacgatctttcttgtgttatctcttcaggaacttttaaatgtgctcaatcagatgcttatggaaactggggatgcagaggtcatagtgaatgttcaaaatagccaagaaagacctattggagtactgatttacttggtttcttactatcccaaaaaacgctactctagaaatgacaggttactttttaccaccacaaacaagttcttacacgttcaggtttgctaaggtcgatgactctgcaattctatcagtcggtggtaacgttgcgttcgaatgttgtgcacaagaacaacctccaattacatcgacggattttacaatcaatggtattaagccatggcaaggaagtttgcctgataacatcggagggactgtctacatgtatgcaggctactattatccgctgaaggttgtttactccaatgccgtttcctggggcacgcttccaattagcgtggaattgcctgatggtactactgttagtgatgactttgaagggtacgtttactcttttgacgatgatttaagtcagtcaaattgtactatccctgatccttcaaaacatactactagcatcgtcacaactactaccgaactgtggactggtacttttacttctacatctactgaaatgaccaccgtcaccggtactaatggtcaaccaactgacgaaaccgttattgttgccaaagctccaaccactgccacctcatccagtttgtcatcatcttcttcagaacaaatcaccagctctatcacgtcttagcatccaattattactccattctatcgcagcaatggaacttctgtagtttcttcctcagtcatgtcttcctcggtcatttcttcttctgcaacgacctccacttctacattctctgaatcatctaaatcatccgtcattcaaaccagtagttccacctctggttcttctgagagcgaaacaatcttagtgattgctggcatgtcattagcgacaagacgcttattaccgtagtagccccccaaggcaaacatctctttatcagtaatatccaaagctgttcaacttctcgaattggcccaggaaaagagcattggggcggcaactaactctggcatacttacagtttctgctcttgacagcgctaaaaaagggcttgttttgtaatgcccggttcgcaattctacaagtaccacgcactagctgctaaaagtgtctaaccttgcgaacaactctggactttcttatgagaatcccatcgtcaagaaacaaaattatacagacaggcgtaaatgtagctcgtaagcgcctgatcaagtaagccaaatgcgctaacttgaggaaatatagccatctaaatctctgcaacatgccaattcgcacgtgacttgaaactatggaaagtgtctagaagattaccaagaaccacgttatttgagagaggatggcaaggtgacgacaatcacaccaagaccacattttgggtgcgcctggaagcaagacctgagaaactgggccaaaatattcaaaccaagcataagatagttggaggtaggaatacactatctaatctgtgctgatgaaatgctggcgaaaacgggcgatgtagtggtacagaaggtgccggttatccgtttgtccgtttttcttcattttttttttgtttttcccttttgtcttttgcaccgcttatatatgggtatgaaacaagttcaagaatttataatggaacccaaaggttcagtctttgtagttcgagcgacattgcgcgtttccttagaaaacgctggaaagatattctttaacgagacggagtaattctcgtcaggaataggatgttgattgatttttgctgtagttatatagcagggacccacggaagagagcgagcgccttctttcacagggacttttgtcagccacgtctccgcggaaaacaattgccgtccgcgtcgcagtgagattacgcagccgtgcgcttcagggacagaaaagaagcatttcgcggctacggagaaacagtgcactaactctctcgagggtagccgcaaagatttcttgtctcttccattaggacatagctatctttttcttttctgtttttggcgtatgatctgttctgagccaaagttatagaacattgcttgaataagcacctcacagagtagggattgtatagaaagtagctgagcgtctgcccacgtaacaaacaatcttgccccttccccgctcttgttttcgcgtgcctcttctacaataatctggccaggctaaatcgcgttctgctgctgctgctgctattgttattgttgttgttgttgttttggccaattgcttatgtgttggtctgcaaattagcacctcgttccctgttggcaaacgcgcgcgtacaagccttacagggcttgagaatgttcttcgtagaaatgcatgcacaaaaattttgatctagcacaccatcggtctctgtagcttcgggctctatagctatgggttaggagtccgtgagtagtaacaagaagaagtatataaaaagcaggtaaatcgtacttcaatatgcttcattgtcactggatcgtcatattcactcttgttctcataatagcagtccaagttttcatctttgcaagctttactatttctttctttttattggtaaactctcgcccattacaaaaaaaaaagagatgttcaatcgttttaacaaattccaagctgctgtcgctttggccctactctctcgcggcgctctcggtgactcttacaccaatagcacctcctccgcagacttgagttctatcacttccgtctcgtcagctagtgcaagtgccaccgcttccgactcactttcttccagtgacggtaccgtttatttgccatccacaacaattagcggtgatctcacagttactggtaaagtaattgcaaccgaggccgtggaagtcgctgccggtggtaagttgactttacttgacggtgaaaaatacgtcttctcatctgatctaaaagttcacggtgatttggttgtcgaaaagtctgaagcaagctacgaaggtaccgccttcgacgtttctggtgagacttttgaagtttccggtaacttcagtgctgaagaaactggcgctgtctccgcatctatctattcattcacacctagctcgttcaagagcagcggtgacatttctttgagtttgtcaaaggccaagaagggtgaagtcaccttttctccatactctaacgctggtaccttttctttgtcaaatgctattctcaacggtggttctgtttccggtttgtaacgtagagacgacgatgaaggctctgtaaataacggtgaaatcaacctagacaatggaagtacctatgttatcgttgaaccagtttctggaaacggtacaatcaacatcgtctctggtaacctatacttgcactaccctgacacctttactggccaaactgttgtattcaagggtgaaggtgttcttgccgttgacccaaccgaaaccaacgccactcctattcctgttgttggctacaccggtaagaaccaaattgccattaccgctgacatcactgctctttcttacgacggtactactggtgtcttaactgcaacccaaggtaacagacaattctcttttgaaattggtactggattctctagttctggcttcagtgtctccgaaggaatcttcgcaggcgcctactcatattacctaaactatgacggtgtcatcgctacaagcgccgcatccacatccgcatccactacctctggtgttgtctctactgccactggttcagtcactttatcctctaacgcttctaccaccgtctcttctacgatctcttctagcgccccagactcaataattccttcatctagcgcctccatctctggtgtctcaaactccactacagcatctggttcaatcgcttctactgcttccaccgcttccactacttctactgcatccgctgcatccgccaccagcttcacctcaggttccgcttctgtctacactactacattaacttacttgaatgccacaagtacagtcgtggtttcctgttcagaaacaaccgacgctagcggtaacatttacaccattaccacaactgtcccatgctcatctaccactgccaccatcacatcttgtgacgaaaacggatgccatgttccagcaccaactgctaccgacgcaactgcaaccgtttcctccaaatcatacaccactgttactgttactcactgtgacaacaatggctgtaacaccaagactgtcacttctgaatgttctaaagaaactgcagcaaccaccatttctccaaaatcatacactactgttaccgttactcactgtgacgacaacggctgtaacaccaagactgtcacttccgaggcttccaaacaaacatcattggccactagcacagtcaccaagtctgctgctccaacttctcatactgctgcttccagcaccttcactggtattgtcgttcaatccgaaggtatggctgctggtttgagaaccaatgctttaagtactttggcaggtattttcatccttgcttttttttaaaatgagtgcgtaaccgtactttcctaaaaataactaagtagaaagtattttaatatataaacgtgagatatatgtgggtaattagataattgttgggattccattgttgataaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacctcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctcttagtctcattgctttagtaccaaaaaatctgtttctaaatttctcttcattattggatataattatactgattgtagatttactgtcggttagtaatcctttagtaattggtttcttgttaagttcttgcacaaggtgactgaggttatttaataatgggacagattcacttatcgcgtgtatttctgcttccgtagttgaagtacatgttaatgaagccttggtggactttcctccaattacctttccattaagtaaatatatgttgccaatttgtgacttgtaatatggttggttaccatatgaagcatcacttattgcgactagtttattatctggctcggtaggtttgtttttgtgccatatcagttgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtatagttcttctttgatgtctgcatacaaatatgccgaagatatgtctaattgtgtaatatagtagttattgtctaatgcaagtgacagggatgtcattaatgcatagtgatgtacggtattggattgcatgcctgggtcgtaagtgtcaggatgttgaatatcacctcttgcaacaaatctagctttatgagtaccgtcacgtttcctgttaaagataaacattgaatttattactcttttggggtctatttcttttctgtcataatatctgtcagtgtcccaagttttcatcatcaacagttgattgacttctttgtggtatgcctggatatatttttctttttctttaatatctttattataggtgattgcctcatcgtatcgtaaggttgttcgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaaggagtctgataattcggtaggaggttctggaggcagatcggggagtggaagatcagcgataatagattcctctgtattctccttaggacaggtatctgacgttttgataggaacgacgtggtgtagtgaattactttctgatgaggaagtatcgatcgaaggtgaacggtgtatgatccttttctcagtctcctgttcgcttgtctgcggaacagttttattattggtaccacccgtactggatattggtacgtttgtatgattagtctcattgtcactgtacgagtctgagtgtctgaaatctttagatttactggcgtgcgacgactcatgtgtgttagattgggacatgggagcaagtaaaggaacatctaatctatgcataccacccgaaccggtactctcgatatcggaaatttggggggtgctagatctcttcttagatggaagaatattagattcagatatgttggggtcaacttctctgggtgcgcgaatattggttttggaaacacgtttcgaatcttcagtatgagttgacggaggtgtggaatcggttggactcacagcttttgaaaggacatttctcagttgctcaggatgtagttcaatgtcagattggaagtcatggtcagattctatgttaagatcattggattgttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggacggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatggaggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagatatatgtgggtaattagataattgttgggattccattgttgataaaggctataatattagatatacagaatatactagaagttctcctcgaggatataggaatcctcaaaatggaatctatatttctacatactaatattacgattattcctcattccgttttatatgtttcattatcctattacattatcaatccttgcacttcagcttcctctaacctcgatgacagcttctcataacttatgtcatcatcttaacaccgtatatgataatatattgataatataactattagttgatagacgatagtggatttttattccaacaaaacgtcagtgtaaacattcaagtgattttaactttacgcggttgaagaatgctgtgttcgaactataaagcgtcagaaaagatggtttagcgaaggcaccattatgaagatagacacattcttctttttttttttttttttttttttttttttttttttttcatttacttttatttctcgcggtcggtaaatttttcgtgggtttctttgaatctattagccgacataagaataatgcataaataatatttttaatgtcttcctatgcccaaaagaagaagtcttgaagttgccgcacatggaaatcacatgaccatggcttggcccttcgttttaaatgcaacatgcaatatggaatgtgtcatgaatactatcagcaggaacagaaagcgtcgttttgtttctgcaaatgctgtagttttgggccgaaaatagatgtagtagaatatatagtgaaacgtgatgtacaaaagaaaaaggtagtttaaaaaaaattagataacttggatttttaccctgaatattgcatgtgattcgtaaagaactgagttacctcaaacggacctcccttttcatttcgtattccgcgaatcatgaagtcatgcaattacctctgaagagctgactgtcccaaaagaagctatcgaatctgtccttgatttatttaagccttgcgtttcgagaaagtgaaaaccaattgaatacaaaataaaaaaaaaagaagaaagaaatagcaggtctaagatatataagaaagttaatatcatttttgaacattttattttagacgccttcagccgcgcgacgcccggagtaatcatatgcccatgactttaccaaaaggcaacagggaggaacatgcattaatgtgaagcatcactgctgcaattctcggtgttgctaataattcatggatcgagaaagagacataacatttaggccaattttttgaataaatatgaactcagctaagactcgacaatacaattttcttatactaaacgtagatttataaaataaacacaactgtaagggcaatgcaaccgtagatgcatatatcatttatagaaattatatccaacagaaagctcagacttatatccggtttaagagagaaattcttgctcatattaccccaagaccaggtggcgtgttgaagtttataacatataagaactactacctcatgaattctagtggatgaaagaagcagcacgaacaccatttctacagacaacgacacatggaaaggttcaccattcccaaagaaaacaacgatggccacaagggtgtggtcctccattctcctactgttggaaggagatattatccgaccgactgttttgtgatatggcaaactatttttttaaatgagcaaaattacttcttttggctggaaatgtcattagaaagtgcccaagtgacatttagctaaactcgggtattgtctacaagaccggtgctgtgaccgtttccaatacggaaagaaacggtactgggagcaggagttgcttttacagatatgaacaatgccaatagagccgcacatgtaattactggttcacactcgtggggcccacacgattcctgtgcaaagtttgacaagaggatggagtttcacgtaaatgctgccaaaggtgatgcggttttgtttttgggcagcctctaccatgttgcaagtgcgaaccatactgtggccacatagattacaaaaaaagtccaggatatcttgcaaacctagcttgttttgtaaacgacattgaaaaaagcgtattaaggtgagaaaatcaagattatctaagccgatgaaaaatgaaaggtatgatttcagccacaaatatatagtagttattttatacatcaagatgagaaaataaagggattttttcgttcttttatcattttctctttctcacttccgactacttcttatatctactttcatcgtttcattcatcgtgggtgtctaataaagttttaatgacagagataaccttgataagctttttcttatacgctgtgtcacgtatttattaaattaccacgttttcgcataacattctgtagttcatgtgtactaaaaaaaaaaaaaaaaaaaggaaataggaaggaaagagtaaaaagttaatagaaaacagaacacatccctaaacgaagccgcacaatcttggcgttcacacgtgggtttaaaaaggcaaattacacagaatttcagaccctgtttaccggagagattccatattccgcacgtcacattgccaaattggtcatctcaccagatatgttatacccgttttggaatgagcataaacagcgtcgaattgccaagtaaaacgtatataagctcttacatttcgatagattcaagctcagtttcgccttggttgtaaagtaggaagaagaagaagaagaagaggaacaacaacagcaaagagagcaagaacatcatcagaaataccaatgttgaagtcagccgtttattcaattttagccgcttctttggttaatgcaggtaccatacccctcggaaagttatctgacattgacaaaatcggaactcaaacggaaattttcccatttttgggtggttctgggccatactactctttccctggtgattatggtatttctcgtgatttgccggaaagttgtgaaatgaagcaagtgcaaatggttggtagacacggtgaaagataccccactgtcagcaaagccaaaagtatcatgacaacgtggtacaaattgagtaactataccggtcaattcagcggagcattgtctttcttgaacgatgactacgaatttttcattcgtgacaccaaaaacctagaaatggaaaccacacttgccaattcggtcaatgttttgaacccatataccggtgagatgaatgctaagagacacgctcgtgatttcttggcgcaatatggctacatggtcgaaaaccaaaccagttttgccgtttttacgtctaactcgaacagatgtcatgatactgcccagtatttcattgacggtttgggtgataaattcaacatatccttgcaaaccatcagtgaagccgagtctgctggtgccaatactctgagtgcccaccattcgtgtcctgcttgggacgatgatgtcaacgatgacattttgaaaaaatatgataccaaatatttgagtggtattgccaagagattaaacaaggaaaacaagggtttgaatctgacttcaagtgatgcaaacactttttttgcatggtgtgcatatgaaataaacgctagaggttacagtgacatctgtaacatcttcaccaaagatgaattggtccgtttctcctacggccaagacttggaaacttattatcaaacgggaccaggctatgacgtcgtcagatccgtcggtgccaacttgttcaacgcttcagtgaaactactaaaggaaagtgaggtccaggaccaaaaggtttggttgagtttcacccacgataccgatattctgaactatttgaccactatcggcataatcgatgaccaaaataacttgaccgccgaacatgttccattcatggaaaacactttccacagatcctggtacgttccacaaggtgctcgtgtttacactgaaaagttccagtgttccaatgacacctatgttagatacgtcatcaacgatgctgtcgttccaattgaaacctgttctactggtccagggttctcttgtgaaataaatgacttctacggctatgctgaaaagagagtagccggtactgacttcctaaaggtctgtaacgtcagcagcgtcagtaactctactgaattgacctttttctgggactggaataccaagcactacaacgacactttattaaaacagtaaatagacctaatatgatttatgtaattttagaaactaaatatgaatgctaatttttttcttattttgacttttgcttgcgagaagtaccaagttggaacaacaaacacagtccaaagagggaaatacaaaggcacagtacgcaattactttattattctttagcaagacgaagatagtatgaatatacgtgtaaggcatatgcaaagccatgattttataccatagacatgacatgcgggttacatgaggtggtaaaatgttttaagatagcgtccagggcaagtacatgaaatgtcgtttagagatgatgcaagagtagggttatgatgtgaaagaatagggcaattaattaacagagcggatgttgtaggatgatatagtgacacataatatataaatgatcggttgagcgcgatattatataagaacatccatatgagtatatatcctaccgtgtctgttctctacagtgcttcttttattcaaaattattggttttcgtaaccgccgcgcaggcacgccgcgcatctctttttctcgaagaaagcggaaaaataaaaacgaaaaaataaaaaaaaaaaaaagtataaatagtgaagactttttccatttgatatttggtaaaaatttcggctggaagttttttgctgaacatttaaccggagaatcttggtggctttttctcagtttcgtgggcttatacattttacctagtatgctgggaacctttttttccgtattctattctattccttgccttacttttcttattattttctatataaccaatttcaataatactttttaactgtcataaacgcattttgtttattacaaattaaaagaattaaatataatcagtgcaattaataactccacaagtagcaaaagcaatggccgccattagagactacaagaccgcactagactttaccaagagcctaccaagaccggatggtttgtcagtgcaggaattgatggactccaagatcagaggtgggttgacttataacgattttttaatcttaccaggtttagtcgattttgcgtcctctgaagttagcctacagaccaagctaaccaggaatattactttaaatattccattagtttcctctccaatggacacggtgacagagtcagaaatggccacttttatggctctgttgggtggtatcggtttcattcaccataactgtaccccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacgacagatggaaagagaaatgcaaagttggtgggtgtcatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctattggttgttgatgaaaagggtaacttagtttctatgctttcccgaactgatttaatgaaaaatcagaactacccattagcgtccaaatctgccaacaccaagcaactgttatgtggtgcttctattgggactatggacgctgataaagaaagactaagattattggtaaaagctgggttggatgtcgtcatattggattcatcccaaggaaactctatcttcgaattgaacatgctcaagtgggtcaaagagagtttcccaggtctggaagtcatcgctggtaacgttgtcaccagggaacaagctgccaatttgattgctgccggtgcggacggtttgagaattggtatgggaactggctctatttgtattacccaagaagttatggcttgtggtaggccacaaggtacagccgtctacaatgtgtgtgaatttgctaaccaattcggtgttccatgtatggctgatggtggtgttcaaaacattggtcatattaccaaagctttggctcttggttcttctactgttatgatgggtggtatgttggccggtactaccgaatcaccaggtgaatatttctatcaagatggtaaaagattgaaggcgtatcgtggtatgggctccattgacgccatgcaaaagactggtaccaaaggtaatgcatctacctcccgttacttttccgaatcagacagtgttttggtcgcacaaggtgtctccggtgctgtcgttgacaaaggatccattaagaaatttattccatatttgtacaatggtttacaacattcctgtcaagacatcggctgtaggtcgctaactttattaaagaataatgttcaaaggggtaaagttagatttgaattcagaaccgcttctgctcaactagaaggtggcgttcataatttacattcttacgaaaagcgtttacataactgaatgttaaaatggcatcatcaatacagtattactgatgttatgttatttagtgctgtccgtatgtcctcctgttcttttttgggctacaatttaattgatggggtgttatgtttacgatatttcaattatgttaatatttagtatgtttatatcttctcattaatgaatagttaatttttacgtttaggtgattttggtggtgatttttctataatattgaaataagtgtatataaattgagtggttagtatatggtgaaaaagtggtataacgtatgtattaagagcatttatacggtatttgggcccgccgaatgagatatagatattaaaatgtggataatgatgggctttatgggtaaatggcacagggtatagaccgctgaggcaagtgccgttaatggtgatgtgagtgcacttagtactgatttagtgagagagatgggccatggattggagtgtgagagtagggtaacttgagagtggtatatactgtagcatccgtgtgcgtatgccataggataattaaaggtgagtatggcatgtggtgaggtggtagtgatggtgatatagagtggtagggtaagtgtatgtgcattatttacgattatttgttaacgtttcaatatggagggtagaacaacagtacagtgagtaggacatggtggatggtagggtaatagcagggtaatggtagtggagttggatatgggtaattggagggtaacggttatgatgggcggtggatggtagtagtaagtagagagatggatggtggttgggagtggtatggttgagtggggcagggtaacgagtggggaggtagggtaatgtgagggtaggttaagagacaggttagatagggtggtgtgtggtgtgtgggtgtggtgtggtgtgggtgtgggtgtggtgtgtgggtgtggtgtgtgtgggtgtgggtgtggtgtgggtgtgggtgtgtgtgggtgtgtgtgtgtgggtgtgtgtgggtgtgggtgtgggtgtgggtgtggtgtgtgtatatatatgtcactgtattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttttattatattggtcttttcgagagcggaacgtaggtccatgtttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgtgcttgaaggggacagacagtcgcttatcttagtgagatttcttattaactgaattttctttgctgctgctggagatttgcacctgcatagcgcagattctgcttcttctcaatagagtagcttaattattacattcttagatgatgataagacggaaactggacaatcttttgtttatattgatggatttcttgtcaaaaagcatagcaatcaacatactattgttaatttcgaaacttacaaaaataaaatgaaagtttccgatagcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggtctaatcaaagtggtaaaattcagaactggtgcaatggataggaaaaggtcttttgaaaaaattgtcgtttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgttacgaaatagcgagtgccaggccgaacgacagctctacgatgcgtactttcactgactttgtttctggcacacctattgtaaggagtcttcagaaaagcaccataaggaaatatggatacaatttggcaccctacatgttcttgttactacacgtagatgagctatcgattttttctgcataccaagcaagtttacctggcgaaaagaaagtcgacacagagcggctgaagcgtgatctatgcccacgtaaacccactgagataaagtacttttcacagatatgtaacgatatgatgaacaaaaaggaccgattgggtgatgttttgcatgtgtgctgcccaagttgagaagagatactaacaaaatgaccgcggctctcaaaaataattgacgagcttacggtgatacgcttaccgttatccagagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccggaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcatctaagggcgacgtgaaatatgtgtcgtttctgtttgtaccgtacacagtgttgcttgctaattgcatgatcaggttgggccgacgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgttgctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagcttgggtgctgcagaaaaggtgtctcgcacaaaggagtttgtcactgacggtagcatgcaagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaaagggccagcatgttggatgctgtggctccaggacagacctgtctgctgacacagtggaactgatagaaagaatggacagattggctgaaaatcaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcatcaacgtcaggactagtgcgactaccactgccagcatcaacgtcaggactagtgcgactaccactgaaagtaccaactccaacactaatgctactaccactgaaagtaccaactccagcactaatgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtagggtatttgaaattttttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattgggttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgctgtagggctaaagaacagggtttcattttcattttttttttttaatttcggtcagaaagccgggtaaggagtgacagcgagagtaaagatagatgtgaaaagtgtgggtgtggtgtgtgggtgtgggtgtgtgtgtgggtgtggtgtgtgggtgtgggtgtgggtgtgggtgtggtgtgggtgtggtgtgtgggtgtggtgtgtgggtgtggtgtgggtgtggtgtggtgtgtgggtgtgtgggtgtggtgtggtgtgtgggtgtggtgtgggtgtggtgtgtgtgtgg

SEQ ID NO: 12212 - DNA, 439885 bp, Saccharomyces cerevisiae
cacacacaccacacccacaccacaccacaccacacccacacccacacacaccacacccacacaccacacccacaccaactctctctcatctacctttactcgcgctgtcacaccttacccggctttctgaccgaaattaaaaaaaatgaaaatgaaatcctgttctttagccctacaacacttttacatagccctaaatagccctaaatagccctcatttacgtctcctccaagccctattgactcttacccggagtttcagctaaaagctatacttactacctttattttatgtttactttttatagactgtcttttcatcctactccttcgcacttgtctctcgctactgccgtgcaacaaacactaaatcaaaacagtaaaatactacatcaaaacgcatattccctagaaaaaaattttcttacaatatactatactacacaatacataatcagtgactttcgtaacaacaatttccttcactctccaacttctctgctcgaatccctacataataatatatcaaatctaccgtctggaacatcatcgctatccagctctttgtgaaccgctaccatcagcatgtacagtggtaccctcgtgtcatctgcagcgagaacttcaacgtttgccaaatcaagccaatgtggtaacaaccacacctccgaaatctgctccaaaagatactccagtttctgccgaaatgttttattgtagaacagccctatcagcatcgagaggaatgccgtccaatgcggcactttagatggggtaactcccagcgcaatctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccacctttctcgagcgcttccacaacaaccgtatcgtcttttgcctcccattcttcctggcactttttttcgtcccagttcaaaaagtactgcagcacctctgtcttcgattcacgcaagttgctccatactttaaaatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaatatttcaaatatcctacagggtccccatgatatggctcgatgtcttccaagtattctttgtattcctcgtcatttcgcagcattctctccacagctagtgcttcccaagctatcctccgatacgatactttctggccagcccaacagacacagagctcgaacatcttttgacagcccttgcataatccgtattgtgtgaacactccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtagcactagtgttggagttggtactttcggtggtagcagcactagtgttggagttggtactttcagtggtagtagcattagtgctggagttggtactttcagtggtagtagcattagtgctggagttggtactttcagtggtagtagcattagtgttggagttggtactttcagtggtagtagcattagtgctagagttgatacttttagtggtagtagcactagtcctgacgttgatgctggcagtggtagtcgcactagtgctggagttggtactttcagtggtagtagcactagtcctgacgttgatgctggcagtggtagtagcactagtgttggagttggtactttcggtggtagtagcattagtgctggagttggtactttcagtggtagtcgcattagtgctggagttggtactttcagtggtagtagcactagtcctgacgttgatgctggcagtggtagtagcactagtcctgacgttggtgctggcagtggtagtagcattagtgctggagttggtagtcgcattggtactggcattggtggtcgcattagtactggcattggtactggcattggtagtcgcattagtactagcattggtagtcgcattagtcctgacgttggtactagcagtggtaatcgcattagtactggcgttagtactggcattagcactaccatgaatgcacgtgttgctgtcctcatcactgctgcaatactttctgtacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacaccttgaatgagctcaataatattaagtctattatcaagcatgatcaccatcatcaattgcttaatgtcaattccttcagtcactaatttcgttccgatgagaacttgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcactttcaaagagggctaaaagaagcttcagtgcttcttcgggctgtgattccactttcttccgaattttatgaacatgccctaaaggcacctcggatttctccttgattagattaaacatccgtgttggatagctggatagacctctgctgagatcttccgaccgtttgagctcgttgatgtccatcgatttcttggccagtcccgtaagcccaatacgctgcaacgcagcatcagctacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgtaaccttcttcaataaagtttcttacaggggccacattcaagcaaccgcatcggcccaacctgatcatgcaattagcaagcaacactgtgtacggtacaaacagaaacgacacatattccacgtcgcccttagatgccagtgctatcaaggggagatgaaataactccgtcttaccatagcccggtggggcctgtactgccacagagggtgtgtctgccatgtatatttcataacataagcgcaactgatgcaagtccctgaattcaaaggagctgccaaagagtttctggcctgcgacgaggatatcgtttgtactcttgggctctcggggcctttttcgcgttactcttgaaattttttgatgatgatttgaactcgccgcctcacctgccactacgtcttccgcattccgagtactggagaatgaacaatggtagtcgctttcaaggcctaaccactgaatccagcgctcggaagctcgttcctgcaataaagtggcggtcgtcccactgacactagttaacgaaaaggaatccacaccgtaaatatttcgccctgtttgaacggaatgattggccatgagttcactcgtcgccgactcgtacaaatctgtttcaaatctgctacctacgcagtgccgtcctagggcaatcaacccctgacgcatctcccgaaaattcagcttctgaggtgcattcttcggaagttccctcatgtactgccgaaaagttgcgtattcaaccagacagcccttcgcggtattcagaaacatgtaggaatacaaaactatcctcgaaatgtctcgatttgttacttgatttggatcctcaaatcccaccacatccatccaaggatcatgattaaaagcgtcataactgttaccaagcgcacatatttgcatttgccttagcacagtgacaaaataaaacacgtaatctgaggtgagtccgtcaagcgtctttagtcgaggctccgatgaaccgttcttgttgtaatcagtgtacagttggatgcgtcttgttgtatcatcgacgtatacgttgcgctgaggaccggcaaaagcgagtagctgaagctctggataacggtaagggtatcctacggcaaaatggatcatccacataagtggcaccgtaagctcgtcaattgcaacagcgactttatttttaagagccgcggtcattttgttagtatctcttctcaacttgggcagcacaatttcacgatatttaacaggtatcatttgaagaaaagaatcgttttccagatactcgtcaattcctcgcttcggttctctgaacaaaacttctcgattacgcaaaatgaggttggcaatatcaaccactgtaggcatataaaagcagttgttcaactctccccaaaggttatcaaactgagccttgcatgcaaagtaaaagccgcggacatactcgcgattaaaaaagttttccacatactgatataccatcagaagaaggtaccaaagttattctataagagtccttcagcgtggtttcctgcgctacttcgtggtacagaattttgatccatttccacattgcaacgccgttgttgtcatcaaatatatctaaatcccttgcggtacaagcacaagacgacaccaataaagctttcacggcatctagtgtttttctgagtcttcgtggagtgttaggactgcgcaacttacatactttcaggccatgctcgtccacagagggaataatgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtagggtgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttttacatttttcccgaccatgacggaaatgacaactttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctctagcagcagcaaagaaaattcagttaataagaaatctcactaagataagcgactgtctgtccccttcaagcacaacatagaaaacagaaggatgtctcattcatcgcttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaacatggacctacgcttagcctgcgcttagcctacaacttcttccgctatcgaaaagaccaatataataaaaagttataaattacatttccttattaggtatacgacctcgcgcttcgaagtaaaggagccctttttggcgtacctacatatggcgcgtcagacagacaaccttccctcaaaatgtattaccccgccgaataagaaaacagacccattcaccaacgacgtatcaagttacttccttgatttgcaatgtcccactataaaaaaattccttaacgctagatctttgggctaaaatctgcgtcaaacaggaaatattgcctattttcgtacaaggttacttcctagatgctatatgtccctttacataataaattaaaaaattttttttataaattataataatttctttttatttctaatagtatcttgggattaaataaatcacttacaatatttattttattatattgctttgttcaattaaattttaatacgaaattatttaattgttttgtatttaaaatattttgaataataaaataatatagagttttattataaatttttcattgatatttaataaataaagatttccagcatacagcacataaaatattaattacatatgtaattaataataaggccatattttgaccctgccattaccctaccatgccccatctgttactcactatactgttgttctacccaacatattgaaatgttaacaaatgatcgtaaataatacacacatacttaccctaccactctaatcccaccaccacatgccacactcaccctcacttgtatactgatatgccatacgcacacggatgctacagtatataccatctcaacttaccctactctcatattccactccactccacggcccattctcactaaatcagtataaatgcactcacatcattatgcacggcacttgcctcagcggtctataccctgtgccatttacccataaagcccacgattatccacattttaatatctatatctcattcggcggccccaaatattgtataactgcccttaatacatacgttataccactttttcaccatatactaaccacttaatttatatacacttatgccaatattacataaaaatcaccaccaaaatcacctaaacataaaaatattctattcttcaacaataatacataaacacattggcttgaagtatgagcactatcatggtatcactaacttaaaagatccttaatattgcaatttgcttgaacggatgccatttcagaatatttcgtacttacacacacctgacattacaataatatgccacctcactgtcgtaacactctttattcactgagctataatacggtagtggctcgcactcatgcgggggctatgatacaattgtatcctatttccattcccatatgctaaccgcaacatcctaaaagcataactgatgcatctttaatcttgtatgtgacactactcatacgaagagactatatctgaacaagacgatactgtgataggtacgttatttaataggatctataacgaaatgtcaaataattttacggtaatataacttatcagcggcgtatacttaaacggacgttacgatattgtctcacttcatcttaccaccctctatcttattgttgatagaacactaacccctcagctttatttctagttacagttacacaaaaaactgtgccaacccaaaaattttgatattttacgtgtcaaaaaatgagggtctctaaatgagagtctgataccatgacttgtagctcgcactgccctgatctgcaatcatgttcttagaagtgacgcatattctatacggcccgacgcgacgcgccaaaaaatgaaaaaagaagcagcgactcatttttatggaaggacaaagtgctgcgaagtcatacgcttccaatttcattgttgtttattggacatacactgttagctttattaccgtccacgctttttctacaataatgtaaaagtttctttctatgtttatcatattcataaaatgcttcacgaacaccgtcattgatcaaataggtctataatattaatatacatttatataatctacggtatttatatcatcaaaaaaaagtagttttttatttattttattttgttcgttaattttcaatgtctatggaagcccgttcgtaaaattggcgtttgtctctagtttgcgatagtgtagataccgtccttggatagagcactggagatggctggctttaatctgctggagtaccatgggacaccggtgatcattctggtcacttggtctggagaaataccagtcaacatggtggtgaagtcaccgtagttgaaaacggcttcagcaacttcgactgggtaggtttcagttgggtgtgcggcttggaacatgtagtattgggccaagtgagctctgatatcagagacgtagacacccaattcaaccaagttgactctttcgtcagattgagctagagtggtggttgcggaagcagtagcagcgatggcagcgacaccagcagcgattgaagttaatttgaccattgtatttgttttgtttgttagtgctgatataagcttaacaggaaagaaaagaataaagacatattctcaaaggcatatagttggagcagctctatttatacccgttcctccatctgtcatcattacttaaacgattcgttaacagatgctcatttagtacctcacatattctccatatctcatctttcacacaatctcattatcactatgaagatgttcttgtttttgaacgaatcatacatctttgatagacttcgtatgtggagtattgttttatggcactcatgtgtattcgtatgcgcagaatgtgagaatgccaattataggggtgccgaggtgccttgaaaaacccttttgcgcgcctgcgaagtttccattttcggtcaaaaagaatatccgaattttagatttggaccctcgtacagaagcctattgtctaagcctaaattcagtctgctctaaacggcttccatgcaagaaatatttctatctcttgaattcgtacaacattaaacgtgtgttgggagtcgtatactgttagggtctgcaaatatgtaaactctcggcgaatgccttggtgcaattacgtaattgtagccgctgaaggcggatggtattgagagaagttgatattcaaagaatcttgtatgataaaaataaaattgtaaccagttcgtagtagcagtattaaaactttgcacagggggaaatatttgattccgagatgtattcccccttttctagtcagatatgaaggaaaaaagtgtaagggcaatagatggcgctaatttgttctattctattctaaaaacgttttctaggaaaaatatattaatagttgatactccttgtaatttctaagtcaaaagaaatgtctctatctttatcgtaacggctcatcgttagagctcaattgtgcctcttggatgtatttccaaagttccacgtttaataacccagccaacacagattcctttgagaacaaatggctaccaaagtttcattcaaataagcctgacaatcaaccccatcaaagaggagctctttgtttttccaaacccatgagaaaaaaatacagttccttttccataccaaaaaatgaagaagaaatcatgtgctgagagttgcctgcagtcgtagaagtttacgatcctaacccattatgtgattcgttgtgagtcacccttccatgattatgtgtccttactacctactatccaattactacatatgttttgaactcatatgtaccaagcacctaaaattacgcacccatttccattggcaaagacttgacgaaatttaatacactgcaataatatccagcgatactcttcaagaattcccgcctataatggcggctcgctgtccgaaagattgcgccgcacttgactgcttcttacactcctttttcccaggcgataaacagactaagcggaaactacgatataatgcagtagaggtcccccaagagctggaaagaaaatattagtttgatagccagcactattccatccagtgggttcttgtaccattttctgtggtatggctttgattcaactgcatacgtagttaacgcgatcagccgcacatgtccattatcattttcaggggtactggtaaaccctattgtttagaaagaatatctggtaagcgggtctgtcgagtcttcacttccttcatacacattttattgagtaaattatacttagatccggaatcataacgttggaaaaggagacaaggttggataagttatgtaggcgtatttcaataagacgtatatgatttagtctaagaaaccgacgtatctagccagcattcgcactatgacgacagtttaacgtcgtattgagcagcatcaactgaatataatgaaaaaaaaaaaatcattccttgaaattcgttcttccgaaaactgctcaaggtgatagcacctcaagaacaattcttcgtttgaatttattatcaaattcatcaccgtcagagttataagttgcactgtattcctggtgaccctagtaacccaaaataccattttctgattttgcaatcatatttattggctttagcgaacatatgatcaccatactatcttgatggttgaccaagaagcgaacatcttcgaaccaaagtcaccgaatctcaaggaatgcaaaattcgtggctcagtgctctcaagacaatgttgcaaccctttgcgtcaattatatatatatatatatatatatatatatcccgtccgctttcttttttttgtcagttgggtcgcaacgcagggtctcgagacctgaaaaaagcttcatagcgatattaaaggtagaggtacacccataatggcattgtttcgtgccctgtatattatttgggtattcctactcattccactgtccaatgcagaagaattcacccccaaggttaccagaactttgtcaagatatgtattcgatatagtaaactttgatgattcaaacactttgatcagagcagaagaagactctgtcgagataagttttgatgctggagaaaattggaaaacaatagatgagattgaagagcctatcgagtcatttgttgttgatcccttccgtgggcatgatagagcttttgctttcgtgaaaacggcaccaaaattttacgtcacggatgatcaaggtaaatcgtggaggcctttgactatacccatttctgagaaagcatcgaattatttttgcgacgtaactactcaccctataaaaaagaagcatcttattattcgttgtgatttgttgacaataaaaaactcaggcttaatgtatgttggaagagagatttacacaactaatgatggagtatccttttcccaagttaaaccttcttttggaaaaattgatggtcatattagcacggcacgctgtgactttattaaatctagtgaggattctgatctgggcggtaatgatgcttcgatactctgtcttttccgaaacactgagtacattgaaagtacaggctcaactattgacaagtctgaattgattttaagtgccgatggaggtgaaacattcaaagaattagtccagttcaaagataaggttgttagtcgatacgagatacttaagcatcatgtgatcgttttgacacaagatgatatgtataatgaaatgtcatcaacaaacatttggatatccaatgatgtatccacttttcaagtggctcgtacacctactaagatacggcacgttaatatgggacaaattcatgaagattccatcggaagaatcgttttacctgtatctagagaaagagatgatgaagacagcaaccaaccgggagctgctgaagtgttaatatcagattctgaaggactaaaatttttgcctataaattggataccaaacaatcagtttggatatatcaatgtagcttatccaggtttcttaaaaggaacattttttggttcgtttcatcccttcattgaatattctgatagaaaaaggaaatacagccgacagaaagtaagagaggaaactaaagtatctgttgataacggtctcacatggacaaacttgaaagttgttgaccgggaaaatgtagatttatttggttgtgatgtcactaaacccgagagatgttcgcttcagactcatttctatgatctaagaaatttaaatccctctgccggaatcatgatgatatcgggtattgttggcgacggcagtgcatacaattggaaagaagaaaaaactttcatctccagggatagtggtttaacatggaggttagtccataattccactggtttatatactactggtgatctgggaaatattatcatgtatattccatatcgttcgaatgaaaatggcgatgtgccttctaaattttattattccttggatcaaggtaagacatggggtgaatatgatctaatcatgcctatttatccatacagattagtcagcacaatatcagatggatctggttcaaaatttattctaacaggaacgtccattacagaagatccaatattcattacatattcaattgatttttcagcggtatttgattataaatcatgtgaagagggtgattttgaagattggaatctagcagatggaaaatgtgttaatggcgccaaatacaagtacagaaggaggaaacaggacgcccagtgtttggtaaaaaaagcattcaaagatttgagtttagatgaaacgccttgtaacagttgtactggatccgactacgaatgttcgtttgaattcgttagagatgcgaagggtgactgtataccagattataatctgattgccctttccgatatatgtgacaaatcgaagggtaaatctgtgttagtaaagccactacaattaatcaaaggtgataaatgtaaaacacctatgaaaattgaatccgtagacattccgtgtgacgaaattccaaaggagggttcgagtgacaaggaaatagtgactactgaaaacaaattcgactttgaaattaaattttaccaatacttcgatacagttgccgacgaatctttggtcatgctgaattcgataggagacgcctatatatcccacgatggtggacaaacgataaaaaggtttgacactgacggcgaaaaaattgtcgaaatcgtgtttaacccatacttcaattcttcagcatatttgtttggctctaaaggtaacatattcttaacacacgatagaggatactctttcatgatagctaaattacctgaagccaggcaattaggcatgccactagattttagtgctaaagcacaggatacttttatttactatggtggtaagaattgtgaatcaattttaagtccagaatgtcatgcagtggcatacctcaccaaagatgggggtgaaacttttacagaaatgcttgataatgcaattcattgtgagtttgcaggaacactattcaaatatccgtcaaatgacgatatggttatgtgccaagtaaaggaaaagttttcgcaaacaagaagtttagtttcttctactgactttttccaagatgatagaaaaactgtctttgaaaacattatcggctacttgtctactggtggctatatcattgttgccgtacctcatgaagacaatgaattgagggcgtatgtaactaatgatggtgctgagtttaccgaggcaaaattcccatatgatgaagatattggtaagcaagacgcattcactattttaggatctgaggaaggatcaatatttttacatttagcaacaaacttggaatcaggacacgatttcggaaaccttttgaaatccaactcgaatggtacttcttttgtcaccttagagcatgccgttaatagaaacacattcggttatgtggactttgaaaaagttcaaggtcttgaaggtattattatcaccaacatcgtttcgaatagcgaaaaggttggcgagaacaaggaagacgaacaattgaagacgaaaatcaccttcaatgacggttcagattggaactttttgaagcctccaaagaaggattcggaagggaaaaagtttccctgtgattctgtgtcattagataaatgttctctacatttgcatggttacactgaacgtaaggatatcagggatacatattcctctggctccgcgttaggaatgatgtttggtgtcggaaatgttggcgataggcttctaccatatgaggagtgttccacttttctaaccactgatggaggagagacgtggactgaggttaaaaaaggcccccatcaatgggagtacggtgatcatggtggagtcttggttttggtccccgaaaacgcagaaactgattctatttcttactccaccgattttggtaaaacatggaaagattataaattctgtggcgacaaagtcctcgtaaaggatataatcaccgttcccagagattctgctttgaggtttttgctatttggagaagcaaaaaacatgggtagtggttcattcagaacgtatacaattgattttagaaacatcttcgagaggcaatgtgagtttgatattaccggtagaaaaagggcagattttaagtactctcctctgggttccagaactggttgtttgtttggccataaaacagaatttttacgtaaaaccgatgaaaaatgttttattgggaatattccactttctgaattttcgaggaacgtcaaaaactgtccatgtacaagacaagatttcgaatgtgactataatttttataaagccagtgatggtacttgtaaattagtcaaaggcttaagttcggcgaatggtgccgatatctgcaaaaaggaacccgacttaattgaatactatgattcctccggctatcggaaaattcccttatcaacctgtaaaggtgggctgaaattggatgcacatttagcaccacatccttgtccgggaaaagaaaaggcattcagggaaaaatactctataaacaccggcgcttatgcgctggtttttgttacaattcttctcgttattttctttgtcgcatggtttgtatacgatagaggtatcaggagaaatgggggattttcaagatttgaagaaatcagattaggagacgatgggctgatagaaaacaataggaccgatagagttgtcaacatcattgtaagactaggattatgcatttctttaatcaccaagtctgcgtttcaacgcgcgaaggcaggtacagcgcaactttcttcaaaatttagggcaaggtttggcaacaaaaaaggtgccacttactcttcgctgcttcatgatcagctttcagatgaaccagatggcttccatgaagattccaacgatttatccagtttcagaggtcaaggtagtaattctgaaattgagcaagaagatgttgacacatctcaacaagagcatacgttgcggacagacctacttggtgctagcaatattccagacgctttgccagcgcgtagtgcttctcacgagtccgatttagcagctgcacgcagcgaagacaagtaggtaggtctttttaaacgaacgaaattgttcacgcattgtatgttgggtttcttacatatcaatcactcagaagcccattttctacctccatcaccgtacttatagaattatttttctttcttgacacaatatactgtggctagtttaacatttcgtgccctttaaatatttttcatggtgtggacagaacaacgtcaattgtaaggagcatggaggtcaaataaacaatacctcaaactaaataatgaagaccccaagaagccttgcaatcggcagtaattatattcatggtactaattgtcactattcgtctacactctagtaaaagttcttgatgcaaatttttttatttttatgtatgagaactgccgaaaaaaaaggtttggatattaactttgttaaataaaataatacaatcaattcaaactttttactgtttcttttttcagctaactatatcatactattgtacacaattattaattaccacttacattaactgttattcgctacgctttagaatatcacatacccaatatcgcattaccacatgtatgtcgttactatttaaagtgcggtatgtaacatagataaatataagtatatgtatatgtataaaaatcttgtcgtcacaatcattaatcattcagatatgtaaattctgccctcccatggcttcaatgttctggaagacgcatcaacttcacttcttgggtagtttccgaattccaacttaaacgatgagctattgtttggaatcgtgaagtcgatcgaatcagagctgaagttcaaagcagcaaacaatgttttgttgtcgtatttctttgtgaagctgaacagtttcttattgtccaaatcaataaactcaaaatcatatccatacacagtaatatccttgtgtgcctttctaaatctcaaggcctccttccagaagttcaaaaccgagttggggtccttggattcgtcttcagcgttaattccttccctgaaagactcgttcaagtaaaaccatggtttagcattaggaccagaaaaaccagcatttggctcctcacgagaccattgcataggtgttctagcatggtctctggaaataagggcaattgcttccaaaaacctcttcatctccttcgagttttctccatgctcttccttgatcgcatcatagttatttctaacttcgacatcctcgtatttttcgataggccagttcttgaaattgatttcacccagttcctgtccttggtacacatatagagtaccgctcagtgacaccaacaacacagacaacaacttaccagaaataacacggtttttgggagaatcgtcaccaaatctggtaattgaacgaggttggtcgtgattttccagataaattgttgaccaacaatcagttccgttaacgtatctgaaaagttcagcaagggcaaccttccaatcctttagttcatatggtatcaaattttgacggaacttgggcgaagtcccgacatcagtgtgggaaaagttgaataactcactaagttcgtgtcttgacgcacttgtatacaacctcttggtctcatcagtagcatgtcgcatttcaccaactgtcataatttctctgccatccttcactctgtttctgatgaacttgttcatttcttgatgaaactcatggatacgtggtccgttcattgtgaaaggatcactgagttgccactttgagttttcgtcaatcacaggagcgtctggtagaccagcaaccttggagtacaagcttcccacatcaattctaaagccgtctacaccatggtctaaccagtatccaacggcactttcgtagattgcctttctgcagtcttcgttctcccagtttagatcaggttgggtggagcaaaacaaacgcaagtaaaactcttgtgtcttttcatcgaacgtccatgcagaaccaccgaagtaagacctccaattgtttggaggaattggcttgccttcggcgtcataacccttaggaggtctccagaagaaccagtcacgttttggattggtttttgaggatctgctctctttgaaccattcatgttcgctggagcaatggttgatgactaagtcggtgataaatttcataccaagcttatgtgtcttttcgatcaaggcaaagcagtcctcgttcgtaccgtaggttggccagaccttttcgtagttggcaatatcgtaacccatatcatcttgtggcgagtcgtaaaatggcgagatccaaatggcatcggtaccaagctctttgatgtactccaacttggaggcaatacccttcatatcaccccaaccatcgttgttggagtctttgaaacttgcgggataaatttgataaattgtggcctctttccaccacttgggttctgtttctggatgtgcagaagaaatagtcattgtacgttgctttcttatctctatgaaaaaactttcacttttgtttgtgtgtttggattggtgaatggaacatatattctagtacagctaattcctcgagtgaagaagtcttccttacttatatatgtctgtggacgtcttacgaatgatcgaaaataagaaaagaacaaagtaaatttaggatctggaaggagtgctgtatgtaaacgaagctttcagttttaggtaatgtttgcacaacctacatgatataagatggtatgttctgcaacagcgtgcctgtcacttggcccgttatagcagattatacccatctgcaagcagaccccattattgcattgcctccgcagccttgcgtatacatagccctaagacaaaatacggagcgtaaacaaccctcgatccccgcaacaattacataaccatttctccgcggaattacataatcatttctccgggaaaattacataatcatttctccgtgcgagttataagtgcttttctcgtgcatttccctgacacttcacaaaaccttctttttcttttttctttatttcaggggaaatcagtgcaaaactaaaaagaaagaaattttgtgaaatgtaaactccaggtgtcaaaaaataaattatatccgtggaaaatcaggcgtcggaaattgtagatgaatccgcctcctccacaataaaaatgctgaccacacgagcaatgcatacactcggacaccttcgttcaaagtatcagtagcagttcgacacaccctatactacttagctcttaaggtctaggctcatctttctcagttcctctttttcgctaaataaaggtatataatgtcacagctgtgtaactaaagaacactgttgttcctatctttttcttcttctttttttggtatgagttggaaaaaataatcattgcacaattgagtactaaaagctttcgtatcttacccaatatcatgtccggtgttaataatacatccgcaaatgatttatccactaccgagtctaactctaactcagcagtaggcgctccttctgttaagactgagcacggtgactccaaagactccctcaaccttgatgctactgaagcacctattgacttacctcaaaaacccctctctgcatataccaccgtcgcaatcctatgtttgatgattgcatttggcggtttcatctttggttgggataccggtaccatttctggttttgttaacctttctgactttatcagaaggtttggtcaaaaaaaaacgacaaggggacttactacttatcgaaagtaagaatgggtttgattgtctcaatattcaacattggctgcgccataggcggaattgtcttgtcaaaagtcggtgatatatatggtcgtcgtattggattgattacagttactgccatttacgttgtaggcatcctaatccaaataacctccataaacaagtggtaccaatacttcattggaagaattatttctggcataggagtgggaggaattgctgtcctttccccaatgttgatatctgaagttgctcccaaacatatcaggggaaccctggtccaattgtaccagctgatgggtacgatgggtatttttctaggttactgtaccaattacggtaccaagaactatcacaacgccactcaatggagagtcggccttggtctttgctttgcctgggctacattcatggttagtgggatgatgtttgtaccagaatcaccacgttacctgatcgaagttggtaaagatgaggaagcgaaacattcactatcgaaatccaacaaagtctcagttgacgatccagccttgttagcagaatatgacactataaaggcgggaattgaaattgaaaagttggcaggtaacgcatcatggtctgaactactctccactaaaacaaaggtctttcagcgtgttcttatgggagtgataatccaatcgctgcagcaattaaccggtgacaactacttcttttactacggtaccaccatcttcaaatctgtcggtctaaaggactcctttcaaacttcgatcatcattggtgtggtcaattttttctcttcattcatagcggtatacaccattgagaggtttggacgccgtacgtgtctattgtggggtgctgcttctatgctgtgctgctttgctgtctttgcctccgttggtgtgacaaagctgtggcctcaaggaagcagtcaccaagacattacttctcagggtgccggtaactgtatgattgtgtttactatgttcttcatcttttcgtttgccaccacctgggcgggcggctgtttcgttattgtgtcagagacgtttcctcttagagccaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcttgacgctggaagaggtaaatactatgtggctggaaggtgtgccagcatggaaatcggcctcatgggtgccaccggagagaagaaccgcagattacgatgctgatgcaatagatcatgacaatagaccaatttacaagaggttcttttccagctgatcttctagttttcggtaaattggtaaaaaagcaaaaaaaaaaattgacgaaactaattctctattatacataatgtttttacttttgtaccctttaatttctaatgaatgttttatggaagcttcaataaatgcgtgactggctatagttgtcggatggcaatccattattatgtataccgtattattaagagtgcaactaggcccgactataaatctaacactcagatccttgtactgtaatgcatatttattttttcacaagttgcatgctaataataccatgatattttttttgaagccttgaaaaatagttcaagcagctacgatatcatgaatcaatatactcattgcagcctatgtaatatatataggttccgtgttaccactcgtttctgatattttcgatatggctacactgggtttttcatgatggaaatgtgatactaccagttccaatatatttatcttccttatctatatgacacgctgttattttagttcaagtcagtgtccaattgaagtgagtgtcacgtgcacagcgacggtagtcgttggatgtgctaaatgatgttctactgccaatgactgcaaatacgttcgaagagtataaaatcgaaggaaacgaattaagttgccaatccttactgtaactatagcatgttacatatatgtaccataagtatcacattaaggtttcgccatagccatgtgcctatattaaatagaaatatcacatggcgatccacggaatgtttatagattttcttcttttgtctatggcccgggcgagacattaatttatcttgctgaaaaattcgaaagttaaaactcaattatgcgtgggatttctcaattaggttaccagaatttcaatctgctgaagaattatgtcttaaaaaaaaaaagtcccgcctcaaaaaagccaaaaagggtgtgactgtagattgtgggtaacttgctgtcaaatgacatgaaaatctctgcctgcatgatccctgtcaaaattcgaaaacacgcggtcataaaattgtgcctcaaaaagatatcttttctgcgggttctcttagtaaatgaggttaggttgtttcctattcttacgagatttcccttgttctcgccgctcacatcattgtcggtaagatcttccgtagtggcaggtcaagcagtgaggaagaaagatcggcagtaaactgataagagccaaaccgaaaagtttcttatacgcaaaaacgctttgaaaattctccaagaatcctatttgaaactcttattaataaataaagtataaatataataaagtttattgtgagacatgtcgcgataagcaccccttgtctttcttggaagggagaaatttgtaatataaagccaagtgctcagaactcgatttttttctgaccaaagagcggaagctccactataaaagttgggaggtacttttaggttctcttaagttcgcatttaattatggcctgaacgattttactgtggacaataagtgaaataagtgtccttaaaatgtgtacgatgtgtacacatcaacctactctccccttcattggcagaagagggaaccatttcatccaaaaaaaataaaaaaataaaaaaaatccaaatattaagctaaaaaaatacttaactgtttacacaaagcgtatataaaatgcatattaagaacctatctcgtttcagaggaataaacttttaattcctcagttaaaaaaattagttaaagaaagcaagaacgaaaataccgaccaatgcattcaaagtattggcattcaaacctgcggcaataccctcggactggacaatgataccagtagaggtctttattggagctgcagatttggagtatgtgggaaattgcactagaagccttggaaatggcagtagtcaatgaggttgctttagaaccctcagaagtgacagtagtgtatgactttggagaagcactagttgcgtgacggttgaagtagcttcaggtattttagaggtgattatcttgacgttacaaccattgtcatcaccattgagtaaccagtggcagtagtgtatgtccttaggggcagcactggtttctgaagtttctgaagtttctttaggagcttcagaagtgacagtcttggtgctacatccattgtcatcgcactgagtaacagtagcggtggtgtatgtctttggagaaacagtagtggttgtggcttcaggggcctcagaggtgacagtcttagtgttacagccgttgtcgtcacagtgagtaacggtaacagtagtgtatgattttggagaagtagtagttgctgaagtttcttcaggacattcagaagtgacagtcttggtgctacatccattgtcatcacactgagtaacagtagcggtggtgtatgtctttggagaaacagtagtggttgtggcttcaggagcttcagaagtgacagtcttggtcttacatccattgtcatcacagtgggtgacggtggcagtggtgtacgattgagaagaaacagtagttgtggtggtagcttcaggagcttcagaggtgacagtcttggtgttacagccattgtcgtcacagtgggttacggtgacagtggtgtatgattttggagaagcagttgttgctgatgtttctttggaacattcagaagtgacagtcttggtgttacagccattatcgtcacagtgagttacagtggcagttgtgtatgatttggaagaaacggtttcagttacaacagcaccggttgatgtactaacgtgacatccagtttcatcacaagaagtaatagtggcggtagtggatgagcatggaacggttgtggtaatggtatagacgttaccattggagtcagttgtctctgaacaagaaactacgactgtgcttgtggcatttacatagtctagtgttgtagtgtaaacagatgttgaaccggtaacggaagcaccaaatgaagtggaagcagttgaaccggtaacggaagcaccgaatgaagtggaagcagttgaaccggtaacggaagcaccgaatgaagtagaaccggtaacggaagcggaagcaccagatgcagtggatgaagaagcggcactagtagcgacaacaccattgtagtttaggtagtaagcgtaagcacctgcaaagattccttcagagacgctgaagtcagagctggagaatccggtaccaatagcaaaagagaattgtctgttaccttgggttgcagttagaacaccggtagtaccgtcataagaaagagcagtgatgtcagcggtaatggcaatttggttcttaccagtgtagccaacaacaggaataggagtggcattggtttcggttgggtcaacagcaaggacaccttcacccttgaatacaacagtttggccagtaaatgtgtcagggtagtgtaagtataggttaccggaaatgatgttgactgtaccttttccagaaactggttcgacaataacataggtacttccattgtctaggttaatttcaccgttgtttactgaaccttcagtgtcgtctctacgttgtagaccggaaacagaaccaccgttgagaatagcgttcgagaaagagaaggcaccagaattggagtatggagagaaagtgacttcacccttcttggactttgatagacttaaggaaatgtcaccactgttgtcaaaagaacttggagtgaaggagtagatggatgcagaggtggcagcggattcttcagcgttgaagttaccggtcacgtcaaagttttcaccggagatgtcgaattcggtacctggataggtttctttggactttttcacaagcaagtcaccgtagacttttaggtcagctgagaaagaatatttgtcaccgtcaagtagagtcaatttggcaccagctgcgaccacaacaccttctgttgcaattactttaccagtaagagttagatcaccactgattgtagtagttggtagatagatagtaccatcgctggaagaaagggagttggaagcagttgcgcttgcactagatgctgaagaagtaatggaactcaaggaattggaagtggcagaaccggaggcagtagaagcggatgaggttgattgagggaatgagcttgagctaccagaagcggatgagactgattggctgccagagcttgagacaccagaagtagaggaagctgattgactgacagagcttgagacatcagaagtagaggaagctgattgactgacagagcttgagacatcagaagctgaggaagaagattgactgacagagcttgatacatcagaagctgaagaagaagattgactgacagagcttgagacatcagaagtagaggaagctgattgactgacagagcttgagacatcagaagctgaggaagctgattgactgacagagcttgagacatcagaagctgaggaagaagattgactgacagagcttgatacatcagaagctgaagaagaagattgactgacagagcttgagacatcagaagtagaggaagctgattgactgacagagcttgagacatcagaagctgaagaagaagattgactgacagagcttgatacatcagaaacggatgaagaggattggctgacagagcttgagacaacagaggaagaggatggaccgacagagctcgagacaccagaagtggatgaagctgattgtgtgatagaacttaagatatcggtagcggacgaggatgtctcagcaatagaactactgatcgaaacggatccagaggaacttgataccacagaggtggatgagctgttgcttgaaattgaggtgctattgctatagtactgacccaatgcactttgagagtaaagggccaaagctaaagcagcttggaatttgtttaaacgattgaacatctctttcaattaggcgagatcttaccaaatttgcaatgatgaggcttgctgtttctaaatttactcgaaataaaaacaacacatactgtccaaaaccccccatagcaatgaatcaagacaaagccttttatatcattgtaggcgctgttgcagttatttgtgggcttccgatatgtaattactgaaaggactgttgagctagatcgattttttgtacggcaattccacaggactcttcaaagcctgcgaggtctatgcgcgcgcgtttggtaagtaggaaattgggtagtaattttatgcaaacgcaatggttgccgtgaataacaacacgatccctttaatattatacgaaaacgtgcagaacggcacaaaccaataggctatgaccaaaatggttcatgagaaagaaccaggagtattatgagtagtaacccaatttttttttgagacttacgctactttcgctcaatccaacacgagcaattacagtaatccgtactcaaaatgagccgtttggactcactacaggatcatatacgattaaaagatagaaataggcatctcccgcctttggagcaaaaaaaaatggtggttgctcttggtcgcgaagtgaatcttcaacattgctgaggggacggctgcctgacttcactgtgacgcgaacgcgataatttttgcgttagcgagtggctagtaagtcccttcaaaagccactccctgtaaaataccgcaccttccgggttgctttcataatcaaacaaagtttaggactcctcccaagactcgtcccttggcaaaaaaaattaagcacctaactaaagaaacttttgccatttttttcctaaaataatttgaaatgccacccaatttgcaaacatgattcatggatcttggaattatcatattatttaacgttatttgcacctatccacgagagaaagcaaggaacataattccgtgcgccgatattccaaatctttccgaaaaaaattctctagcggattcatataacccgctagataagccatatattactaattgcctttcgtgtctatttgcctgaggattttagactacaggggttattttctttttttttgaggatgatgaggatgatgataataatcagtgtccgagttacactcaatgaaaaacttttggtgcaattacgggagtaaagagttttcttgactttttgtcatgaatttttagtggcttgtttacaagttcaaaagcaggcattcgcttcgaaaggactgaaccttggtcttctgcgacagcaatttcttttcgtaataccttatatcatgtcctgtcttgaattgtagttttaaggcgggcattattttgctgaaatggaattttgatagcggtagttcgatcatatggcaatgcagtacgatttgtatatcgaggcatatgcgtgttgtttctacacacatctaaaatatgtttagctactccgtcgatagagttgcgtatcataagttattttgacagcatctcattgtaattttacgttacaccttctctctggatgtagttccaggagcttgaggcgacctcatcaactaaagaagttggtcagaagaaggataatgcaccatcaagtatttgctatagtccggtatgtcatcaaatgtcgaatgttccccgtcagggtattttcttctagagaatacttttctttggtgtctctgtagctttcggttgggtaaaagggtattacttcttacttccactgaaggctagaataacacgcaggactgaaaggtgaaatggcctgtcttgtgctctcttcattttattttttattagcagaacatcctgctgtgatgaaattttatggtcaacttcttttacgatgacaccctttcttgcacttcctttaggacactgaattgggatgccacacgtacaaatttgtcttctatgtgcggaaattagaaaccatccatttacttaatgtaatatttcattgtctgcaaaaatttgtttgtggtgttatcttaacaacttaaaaaattcttccttatgcagtggaaacttttaatgacatgtggtacactttttaaaggtttacatgaagtttaccatgcctcttctttttttttatgtcttgcttgtaacgcagttgtaattacttgctgttatatctcgagcttccacctatattgctttcaacacaaagaaccttttgacggtcttgggctagctcctatttttggacccttgcccatcacagaactatgagaaaagcagtacgtcttgactttagtgcatgctgtacatcctagactgtaactgattcttcacagaccttgccacataaaactacagatatccccgttttcttggtttacggttggcataccttcaaaatattaacagtcaactattaaacgaatgatgccctaccttatttacattctttatatatatatatatatagcattagtttacaaataccgtacatgccattcaccttgacacacccataacggtaattcaaatcaaatcgtcatcgtttgggcggaatcatatcctcaaattcttgacattgcatagcgtagtatatatggtattaagaaagctcgtacagcataagatatcaggttctttctttgaacattatcgaacgctgttagcctcttgtagtatttccccattgggctaaacggcaatgtccttatcgtagttagaatatggaaaaattacataatttcgaaactggaaatgatgctagataaaagtggaagattactaagcgtagtatattagccggaaagaattcatatatagtcatgaagacattttgaaaaaattacatttatagaagtttattataacgtaacagttaacaacaaaggctcatagtccgagatcaatataataaattattcaaggtttaaggaagaagttaccatggaaatgacttactatgaaaagacacctttgattcgtcaatttttgaacaatggtaagacaaattcgtggttttacgttaagcatgagatgttacaaccaggtggaagtttcaaatcgagaggaatcgggcatttgataaggaagagtaatgaagaagcgctaagcgagggttctgggaagcttgctgtattttctagctctgggggaaatgctggtttagcagcagcaactgcctgcagatcgatggcacttaattgcagtgtagtggttcctaaaactacaaaacctagaatggtaaagaaaattcaaagtgcaggagccaaagtcattatccatggtgatcattggggggaagcagatgaatacttgaggcacgaatgaatggcgcaagaaagccaacatggttcgaagacactatatgtgcacccgtttgataacgagacaatttgggaaggtcattctacgattgtggatgaaatcatagaacaattgaaggaaaatgatatatccttacctagggtgaaagctttggtttgtagtgttggtggtggtgggctatttagtggcataattaaaggcctagataggaatcagcttgctgaaaaaattccggtcgttgctgtagaaactgccggttgtgacgtattgaataagtctctcaaaaaaggtagtccagttactcttgaaaaattgacaagtgttgcaacttctttggcctccccatacatagcatcattcgcgtttgagagttttaacaagtatggatgtaagtctgtagttttatcagatcaagacgttctggcaacatgcttgagatatgccgatgactacaattttatagtggaaccagcctgtggagcatccttacatttatgttatcatccagagattcttgaagacattctggaacaaaaaatatatgaggatgatatcgttattataatcgcatgcggtggatcatgtatgacgtatgaagacttggtgaaagcgtcgagcacattaaacgtatcataattttcaaatacacacgcgatcttagagcaatagaaatggatcgcgatctatctatgtacgttcggacttattaagatgtgtttcattttttttcgttctagtctttttattggatggtggtctggaaattcaatctactgatactacagtattaaagcaattaagcacctaggatgaagctcctgcaagtagcttggtagatgagaaatgttaagcggatagtaacgctgaagctatgctatgccataataatttataaaaaaatcaataaaaaagagtgtatattgatattactaatatgtagaagaaagaattaactagtataattcggagagtagtaaagaaaattttatttacatatgaatgtagaaattaattctacgattcacgcggaatattgtgaaatcttgagataagaaagttgcaagagatcacaaatgaaggttatctgcaaacagcataaacagatgacaccttatgaatgtaaggtaacatcggtagcttagcgcgttgacctgtgagctcctacatagaatatttgtgtgcttggggattatttgagaagcattaggctggttcagaggaatatttacaattggtcattgtattttgatatcaattaccgaagattttggtgttattatgttcaaaaacttttttttgtttccgtgaacacacaattgctgtcacctgcttttgtggtatagcagtgcaaaactactaaaaagcaataacatcccatgacctttaccttaaaaactcgaaaaaaaaaagtttttgcattaaccttttgttgctctggtgtaataattttttttgatgtatgacttctcgcttttgcgtgtagcattactctaacagcaaaaattttaatacacgaaaacttaatctagtgaataaacctataatcaagacgcttcattcccttatctttagttgtgtccaagtaattgatctgctcttcttttgtcatagagttccatttgcggtccttgtatttattcctactaatatagtaaaacttagtagcaacagccatacaaatgttgaagcaagtgaatcctagaagtattttgttacctctagtatagtaaggtttatcatcatttctatacatgttagaagcaatgattgctccaacttgggcactcatattgtataacgctgtgcccactgtacgcgatcttaccgaatttgaaatctcggagacccaaccagcaagaatggaatgtgtatagggaagaccaagtataccggttagtaatatatacttgatccaggggtttgtgtcagtcggtaaagcgaccagagaaactatgaaagggagcacccaaacgttggcaattcccacacaaagtgatttttctttcaatttacgcgataatagtgccgctaatggtaaatttattagcagcagggcttggcctggaattgctaaaatgttcgaaagaaatgtagagtaatttaaactctttaatatcaaagataaataggaaccaactgtttgaagagatatgaatgctgtaataccttggataaacaatggccatagatcaaattctgttagagtgtacaaaatctccttgaaggtaactggttgtcggttactcatgtcaccctttgatgggtcatcccttaaaattctgttaaccataattttctcctcatactcagtgaataacgattttcctttgtgaaatgcagactcaccagtttgcgtaggtcctctacgcattaaataaaaggatgccacgccaacagaaagggacagaaacccttcaattataaataggtactgccagccagctaagttatgaatacccctcatctctatgattccggaagctaaaagagagcctaaaatttggaaaagaggtatagcacaccaaaagaaacttaggcggaatgtgagctcagctccagtataataatatgacaagtatagaatattgtccgggatgaacccgccctgtaccattcctaataagcatctagtagcaataaattgacctcgatttttcagaccagcttgagtaatacaaattacactccacaacacaatttgaaccggaatgaccctttctggaccaaatcttttggacagcagattgccgggtagttcacttgctagaaatataactagataaacagtttggccaaggttgtagtcgttcgtgttcattttcaagtcaacaatgaagttgtctgaaactgcccttgcaatatttttccttattaaatccaaaaaggcaaacataataaaaacccacaaaaaaatcttcaagtccatttttcttaccaatttcttttcctcatcctttgtccatgtaaactcaggatcgaatttagacaagccttcataaccactggattcatagacttttctccaacgctctgctttatgaaaatcgtcaaatgggttatgtgaaatactctccgaatctgatgttaagctttctgcggacacagataattgggccttttctacaatatcgtattcttctttttgtacggacatagatgaaactttgtttgttgattgaattttttattaattgtttgtacaataaataatttcaataatcaacaattgaacgctgcctttttatactaaatgattcagtagaagacgaacctagcgcagggaatacgtcatgtatttgatagtaagcgccaaacctattaggcaataaagtgtgacaaattggtagcattgatagttattcccaattgacccataggctgttgaaatgaaaccatcagtatatgttgaaacctcaagtgaggcgtcaacctctaagtgaggcttcaagcttcgccaactattatatatgccacatgactgcagggtccttattttaaggagctagctgcaacgactttgtgctgtaaaggggtgcagcagcaaatgtagcctatttgctcgaggtttttctttcttacgagaatgctagcaattcaagatagtacgttgtaatatgatgcatttcggcacaattatccgagaaacggactatttcgggattatatcgatccgaaattctctgcgtcgagccgaatgccaaggaaaaaagttcagagaatgactacaaacagccttggcgacggcaaaagtaagcttggtaagaatggcttgatccacacggtgattcttgtatcgggtcaatgcataattttgattgtgaaaggcgcaattattaaggctgcattctttagcttgtcttgactcctacccgtcatcgtacaatctccacattaaaaaatatcacgacatttataaatcttcttcacaccggattaaacaaaaaaactgtgttaatcggatccgggagaaaatgctaatatctccttcttgtttgtgaaatgatgataactgggctgttgaacgaaaatgaaacttctcaaatacacctatttattaataaatgttaatttatattttaaaaaaaggtaaaaattaaatgatcaggtttgcgatcctgatttcaaaatcatggcttggattatatcttagagacgtatggatttcaaacaaatgcctatttgattgaatattacagatctacattatctcttgtacataaaacattatataacagacatattgatattaacgaatattttcgagccaccattcatgaaagcctagttaatggatttatgcggtattcatttcgtaaacttgacatcgtgtgacctttcattgacagtcaactggaagacatctcccctagcataatgtccgacagggtcaagatcaaagcgagcttcagcaatcaagtcagtgttaatttcggcggttaaaaggccctcctgccctagcaatggccctgcaataatctctccataaggatcaataataacactacctccattaatacagttgtcgtcagcagatggccatccaggtaattttctcttacctgtagcttggtcaataatctccccaaagcccattgctgtcgcatctggcatgaactgcactgcactaatcaagaatagacgaccttcgtatgcaatatttttcatcacagtcctctaaataggcctagcatccaccgttggggcacaccagatctcaaccccttttttatacatggcgtatctcagtagaggcatcatgttctcccagcagatagcaccgccaatcttcccagcagcggtatccacgacaggcagagtcgaaccatcgccttgaccccatatcagtctttcgccagctgtcggcatcagttttcgatgcttcccaacgtagccatctttaggatctatataaaccatggtacaatataatgtcgtcccatcgcgctctatacaccccacacataaggatgcgtcggtggccttcgatagtgcgcacaactgactaatttctggatatttctctccgtttccgatctcaattgcttcggcaagatacttagcatactcctcccttccttcttgaagacggtagcctagataaaccccaaagttcgatccctttggataaccaccaagagtggcttctgggataacgaccaacttggcaccagattccttgatctccttctcatatgacaaaatttttttcaaggtatccttagtagagcccggacaagagccgatttgaagggcagcaacaatgtgtttcgccattgtggttaactagaggtagcctcgaaaagtgattggctaaccctaagtcataatatcaccctttcttattgaagagcttttattatttatatacactgccctttatgagtcacggaggcctgggctccattttttttacgaagcaaaaaagatagctcatatttcgtaagcattaggccaactttactgataaccgttttcaaatcgcggtgggattaatataatgtggcgttcatagtgaaatgtggctccaaagtataagcgtaaatgcgtttgcttatcgaaccgcaagtaacttgtaatttcacctctataatttcgagcggtttttaagatacaccatgtttcaagtaaccacctttcgcctttttcctctgttatcgaacttccatctgtaaaaagttcgcttgcagaagaaaaaaggcactacacggaagaggactgataattaatgaaaatcaagctatgatcaaacaactactggctctaatatatggtttcggctacataatctaattgtcatatctgttatctcgacactcgtctctcgataaacgagttcttcactgttgctaggtgcagtggtcggccatagttatccatacaaaattccaatttcttacgcgcatagcagtcgatacatgcaaacatctcgactattctggcgatagcagtaccaacaatcaccagcacaaattttgtcacctgtgctttgctagagttacttcagtactaattagattataatattttgcagcatttattggtatagaaagaaaagctcgagcactaccaacttttatctgatataccgaaaaatgcataaatatcttctctagtttgtgcgttttcttgtcgccctacctcacaaaagagaagtactgatggctaataattgttggatcgattcattgtatctcttaaatgtcaacagagcataagtcagactctttgccatttttaaaaagctgcgaaggcgaacgtgactacggggtgcgggtttttgtattgctaatgtagcatgacagcttatccaatgttttgttgtgttcattcaaactattttgagcctcacttcaattttgtttgactactaacatggcagcatgcgtcgtttctaggtgctagccaggctgtgagaacgtaaaattagcctatgttcaacattctctgcttttcaatgtcactgttcattttgttactatgaaagtagttcgtcgcaatttgtacttttcttcgaaagtcttcttttgcagtagatgaagtgtgttctgagaaattgatgctttcaaatggccttaaaaaatttttgtatcatagctaacaacatactgttgcgccaggggaagtgaaatcatggttgtatattacaatagcattatgtgcatttaccaagtatggaaaagcggaaagtgtgaaagaagtttatgaaaaaagcggaaaataaaaaaaaaaagtttattttcctgtgacttctgggaagcagttagacctccttcgctgtattcttaggtgctatacctcatttccacgatggtaatagacgatcagtctattaatgcgctaaagaacgtagaaaagttattaactgaagaagctttgctaatgccgtcgcacattaaacggctagacattgccttgaataggaagccgaataatctacgaaatatcatggagcttcagggccttgcatatactatagtaaaaaaaaaactaagttttcccctgtagtaaacagggagataccgtacggaggtctgaattccctacagaagtagctgtaaaaattcagaattcgcaacaacctataattgagttaagtgcctttccaagctaaaaagtttgaggttataggggcttagcatccacacgtcacaatctcgggtatcgagtatagtatgtagaattacggcaggaggtttcccaatgaacaaaggacaggggcacggtgagctgtcgaaggtatccattttatcatgtttcgtttgtacaagcacgacatactaagacatttaccgtatgggagttgttgtcctagcgtagttctcgctcccccagcaaagctcaaaaaagtacgtcatttagaatagtttgtgagcaaattaccagtcggtatgctacgttagaaaggcccacagtattcttctaccaaaggcgtgcctttgttgaactcgatccattatgagggcttccattattccccgcatttttattactctgaacaggaataaaaagaaaaaacccagtttaggaaattatccgggggcgaagaaatacgcgtagcgttaatcgaccccacgtccagggtttttccatggaggtttctggaaaaactgacgaggaatgtgattataaatccctttatgtgatgtctaagacttttaaggtacgcccgatgtttgcctattaccatcatagagacgtttcttttcgaggaatgcttaaacgactttgtttgacaaaaatgttgcctaagggctctatagtaaaccatttggaagaaagatttgacgactttttttttttggatttcgatcctataatccttcctcctgaaaagaaacatataaatagatatgtattattcttcaaaacattctcttgttcttgtgctttttttttaccatatatcttacttttttttttctctcagagaaacaagcaaaacaaaaagcttttcttttcactaacgtatatgatgcttttgcaagctttccttttccttttggctggttttgcagccaaaatatctgcatcaatgacaaacgaaactagcgatagacctttggtccacttcacacccaacaagggctggatgaatgacccaaatgggttgtggtacgatgaaaaagatgccaaatggcatctgtactttcaatacaacccaaatgacaccgtatggggtacgccattgttttggggccatgctacttccgatgatttgactaattgggaagatcaacccattgctatcgctcccaagcgtaacgattcaggtgctttctctggctccatggtggttgattacaacaacacgagtgggtttttcaatgatactattgatccaagacaaagatgcgttgcgatttggacttataacactcctgaaagtgaagagcaatacattagctattctcttgatggtggttacacttttactgaataccaaaagaaccctgttttagctgccaactccactcaattcagagatccaaaggtgttctggtatgaaccttctcaaaaatggattatgacggctgccaaatcacaagactacaaaattgaaatttactcctctgatgacttgaagtcctggaagctagaatctgcatttgccaatgaaggtttcttaggctaccaatacgaatgtccaggtttgattgaagtcccaactgagcaagatccttccaaatcttattgggtcatgtttatttctatcaacccaggtgcacctgctggcggttccttcaaccaatattttgttggatccttcaatggtactcattttgaagcgtttgacaatcaatctagagtggtagattttggtaaggactactatgccttgcaaactttcttcaacactgacccaacctacggttcagcattaggtattgcctgggcttcaaactgggagtacagtgcctttgtcccaactaacccatggagatcatccatgtctttggtccgcaagttttctttgaacactgaatatcaagctaatccagagactgaattgatcaatttgaaagccgaaccaatattgaacattagtaatgctggtccctggtctcgttttgctactaacacaactctaactaaggccaattcttacaatgtcgatttgagcaactcgactggtaccctagagtttgagttggtttacgctgttaacaccacacaaaccatatccaaatccgtctttgccgacttatcactttggttcaagggtttagaagatcctgaagaatatttgagaatgggttttgaagtcagtgcttcttccttctttttggaccgtggtaactctaaggtcaagtttgtcaaggagaacccatatttcacaaacagaatgtctgtcaacaaccaaccattcaagtctgagaacgacctaagttactataaagtgtacggcctactggatcaaaacatcttggaattgtacttcaacgatggagatgtggtttctacaaatacctacttcatgaccaccggtaacgctctaggatctgtgaacatgaccactggtgtcgataatttgttctacattgacaagttccaagtaagggaagtaaaatagaggttataaaacttattgtcttttttatttttttcaaaagccattctaaagggctttagctaacgagtgacgaatgtaaaactttatgatttcaaagaatacctccaaaccattgaaaatgtatttttatttttattttctcccgaccccagttacctggaatttgttctttatgtactttatataagtataattctcttaaaaatttttactactttgcaatagacatcattttttcacgtaataaacccacaatcgtaatgtagttgccttacactactaggatggacctttttgcctttatctgttttgttactgacacaatgaaaccgggtaaagtattagttatgtgaaaatttaaaagcattaagtagaagtataccatattgtaaaaaaaaaaagcgttgtcttctacgtaaaagtgttctcaaaaagaagtagtgagggaaatggataccaagctatctgtaacaggagctaaaaaatctcagggaaaagcttctggtttgggaaacgaaggaactccaatcgggaatgaggagagcacaaataaagctaaaaatggaaataaaaagcggaataaaaatcgaaacagaaataagaagacagagacaaaggaacaaaatgaacctaaacctgtgactggaggggaagaagtgagagtcgagaaatctcaagcgaaaaacagaaggcggaaaaacaataatggagctaataaaaagaataccctacactactcaaaggaaattaatgtagaagagcgaaaacaaatcgcaaaaaggcaagaagaaatcgaacaatgcattcacaccttatccgattttaaactgtttaaaaagggtaagcacgttacctcatatggctatcgaatctcccccatgacagactccggtaagatttctttgaaaattttattcaacatacctttggattatccaaaggccccaataaaactaacgatgaaaagtaatgaagaagtttcctcttacatggacaccgtgatagcgaatttcaactggaaagcccgtcaattggttaaggaggactggaggatattatctcaaataaactatttggttagtgagttagaaatattgaaaatggaaaattataaacaaattgataaactacgtaatagcttttacaaaaccatataaatatgagcataataaaaagggagaatattaactattatcaagtattaaaactattctttaataaagatggcggcggcacccataccagtaccgatacacatactaacaaccccgatttgatcctttttcagttctcttagtatggtagctacttgccttgcgccagtacaacccaagggatggcctaacgcgattgcaccacctcttggatttactttattcaaatcgatgcccagtttatggatgcagtataatgcttgggccgcgaatgcttcatttatttcaaaaatatcgatatcttggacttgcaagccagtagcttccaggacttttggtatggcgtatgcagggcccacacccatgatttcagggggaacccccactgtttgaaaatcgatgtagcgacctagcacaggcagatttaactggttggctacggacctgcgggctaacaagacacctgccacaccatcggagacctgggatgcattgcccgcagttgtggttcctctgtctttgataaaggcaggcctgatgcttgaaagcgactccgcagtgacgttagggcgtggcccttcgtccgactggcaaattgagccatctggtaattttataggtaaaatttcatcttcgaaaagcccctcatttttcgccttgtaagctttttgatatgaattcgcagcgaactcgtcttgatcctttctactgatcttgaaattagcggcaacattctcattagtaatgcccattggtattagacatttcttcgcttctcggtttttttgcagctcttcagaggagatcatgcccaagggattgacgtttttgtagttattggtcattgattccactcccagcgccaaaccaatatcaatttgcccaaccttaatcttgttggcaatatcgttcaccgccgttaaacctgaagaacattgtctgtttaaagcgacaaatggcgtcgagtagggaatcccacttgccaagcatgcagccctgtgttctgtagcaccggctccaacattgagaacatttccacaggcaacttcttcgattaagttcaaatcagccctcaaaggttccggaaacctcccgatgaactcattgagaaagttgtataataagtagtctgtgtttacatctttgaaggcacctttaaaacctttaccgatggcagacctgttagcagccacaataactacatcttcgggtcttttctccagcaacgagttcttcctcttcgattcacccttacccatggcgctctccaccaaatgatccttgatactttgtagtctttgagacattgcttttatgtagtgttatattcactctgtactcagagccacaagaaataaccattcgatttcaatagaactgagatgcaaaagtataccctatttatatctcttctttctagtaaaactccaataaatttgaaaccaatagagggagaaaggaaaaaaaagctgcggtgttaatactattatccccgtttccctttgatagcgccttacacggcgctaccacatcattaccctcctcatgttgacgcgtcaagttttttttcttttttcgctatttgtggcataggttcaaaactagcaaattcttgatcttttgaagattacatagtgatgatgatcgtgacacaaaagcagataaaaaaatagcacaatcatcagcgatggactcttccccgaacaagaagacgtaccgctaccctcgcagatcgctgtcacttcacgcgcgtgatagggtcagcgaagcccgtaaattggaagaattgaatttgaacgatgggctggttgccgctggcttgcagttggtcggtgtagcgttagagaaacaaggtacaggatcacatatatacatgaaacagaagaatttctcagctaatgacgtttcttcgtcaccaatggtttccgaagaagtgaacggatcggaaatggattttaatccgaagtgcatgcctcaggacgcatcactcgtcgaaagaatgtttgatgagcttttaaaagatggaacttttttttggggggctgcttataagaatttacaaaacatctctctacgaaggaaatggttattgatatgtaaaatccgtagttccaatcattgggggaaaaagaaagtgacttcgagcacgacatactctacacatttggccactaatgaactagctgaaaacgcacactttttggatggcctagttagaaacctttcaacaggtggcatgaagttatcgaaggctctatataaactagaaaaattcctgcgaaagcaaagctttttgcaactttttctcaaggatgaaatttacttgacgacattgatcgaaaagactttgccactcatatccaaggaattacaatttgtttatcttcggtgctttaaaatactgatgaacaacccactggcgagaataagagcactacattctgagcctttaattcgctggttcaccgagcttctgacggatcaaaattctaatttgaaatgtcagttactttctatggagttacttttattattaacgtatgttgagggttccacgggttgtgagttgatatgggaccagctttccatattattcaccgattggctagaatggtttgacaaaatccttgcggatgatattgcaattcattcatccctttatttgaactggaaccaattaaaaatagactattcgacaactttcctactgctaataaactccatactgcaaggtttcaacaacaagactgcactagaaattttgaattttttgaaaaagaataatatacataacactatcacatttttagaactggcctataaagatgatcctaatagtgtcgtgatcatggaacaaataaaacaattcaaatccaaagaatctgcgatatttgactcgatgataaaaactaccaacgatacgaattcgcttcacccaacaaaagatatcgcaagaatagaaagcgagcctctatgtcttgaaaattgcctgttattgaaggcaaaagatagtcccgtagaggcaccaataaacgagattattcaatcgctgtggaaaatcttagactctcaaaaaccatactcagaatctattaaactattaaaattgataaattctttgctgttttatctcatagattcctttcaagtgtcaacgaatccttcttttgatgaaaccttggagtccgcagaaaatgtggattatgtttttcaagattctgttaataaattgttggattctctacaatctgatgaaattgctagaagagcggtcacagaaattgatgatcttaatgctaagatttctcatttgaatgaaaaattaaatttagtagaaaatcatgataaagatcatttaatagcaaaactagatgaaagtgaatctttgatatctctgaaaaccaaggaaattgaaaatctgaaactgcagttgaaggcaaccaagaaaagactagaccaaattaccacgcatcaaaggttatatgaccagccaccttcattggcaagtagcaacttgagtattgccggctcgataataaaaaataatagtcatggaaatatcattttccaaaatttagcaaaaaagcaacagcagcagcaaaaaatttctctgcccaagcgttcaactagtctactaaaaagtaaaagagttacgtccctttcatcatatttaactgatgcaaataacgaaaatgagtcccaaaatgaatccgaagataaatcaaaagactcattatttcaaagatctacgtcaaccattaattttaatatcccttctatgaaaaatattactaatatgcaaaatgtctctctaaattcgatactttcagagttggaattttcaaatagcctaggaacacaacctaattaccaatcgtctcccgtgttgtcttcggtttcttcttcaccaaaacttttccctcgactttcctcagatagtcttgataatggaatccaactagtacctgaagttgttaaactacctcaacttccaccgccccctcctccacctccccctcctccacttccacagtctcttttgactgaagcagaagctaaaccggatggtgtttcctgtattgcagcacctgcaccgccaccccttccagatctatttaaaactaaaacttgtggcgccgttccaccaccaccaccgccaccgcctttacccgagtccttgtcgatgaacaaaggcccctccaatcacgatttagttactcctccagctccacctttaccaaatggtcttctttcttcctcctcagtgtctatcaatccaacgacaaccgatttaaaaccacctccaactgaaaagcgattgaagcaaatccactgggataaggtggaggatatcaaagacacactttgggaagacacgtttcaacgccaagaaacaatcaaagaattacaaactgatggtatattctctcagattgaagatatttttaagatgaaaagtccgactaagattgcaaataaaaggaacgcagaatcctcaattgccttgtcttcaaacaatggcaagtcttccaatgagctgaagaaaatttcattcttatcaagagatttggctcagcaatttggtattaatttacacatgttttcccaattatctgatatggaatttgttatgaaagtattgaactgtgataacgacattgtccaaaatgttaacatactgaaatttttttgtaaagaagagttagtaaatataccaaaaagtatgcttaataagtacgagccatattcacagggtaaggatggtaaagcagtaagtgacttacaaagagctgacagaatatttttggagttgtgtatcaatttaagattttattggaatgcaagatcaaagagtctgctgacattgtcaacatacgagagagattattacgatttgattttcaagttacaaaaaattgatgatgcaatttcacacttaaatcgttcacctaaatttaaaagtttgatgtttattatcacggaaataggcaatcatatgaataaaagaattgttaagggtatcaaattgaagtcattgactaaacttgcctttgtcagatccagtattgatcaaaatgtatcatttttgcattttattgaaaaagtcataagaataaaatatcctgatatatacggttttgtggatgatttgaagaacattgaagatttaggtaaaatctcactagaacacgttgaatcagagtgtcatgaatttcataaaaaaattgaggatttagttactcagtttcaagtaggaaagctatccaaagaggagaacttagaccccagagatcaaattattaaaaaggtcaagtttaagattaatcgggccaaaacaaaaagtgaattattgattggtcaatgtaaattaactttaatagatttgaataaactgatgaaatattacggtgaagatcccaaagataaagagagtaaaaacgaatttttccaaccctttattgaatttttagccatgtttaagaaatgtgccaaggaaaacattgaaaaggaggaaatggaaagagtgtacgaacaaaggaagagcttgttagatatgaggacaagcagtaataagaaaagcaatggaagtgatgaaaacgatggtgaaaaagtaaacagggatgctgttgatctactcatatctaaattacgcgaagtaaagaaggatccagaacctctaagaagaagaaagagtacaaaactcaatgaaatagccattaacgtacatgaaggagatgtaaaaacgagaaaggatgaagatcacgttttactagagagaacgcatgctatgctgaacgatattcaaaatatatagtgaagacttagtattttatgtagttgtggagcttatataaagaaatggacaatattcgcaatcgcttctcaaaagggaaatattttcccttttcgggcggtggtcgtgttgacaaatttcctagttaagaactaagatttggagatggacagattcattaataaatttcaaaataagcacagaaagcatcgaatttttagctcaaaacaatctacttttcaatcatcaaaacagactattgaataaagatgggcaatgtgtctgtggcagtgggaacggcagttgggattccaattgctgtgggcgtaataatagccctgatattttggtgtaaattacaacgacgttacaaaaaagaagagattagagatgctgatttggagaagatggtaatggaagaagtggcagtgtcggtatatgatggttttaaagccgaaattaacagctcaagtgaagcttccacgataaacgaaaaggaagcaaaccaggatcttaaaccctgccaagaaaaaaccgccaaggcagggtacacaccagcatacagaaggcaattgaacgctagtatggggactttgcgtccaaaaaagcagagcactgcatataccaatgtccccgtcattttcagcggcgaaaaggtgaattatgggatggtcagagatccttcctatagttttatgtatccactgacgctatcgcgcaaagaaacgagtagtttgagatcagcttctacgtcaaacttgtcatcgagcacagaaaatactgcgttacacgaagaaataaaactggatgacccatatgaaaacgattttacgaattatactgtcaacaagagagaatttattgacagcttacggccacactaatatatatgcatatagatatataaacgtacctacatagttttgcatttgtatagatacccagaccacttgtaataacgataaaaataaaataataataaaggatatttacagacaaatagcaccatacttgctattaaattggtgtcttggtattttcagctagcaaatcgatcttttggccagcggcagtgacgctccattcatgaatcaaaaactcttcgtcgtgagtgttcctatcggcaaccagtctaacggttccagtaacgtttttgtcccccttgatataaaacgtaatgttaatcctacccttcacagagttcagttcaccgtagacccaagggatgataccatcaaattctatgctctcacccagtatgtttttagttgctggagaccgtcttatataatacagcgtgttggagataatgggggactccgtcttttcatagttgaagatcaaagatagtgcggacccaatggccacagaaaacaacaaaaatccagctattcgctttctcctctccgtggttgggtcaggcaattctctgtcaattctcaatggcctgttcttgtctttcaaaacgatcttggcctcatcttcagcgacactattattgaatctagcgctggtagagaatgagtgcagcaaggaaccacgcactagcacagccttagctgcagaaggtgtcactttcggcaaccctttagttactagtcttaacatcatgtatagtctgttttatcttttacttttatgtcgtggactggtacggagagaaagatcgaactgttttaaaactgggattaaaatgacaagaaggcgctttctttctctccacaatgatcaaaacaagaacaagcaaaacgcaaagagatgacattagtaagtacccaaatgagctactaacaacgcatccggtaatactaacaagagaaattggttaggtagggaaactagtacacatatccatagatttggtcttggtatcaacgtgcctcgcggggattaaacgcaatacaggtttgacgcctaaactggagactctggacaatcagactatgagaaactacatgaagcggtacttgaacttgggagagtctgtatacgactattctgttgccacttgtggctcctcgacgtatttcgctaggaaataggtacgtttatattctatatatgttgataatattttgtataacggcacccagccgggggccaaaattaataaccgcaacttaaagagctatcgctatcgattacgcatagaactttaaatgctagacgatgataagggcacggccatgcatccacatataacgccgttcacgcctgagtactcaaatgaattactgcgaagggtccaggacctgtaccacgaagatatcaagcactactatccgcagctaaaactggagaagctgctggaccttctggagcatacagagtacctattcgagttatatctagattcaatccatcacgataggcccaacgatgcactgacagcgtttatcattggatgctactacgtgttcttaattattccacaatctttgcagttccaaacacgaaacaagtcctacagcatctatacagatctaaaaaagatgtatgagaatgaaatgaacatgaccaatgttgtgcttatggtgaagaaagaaatcggtgtggtcctagatgaatcggttaaacacggggccggtattgagcacagaatcaccaagaagagggcattttcagttccagctgacgatctttcaggtcaggtagcttcactatcacttgacaccgcggcaccgcaagatcatggcctcaaaggcacgtttactgaagacgacgcagaacaatcttcacctgtttggacagcaccaaacttagagcccaacgaccaattgaaactggctttattgcccgaagtgataccaacgccagcttttcgtgagcctgaaagaaagacaagtgttccagtgagaccatctgttttattggaagatgtaccctccatataccacgaggatgacactagtttcgcatctttgaacccaccatttcgagaaataaccgcagatagatcagtaactcatcgaaaggattcttaccattctgtttatatggtggatagcggcaacctcaaggaagacaatgatgatctgttcaacgttgagaatgatggcttcatccagagtttggatattttacaaaagcagagtataatcacagcaccagaattgtttagtattttatcgaatcgcgttgaacgtgaaaaggttttactcatcgacttgagaataccacaaagatctgcaataaatcacattgtggctccgaacttagtgaatgtggatccaaacttgttgtgggacaagcagacgaacacacctatctacaaggatgacatattggaacatttactgaaggagaatgagaattttataaaccgtaataaatttgattacattgtttactatactgatgtgaagaccttcatgactataaattttgattatgcatttatttttttttatttgatgctgacttctcagaagactcctttaacaactgtacctactaccctcttaggtgggtacgaaaaatggaagaaaactctgcattcgtatgcccaggagtatcatatctctattgaagattacttgtacagaccttactcacagaaggcgcgcttacaacaggagcagcagcagcagcagcagcagccggattctcaggactctttttccgctaaggaatcatctacaaaagttcctgagcctccctcctggaagccccctgacctgcctataaggttaaggaaacgtcctccacctccaccgcctgtatcaatgcccacaaccccagaaattccacctcctctgccccctaagataatggttcattcacaagtcagttctatctctcgaaagccgccaataccagcaaagcagcatgtcaaaaaggaacaacttaactccaatgaaattattcaaagaaaaagacagcaccagcatcagcattacgaccaacaaatattacaaccgcaaagggcgtacaatattccaactattgaacgcagtccaaacgtatacgtttcgttgtccatcacgggactaagaaatttgggcaatacatgttacattaatagtatgatacaatgtctattcgctgcgaaaacattccggacactcttcatttcatccaaatataagagctatctgcaaccaataaggagcaacggatctcattattctcctaaactttcgaattcactaagtatgctcttcaacaagatgtatctaaatggtggttgctcagttgtcccaacaggatttctcaaagttatcaatcaattgcgtcccgatttgaaaattcctgatgaccaacaggatacccaagagttcctaatgatacttttagacaggttacacgatgaactttccgaccaacagcatgtagcgaacgattatccgaatttattattgtataatgcagatgccctaaaggtttcaaacaacgaatataagcactggtttgacaaaaatgtcattggtaatggtatatctcctattgatgacatttttcaagggcaaatggagaacagcttacaatgtaaaaggtgcggttacactactttcaactatagcacattttatgttttatcactggctataccaagacgttccatgaagttgagtaaacttggtaggtctactgagaaaagagttaagttagaggattgtattaatatgtttacaagcgatgaggtactctctggtgaaaatgcatgggattgcccacgctgtggccccacggcgtctgtgtctacatctgtgtctgcattagagaatgagccatccattgttaagagtaaaaagaaaaaaagtcggttttttacattacatacaggaaccaagcgtcgtcatctcgacttttttggagacggtattactgagggccataatagcaataataataatacgacaatctttgaacgagaaaggtccagatcacccttcaggatgttgggtggtagtgggaagaggtccagttccagtacaccgttcagtactggtggtaatgatagtaacaactcgagtgattacaagaacaaaaaattgacaacagtgaaaacgataaattttgtaactttaccaaaaatcttagtcatccatttatcgagattttattacgatttgaccaagaaaaataacaccgtcgtaacatatccattgatactaaacattatattgaaaaacaatgacactatgaaatataagctatttggagtggttaaccatacaggcacattaatcagtggccattacacgtcactggtgaataaagaccttgaacacaatgtgaatattgggcgttctaaatggtactatttcgacgatgaggttgtcaaggcagataggaaacatggatctgataaaaacttgaaaatttcaagtagcgatgtctacgtattgttttatgaaagggtttatgactagcaaaattttgcatttttttttttgcaccataaatatgtattgcgtatgcaccaggacgttgaagaatattatttagtgtttctatattttatgataaaactagagataaaggggataattaaaacgatattaaaacggaagtctacacaatgattatatagattatattatgtattggaaatagaatataaacactaggaaggtcataatttgaagatcaattgtagtagtagagtctattacctctttttttttttttcttcatatatttttgtagtttttttagtttactttaactcttccattaaggaaaataggtaataatagcgatttcattgccattaccaccattattattattgttattactatcattattattattatcatcattaccattattattactcttgtgaatgttatctttgtcacccttaactatcatgatcgatttagacaccaaacgtcttgatgaagttcacagttttttcaagttcccactgcctctttttctccgaccaattgaactcatcacccataactttgacggtggcatgcacggcattcaaagcttccttggcgtccaagaaggcgaatcttgttcttcttaaaaggaagtccaagggagttctacaatattcgtactgcatggaatactttaactcaccgattgtgaatggatatctgaaagtatcaaaattgaccaagttgttctcctcgctagagtagattacgttattttccttgtcggctaaggacaaaggcagtttattttccatggattctttgaaaaattcgcaaatgatagaggaacgggttccgtagttttgaaccaagtagttggacatttttgatgataaatggtagttttgagccaataaagccacatagttttgcgtccattcttctgcaccagcaagcttaatatctcttgtgtgacaaggtttcaggttgtggaatccgccaacttcgacaactttgtcgactgtttcctcagccatttgtctgtaagtagtccatttaccacctgcaatagtaattaggccattatccgaagtgaacaagaagtgggatcttaccacgccctgagtggcagagcccttcttcccgtctgcggggattgtacgtggatctctgaccaaaggtctgacaccagcccatgcacttagcacgtcttctcttttcacggggaattcgatatagtgctgtagttctttcaagatatcttgaatatcagcctctgtaggcatagggttttctgggacttgctttagtgggatgtctgtggtgccggcaaggactttgccctgccaaggtaaaaagaacatcactctgccatcagaggttctgacgtccaacaaacccatatccttcgggcagtaaaaagagggcaatacgatgtgaacgccaatagatgggatgaccattttcgggtccatgacggcgatttgattgaaagtcgacttgatcttggagttgtcgtttagcggggagtccggcagaccggatgggttgcggtccatttgcaaaatggcgtcactgtatgggcccgtggcattgaccacacatttagcgttgattctgacaagctcattagtctcaacgtcccgggcctcggcaccgataaccttaccagaagttgggtctttgatcaatttttgtacctcgacatagttcaagacggtagcgccgttctccacagccgtgatggctaaagtggcgttcaaacgcgagtcgttaaaggacccatcatggtacacaagcgaggcctttaaattgtctgtggtaagcatgggagccttctccacggtggcggatttggacagtaggtatgattttttcaagttttgggaaccggcaaagaaatcgtagaatttacagcccatatagatgtacgggacctgccaggtgctgtagatggggatcagaattggtagcaccgtgcacaggtgaggggcagtgttgataagatgtttacgctcgttgagtgcctcgatgaccagatccagttgtgccttggagaactcccagaaggccttctctaagtaccgcaccccaccgtgaatcatcttggtagatttggacgacgttcccgaggcaaaatcccccttttcaacaagggccacattgagtcccctggtcgcagcatctagggcacatcctgtccccgtggccccgccaccgatgatcaacacgtcgaattgatgcgtcttggccagacggtccagcaggtctcgtctagagacctgcggtggagcggcggtggggaattgcaccatgtagctcgggtcattgtgcactaacggcctatcaccttggctagtcatccagtacagcgtccccgtggctgtggccatggcagcagctgcaccggcagctcttcttctcgttaccgaaaacatatattagtacgtatttagtcttgtagcagtgatggcaatagcacggtcaagataagggagggagagtccttgctttagaccaaagttccctatttgtggctgttctcttttaagtttaaatacgatttttagcgtgcggggttgtgaaatttcccctgccaaaactgaaataaagttgggtggataacgtatcggagcagagaaaagacataaggtctgttgctgtatataagtatgtgttgctaaaaaggaattagtgcagtgattattggtcactcgctgatgcccttgcgcttggcacgtttcagcttctttctaaccgcgaggatgggcacagagcagacgaagttctgcagagtggacaggatgaccgagagggagcagcacagggcgactggcttgaggccgtggatcatctcgttgaggaggtgttttgggtacggatgggtcaaggagaggacgacgacgtcgaggtcgtcgagcacgcccgcgacgcagtcaaacaggtgcatgacgtgctttctgattctggcaacgttggcgaacatctgggagtcgtccgtgggcttcgagggctcccagtggacaatgtagacggtgtctccctggttgacagctgcgcccatgagataggtcagggcgtaggtggactcgctgctcaggtccgtgtagaggatgaaggacctttggttcccggcctctgcgccggcacccttggtgagtagttgcatggctctgacgtagcctccgtcgagttgctccagagacacgtcttcgttttcgtggccacggatgctgatctcgtacttggctatccagggcttgctggagtctagcacttcgtttatgctggtacaaaagttgggtaacactttcatgcccagatcgtagtggaactcctcgtcaatctctaaatcgttctctatatcgctcacttgctcttcatcggactcttcctcgtccatatcgtcgccgtcgccgtcgtcgtcatcttcgtcgttgccctcaccttcctcttcagaatccacatccacgaccctcaaccgcatcgaggggtcctgcctcaacacggtccacttgaggaactcttcctcccttactctgctgcggctactggccctgcttctcgaccgcgacagactgctcacgtttgagtctcgttcgcctcttttcttcttgctacgacctctttccctgtggcccctttccatctgctccgagtcgaactccaccgtggtgggcgtttccgttttgatgctgtgtagattcgattgtgttccgtcaggtttagtcagcaatatgctcttctgcattgcgtacttggttgtttctcttgttggttcttttggtactcaccctttccatagtctcttgtgtttgatcaagccttttttccggacctttaaagctttcttaaaaagataaaataggaagaaagtgcaaagtgcaaaagaacgcacatatgaacaagcattaaacgagcaaagaaatgtctctggatcgtgtagattggccgcacgccaccttctctacgccggtgaagcgtatcttcgatacgcagacaacgctggacttccaatcgtcactagccattcacagaatcaagtatcatcttcacaagtacactacgttgatatcgcactgttctgaccccgacccgcacgctactgcgtcgtcgatcgccatggttaacgggctgatgggagtgttggacaagctggcacacctgatcgacgagacaccgcctcttccaggtcctagaaggtatggtaacctagcatgccgcgagtggcatcacaagctggatgaacgtttgcctcagtggctgcaggaaatgcttccctcggaataccatgaggtggtgcctgaattgcagtattacctgggcaacagctttggttcgtcgacaagattggactacggcacgggccacgaactttcgttcatggccacggtcgcagcactggacatgctggggatgtttccgcacatgaggggggcagacgtttttctgctgttcaacaagtactacacgatcatgaggaggctgatcctgacgtatacgctggagcccgctgggtcacatggcgtgtgggggcttgatgaccatttccacttggtgtacatcttgggctcgtctcaatggcagctgcttgatgcgcaagcacccttgcaaccaagagaaatactggataagtctctggtgcgcgagtataaggacaccaacttctactgccaaggcataaactttattaatgaggtgaaaatggggccctttgaagagcattcccccatcctatacgatattgccgtcaccgttccacgctggtccaaagtgtgtaaggggcttctaaaaatgtattctgtagaggttctgaagaagttccccgtggtgcaacatttctggttcggcacaggcttctttccctgggtcaacattcaaaacggcactgatcttccagtctttgaagaaaaggaggaagagagtatagaacaggctaacgcaggatcgcccggtcgagaacagacttcaacacgattcccaacgtccacgtcaatgcctcccccaggcgttccgccgtcaggtaacaatatcaactatttactaagccatcaaaaccagtcgcaccggaaccagacttctttttcaagagatagactacgtagataatattaattaaacatataaatgtgtatgacaagcattatgacttctattttcgttcttttttacttgcgtctacaatatataagcatataatcagatgaaaaaaggaaaaggaagcggtaatacaaataaacaaagaagtggaaaaagtcgccacagtgtaagcaaatgagtcacaagagaaggggcctggtaatatatcaggatcagaagcagcaacaacaacaccccccggggcagtccctaagctctatatcctggtctccaaccaggcgacctcatcaccctttaaaacaacaaagcaccaacagtttctcagaaatactatcgaaatcaagtgtgcaaccgaacgtgcaacatgacggtaatcatatgcccatttcattgctagttctgaaacaagaacatcataagcagcagcagcagcagcagcagcgccagaatatccgatcacaaaactctacgcctcccctgcgacagttggttcaggagtcgcagtggacgagctccgcaagtaatagttctctaaagaaacaggaaaagcagccgcaaacattctacaacactgactctaaacttgtttctcaactgcatagctccgtgaaggacctggatgccataatccagacgcataaaccaaagtttgacacaattattcgcgatttctctcaagcaaccatactgtcctcaaacgagttactcatcaaacttccgaaggaccaaacaataatattgcatagcagagcgccaaaaattaacgcagaatggctacagaacaaggttaatgaccctagtgcctcgttagtgatcgattcaagatcttttctaaccttgtgtaacaatataaaatggtacctgcattggaaatttatatgaaaagtaattgtagaatggagtgttcaaaaaaaaaaaaaaaatgcacagaaatatatatgtgatcatatatatgtatatatacatattagttggtacataatccactattaataccaagcttgctacctaacgaaaataaatactttgtattgcacgtttttatcattctgtccttcgctttttggttcatattatcatcatccgttaccagcactgcaaactccttgcctttgttcttgttttcatcagtcaatctttcagcttgaaacctttggttcagtttggcgatagcatcaataacaaattcatcgacgtgcgtcttccaagtaatttgctcttcgaactccagattttcttcaacatgtgttgcaatattccccgtgaatctcataggaataattttcttttcatcgtacaactggcgaatagtaattaccgaccttgttgctgcttcgacgacagtatcgtctttcgatcctcttagataacgtagttcttgaaatgtggtcagacaaatcgcaaatttaagagtattgtttttggctagtttgaaaatatgtgcaaagtgtcttaaccatgaggtagcatcgatgacaaaataaagcgtacaattgtagttttcgtcactgcctttagatgcggcggcaattttatcgaagaatattttctcccaatgcaggctcaagttgttgttggcaacatcgtatatagattcgccgcttacatccagtgttacaccattaccaacattggaccattggctgtagataaatgcactgttgaacccgccgtttttatcaaaacaatgataatctggtgccaatctcgtataaccagtatattcgaaaatactttcaccagaaacgacgctcaaattcggtgtggcttgtgggtccatgttaacagcctcgatttcttcatttatttcaattgtgtcatatagatcatctaattcgttgttgtcgttataattatcttcgtcatatgcatctagcttaaaggtcaaattctttaggaaataatctggaggtatgtcatttcgacgacaaaacacagaagcttgaaagcttactttcaaccccaaatcgggaaatttcttggcaatacctttcaaaagtaaaactgctctcacactgcgcatccagaatttttcaccaacttcatctttttcatcaaagactataccatcaaggggagaatcgaaaaaaagatggtcttgaacgccaggaatttccattacatcgcacttcttgatagcgtcaaaccacaatgttccccaacatttccaaatctccggaagattttcattttcgttataatattcgatcaaatcatccagttccaatgaataaaacttttccaattcttttttcaaaaaagggtgtaaattatccagcatgtaacaaactaatacattacctaaggtcactattgaattccaaggcattgtccttcttaaaaaatgtatccagaatgctactacttgctttgaatttaccatttctaattttttcaaaatagcaactataaaatgtaaccacgtcaaaaagtgcggtaaggcaaccactaatggtgcatgaagaaattttgttaatacatgtatactgcattgtattgacgtcatgttgatatgattcaaagaatccagccaaatattgagattggttgggatatcattgaaacttgaatttaaagcatcgatattctggaagtagctttctgaacttatttgaacatcgaatggatctgtataggaagatgtttctgttgcttcggatctctttttttctcttttatccttctttaatttcaaatacttaggcaactgaaacaataatgcaaatgggtttttaggattgccaaatccgattagctgtaaaagctgagattcagcaaatgcaggggcatgcctaaaataataacgcaatgattctggattttggcaaaacatgtcttttgtatcgaaaacgtcatttccgttaaaatctttaccaaacttgtctttgaagtacataagcacaacatgctgtaaatccatattctccaggaaactaggtaatagcattacttcagtatgctttaaataatcaattaattgagaatttctatgggcaatttcattattgttcgcactaccagaacttctatctatgaatgcagattgatagatattttcaatcaataactgtaacgtttgctgagacggagtgaagggatcctgacaaaaaacactttttcccaagtttacgaacgcttctaaactgttctgttgaactgtggcaatatgataatatagttttccgcacccatatatgtatttcattgattcggtataccaatattcggcgcttagcctccaatctatgaatcctgatgggtacagcgatattgccattctagacaaatcacccaatctttgtctccacaaaatagaatatttcaacggtatatcctcaagcatatttgagacagagatgaaagcgtatataataaactgacaacatacctctgggtccataaagttcgaaaagttctttagtacatccaagaaggttattataccataaacccacaatcttttttctattctgtaaatatccaaaatttcttggcccataatcaagtcgtttataggttgtgtagttaataatgcagtgatgatgaaattgatgtaatttttgatcagttctgtgttcagtctgtatattgcccacaaactttttagttctgtggtttgagaggtggttaaataaaggcatctttgttgtaactcggtttcctgcaccactatgattttataaatttcctgcagttttttaataaacgtctgatttggctgcgccgaaggaagttgccttatcatcggcgggggtgaagcagcaactacaggagctcttctaatatcggataaagttacttggctttggggttgcgaattgctataaataccatttgaagcgactaatggctcgtcagctctcatttgtggatttgcgttatcttcataagtgtctctagaaacaaccttcatatttcgagcaagcatagttctattcacataatatggagatttaggaacatccattgttggaatagaactggtcttaacttgtggtgtcgattccataactttgcgagagatgctcggtcttctagatgcatcatcagttttggagggtgtgttttgtgcagagatctggctattagttattccatctataaatcctttccctacgggatctacaattccaggcacccttcttttagcgaacgacgactctggtgtatcattgtgcgacgaagaactatgtcgcttttgatgaagaaatgcggcggaggtcgggcgcatatcgctcacaatatgagtgtggttgttgttggatctagaataatcagtttcattactagggtcatcattcgccggcaccattaggtcaaccatattatgcgatatccgtggtcttgttgttatgtattgaacctaaaaataacgttagatgctgccaaagatcggccaaaaacgactgtaaagtgaagtaaagagtacagaatgaaggatgcgcccaagagggagatgttttcggagcgttttgtgtctcacaagatgttctcttctgttctttctcactttaaggattgattccctatattgcaaccaaaatcactcaatttttcatcataatttttcaatcattacccgcgccattgtccatcaaaagtaataccattttggggccctgaaaagcacaccaatacttatttatattatctcaagatcgctggcactaccgtcagaagtttctttagtttccttggatccgaaatgtttttgccaaacttcttcgcgatggcttcttttcttgaaccattcgttctttgaaggtgcgagaatgactttttccttcttgtaatgcaagagatcgtttataacagttttttttttaccgagtaagttgttcttaggttcgctccctgatacagaagacttgagtacttgggaaatttttccatgagtgggatcgaatcctaggcgttggataagccctgtctggagggcactttctgtggttcgtttcattttctgtcgctctccgacgctcttatcttctaatccgctggattccctccttctcataattttgcctagttcgcggctcagtgctgtcgatttcttagtttctattattttccttcttttattgtctaagtttgccagcatatctggattctgaaatttctcgtcgaaaaatgctttggcagaattactattcgtaaaattgtgagagctctttttaagtctttcctcctcttctgacaggcgcttacgagtacctttgattatattaaacccgttttcccctttggccttatataggcttggttgagagtccactttcgtaggcgcgcccaaggcgtacccaccatttaattcaattcttttagcacttgttccacgaaattgcacttctctatggtaatcgcaacacttatgaagagatatgttaatgggagagccacattttttgtgagtctttttattcactatgggacaccaacctaaatctctacttgaacctatctccaggatacatttgaagtcatgactaattcgaaggttgaaggatttgataaaatttcctcgccctgagggtctccatggtagtacttctgggtttaatattgctatcacatcacccaggcgaagattataatatctttctacaccctttttcccgaagatataaacatctagtgtatgctgaaagtccgttatggtgaacatgaagaatttgactggcttttcagatgatgtaaatttgatgtccgatttgtggctaatgaggcctacggtggcccagttggcgtattcaggctcttgaaatttaggtgggcgaattttagcaaaaagtttgcccaaccgaaggattttgatctcatgcaaagcccgttttaagtcatcttcaggtatgtacctctttttaacccaaagatttgaaaagctttctaattcgtttgtgattatcggcacatatttcttctcatcggtactgaacgtatgtactcttgcattcatcatgctttcaaacttggcaatttgtttatcttcgttcttctttgcgttttgaaatttctccataaagtatgtggttgtactagctggtggttttggttgctgctgtaattgagataaccttacttcattaatattcgaaccttcgaattttgtgccttgttgtgtagcattatgagaccccactttcacacggtttttggtaggagattgaggtacctcgatggcttcaaaattaggatcctggggtttcttaaattcttgctttctttttaatcgttccactaaggcctgcctctttcgttccataaattcaagttctctcgcgatggcttgctcatcctcttcatcagaagtaatattattgtacggatcaaccgctaaaatttcacgaggatcattcatttctccacgaaccaagtgcttaatgtgcgttgaaaatgtgaggttgaattgacaaacttacgttcctttatcttcgatggcctataaagttgatatttcttagtggtgttagaaaaggtgggtttgcgcatccaagaaacccgcgtgaaaaaaaatggcaaataaacccaaaatttgttcatacttaactactagtacggatgtgtcataaatcactttatgtcctctgtaatgacattagtgacatttaaaatatgtagatgtttcatatttatataattacattgtttaatattacatcactcgttggaagcttgatcatttgctggactctctttaacctttttggtgtctggatcagaagatgtaccgctctcaattggccgtttagatgtacttccaatttctgttatttttgctccatcggtgctattgttagttagatcggttacgttggaaaagttaatcgccgctttgactgcaacttcaggttgaatattgagtgtacgtaggggggcattcgtattgatattagattgggatgctgtgaatgggttctgaaaactttgaagagatgatgtattagaggagaagaatggcttaccaaaactaaaggttggaatggccttgttaccagcagcgctactatccacgatattattttctttatttgtaaccattgactggctgtcattgaaggaaacgtcattcttcacattcttcaattgttcttgaggtttaaggtttttttgatttataaagccagcgacagccgacggcctctcagaattccccttcgatggactgttccataattcttcttcggcatcttccccgctacctttgttatcaagaaacgttaagcttcccgcgttttctttcaatttctttcgaaattcttcttctaattcttctttacgcttactaatgatcttttgtatcctttcctcgcttggtaaccttattcttttctttaaattctcttctgcttccttaattctccttaacgtttcatcttcatattcctttagccattcctttttcaatgtttcgatatctttactgtattctgcttctgagcttgtactcttatttaaggtctcttgtaattttttttcaaattccttcgttctttcgtcaataattctgtccttttctttctccatgttaactttcaatttctcaaatgcatcagatgagctattcgcagttttgaaaatttgtaactcctttttgagtgattcaatttcctccattaatgtccgataagtgtccttttcgtgatctctcgagacgtcttctgattggagttcatgtgctttgagcttcgtatctagatcaataactttagcgttttcaaagtgtagatcttgttctaatttgtctttaattgcttttaattcgttgagttcgttagttaaagcagcttgttgtttcttagatgcgtccaatttttcatgagcctgcttctttagcctattgaatttattttccaagtcagcgtttgcgttctcagcgcttgaaagttttcccttcaaatcactaatctcattagttagcttttcaatgtcttttttttgggcatctttttgttgttgagataagtcctggtacctctgtttacattgctccatttcactttcatatactaaaattttgttagaatttatcgaaacttgttcttttgtttgtatgagatcacgctgtaatcgagaaatttcttcttgcctatcatttaattgtttataaatttccctgtttttttcggttacgtttttgagactcttttgtaagatggcattattctcttttaaaatgttaacttgagtaacttctttcgtgatatccttgaattcgtcaataataactgcagagcattggtattccttctccgataaagtctgggttcgttgcaggtcatttatcgttttttctaaactatcgttcttttgtttaacgaatgccaattctctcttacaggtggttaacttcgtctctaaagaatttctttcatgacgtaagtttgaaaacaaagaaactagcttcaaatgatctttatcgccattatttgctgctgtgtcatcaaccttttcaatcaataccgaattttcaacacgcaaggattccgtctgttcaatattagatatcaattctctttcataatcagccttttcctccatccatttcctttcatgtttatcgagtaaatcctgagcgctatacaatgaggatttggtttttgttaattctgcttggcaatcagccgcatccttttcaaggcggataaccaattcagatagatctttattttccttcattgtggactgatattgggacatttctttttttttgcacagttggacaatcgtactcattttttcaattttttctatcattttttggatcctttctacctcattcctcaacttttctgattgttgaacgaaatgcaatgcaccttcttttagtttcggttgcaaagctcttatttcaccgagctctccgcgtaaacgagatagatcttcttccctcgcccatttttccttcttctctagttcaatcttagcatcgtaattttctttggtttttgctagttcatttttcaattctattagcgcattttcattcgatgatataatttcttcataagcctgtatctgtgagtttgcatccttcaattgaacttggatttgctctaattcttttctcaaagtcggttctaacgtgcttgcatcactattttgatccaagaatttatattggaatttggtttttcttagttccttatccaggttctctatttctgatgaaagtttttcaatcgttgtttccttatttgataattcagttagtaaggacttcattttcatttctgtatcatcgatggtattttgagcccatttgagttgcgaatccttgcatgagcgtatcgattctatttcttgtatctttgattgtaagtcggaacgtaatctttccaaattgttttccaattctttgattttggctttgtattggccctctttcgagctaaaatccattttattttcattatgactgatttcagactcctttagtctcatctgcaattcttttttttctttgcagcattgttcgaaatctctagttaaagattctttcgtgggtataaagctggcagtttcctttttcagtttggaaatctcgtactccaaagatttgattttgatcctagactgtgacagttcagttgaggctctttctttctcaacatgtatgtatgatggaacccatgatttttgtttctcgagttcagcttttaggtggtctattgcttcctctaacatacgttctttttcctttgccaaacccttgaaattttcaaaatcctctaaagttgttttttttttgcattgtgatttcttataaattaacaactcttttcttaaattctgaataatagcagagttttcgacttttgtagatgaaagttctgcctcaagttctctaatcttcttttcacgggctgcttccatagaagtgacagaatttgtgttggccttgttttcttcagttgatgccagcaatttgtaagaatcccgctctcttaataggatatttatccgggtttccatcttcgcattgatgttctccagttcaattattgcatcttttgcttctttaatggtctggttttctaccttttgtaaggtcttgtcttgttttccttcataattttctaatttatcagccaaaatccgaatgcaattcaagagttcaacatttttttcttgtagctcattcacattactgaattcaaccagtctttccgtaatgatggcttgggaatcattttcatttacgatattgctcgactccagtatttttcttaatgatatcagttcatcttgcgataacggcgatgccgtttcctgtatcgcagatgtatttaaaagaagtagtttaacttgacgggccaaatccaaacgttgtttcaccagagaatgaatatttgcttcacagccatttatcttctgtctcagtgaagttatttctctttcttgcttacgcttagtcaaagaaacagtttctagtagttctgtggaacgttttagttcatgttccaatgattttgttctttccttaaaagagatcagttcaggggttttatgctctaattctagtataaaatcctccagttgattctgtaattgaaatttctgattcctttcctttatcaattgtcttttcagcactttgatatcagaaaatagtttacctactgtgggagaaactgcactcgtagtcattgtagcttcttcttccttggtacaatccataactatattctgtaacctttgacactcattttttgatttttcgagtcttaattttgtgtctataagttcgtctatcacatcagtatgttcagggttcctgcaggaattatcatcatttttctctattgctctcaaggaacaatctttttccaatgatgttagttgtgagcgtagcaaatcgttcatatttttttgtaaagtcatttctttggagaattctgctttttccacacttgcggtatctttcaaatttttcatttccagtactttctcttccaccgactgggataattgtttattttgatttagtaaaaacttattgtacgtaaagacagattcatagttggattgcatttggtatagtttttcttcgaggttctctacgtgcgatgattttgtgacttcttctgttagcgtttttttgctaaaagatgataatttttcttcaattaattttttactttgtaacattaattctttttcctgtactgaggtatcgtactttaactgtaatgatatagcattggacttgcacctttgtagtatattttccatttccatcagctttcttcgaagaagcttattttctttgttcaaatcatcatttaaagaatcattcccctgatctctactctgccaaatgtcatattcttctttaactcgtttttcgtcatttacttctctcatagcttcatggctcacatgcaattgtttttttagtgcatctatttcccgcctatatctggaacgttcttcattcagctgatctttcaagccattcaattcttctttagctgtgttcttctgctcagaagattcatctagtagctgcttaagttttgaaatccttgaatagtactgcgatttgatctcatcgaccaaaacattgagttttgtcacttcctcttcagaacgttcaaacttggctattttcttgtataactttcttaagacaggataggtaacaccttgaagtgattcgaatggaacatttaaaaactcagatattttgtcctccattgccggtttgcttccgcccagtgttctttcgccttaaatttcttttggtaaacttccactagaaaaagaaaagccaccagagaaataagcgcttgcaatttaacgccgatattgttttcttcttctattatcttcaattatcgatcaactctatccaacaattctataatatccactgttcattaacgaatattggtctttttcccttatggtgaagtaaattttccatgcaatatccgggtaagctatcgacaagtttattgactgcaatttgagtttattacatccgtacattactaagatgtatggtttttctatttttgtgctccgtgtcgatatttcgtggagcaaaccagaaaagatgcggaacctcttagcactccgcctggacataggcggagcatattcctcctatgggatgggttttgttgtactcttttctctctagacaggacctccgattgcctccctgagggtgagatggtttccggcctcaggacggccttctccagtttctagcgaggcatacattccaaccaaaggtgtatcaagaatatctgaaattaaaggtagttgaatctctatttgttgttgttattaccgcttattatcccatagttgagacgaccaagattcaaacatgcaaatgtatgcaccatatccattctaaacatagtttttcgaacgttcagagcttaaagggacaattattttagaaactgaatttttacccagtggaataacatcgtatctgtaaagtctacaaaattttttatccatcaaaaattaaaacaaagaaaactgccaaactgaatatgaggaactttcctctctaggaatgacttagtgaatgtacagtgacttgtggaaaatatgattagattttgagcgggtgatgcgacttaacagtctcattgcctaagaaatatccaaatttgtggttcatgctctcccccaagatatgacgatgagagctcgtttaaaattttgtcttcttccgaacagttatgaaaaaactattacgtgtttttatgatatccttactaacttgtcatttttttataaaattatttttttaacagttttgtcaagactttgactggtaagaccatcactttggaagttgaatcttctgacactattgacaatgtcaagtcaaagattcaagacaaggaaggtatcccacctgaccaacaaagattgatctttgctggtaagcaattggaagacggtagaaccttgtctgactacaacattcaaaaagaatccactttgcacttagtcttgagattgagaggtggtatcattgaaccatctttgaaagctttggcttccaagtacaactgtgacaaatctgtttgccgtaagtgttatgctagattgccaccaagagctaccaactgtagaaagagaaagtgtggtcacaccaaccaattgcgtccaaagaagaagttaaaatgatctgtttcgcccaatcaatctatacatttatttactgtatactttaatgtacatcttcttttatcatacctactgttaaaatcataatattaattcatacaatatacttaagaaaacaatatacttttcttagtttcataactttggaatctataatgttgtttttttttttttaagtatatttgtatattatgcatataagtcaacgcgtagcggtggtattacgcgcaagcttttgatttctcttactattcttggttgttcatttgttatttttctttccctgatatgctgcacaaaactcagtaagaatagttttcaattttggtcttttgattggtttcgataaaaatccgttcattcctgattccaaacattctttaatgttgctatcgtcagcaaaagcggttagagcgacaataggtgaggtataacctaaatcgcgccttatcatcttggtagaaagtaaaccatccactttaggcatctggacatccatgaaaatcatattataattttcgcccttagatgtcaattctttaactttgtcgaatgcttcttggccatcgcaagccagttcaatattttcaatgccctccaagttcaacattcttttgataacttcctgatttacatgattatcttctacaaccaaaattttgacacttgtttcatttttatcgtcgtctttgactgtggggatgtttctacttgatgtggctgtaccagtactttgcaaaaatggtctatcaagattgacagaacctagaccttcatgtcgagaacgatgcttagaagacaaggaattttgttcgttaacttcagcacctgtaagacatatagaaggtttaatatttttttcctgcagttgttcaagccctccattgtcgtttttttcttctcttcccatgttaggatttccaacatctttcgtctcatgcttacctttacttcttacctccggtagcacgtcgttggttaggctacttctatttgtagctggtgttgcaacagatgatgtggattgtcggctcttgatgcttttagcaacactaaacttgactcttctgttctttctactctcaggattaaattcgtcctcaaaaggaaactccatatctgcaaaactgatctctttagtttgatttaatggcaaggtaaaagtgaatttactaccaacacctactttcgactctaatttcatcgttccatgcatcatatttgctaactgtctacagattgatagacctaagccagtaccaccatattgcctggacaatgtttgatcaccttgaacaaatggatgaaatacagattcttgtaaggaagggtcaataccaggcccagtgtcttccacttcaatagaaataacccacgttttggggttttcgataggtcttcctaggttaccaccttcttcatcatctgagccaggtgctttattgaactgactattgaagatagcgttatcatacgagctggtagttgttgatactatagaagatacatcatcattcgaagctttttccctgtcattcactttcttatagatactttcattcgcaacagtatttctttttgttatctcttcctgaattgtcgaagtgtctctattacttcctagggaagtagcgctggattctaaatcgacacttttcctatggttcgataaagttggaagatcgtatttatctgtagtttctaaattttcggttacttctgtcccttttttgatatacacttctttgtattgcttcttctcgcttaattctttgtcgtattcacccaacagtttcattcttacatcaacggtaccatctacaggggtgaactttagtgcattggacactagattcatcacaatttgaataattctgttggaatcaccccaaagaaccattgtccttatcaaattaggaaacaatgatattgaaagacgaacacgctgatcctttgcaactttaccaaatatcgattttatttgtaaggcaacatcggtaatgcaaaaatctcttttctccagtttcgttctttgaagaacgtttttggaaaaagttaacaattccgttagaatatgaagcaaaagctcacctgatctaaaaatgagttttaaactatttcttattttgttaacatcggtttcttccattgaaatagccgtcatacccagaataccatttaaaggcgttctcaattcgtgcgaaatattggcaataaagacggtttttgcttcatttgcggcctctgcctcaatcttggcagcttcgagttgttttgtcctcgccctaactctttcttctagaagagcataatgttggtctaatgcgtctgtcatagtattgaaggtttctgttaaatcggaaagttcatcagaaaatagtcttctataatctggtagcctagcttcagttaaatttgcagaagttgtgagaatgtgagatctattggaacttctgtcagtgtcattatgtctcaaggaatgtggtccaagcaaatcgtgatttagcgagccatccattgatattttagcatcggtgtggttattcggtattttgttctcctcctctggaggtgacattttctcatttccaaggtttatagcgcttttcatgctactatttgctgaaaaagctgcaccactgccatggccactgcctccatggccacttacgcttgtggtgctgccagcttcagcagtattaaattgtaataacgaagaaggaacagcaaatccagaactaaatcctcttttgaatgaactggctctgcttatcgttcttggggtgctcggtcgaaggcctctcccctctgtaattaattcagttgccttttgtagacgtacaattggttgcactgcccagtgtgctagaggaagggttaacaaaatgacaaagacaccaatagcgatgacagtgccggtgatgatttttgctagtttcgttgctggagaaaggaaaaccgactcaggctgtgaaactatcgcgacccaattaactaggttaaacgaacatggtgaatagcctaaagcagtattccgtgtagaaaggatattggtttgtttcaaagaccctcccttcccgtttctaaatgcgctactaatgaatgtatcattttttatagaaaaaactttttgcgggaggtctgatcgtgatccatacggtggaaagacaaaatgataccctgaagctttgccttgactattatatactgcagaaataatggcaattgtggaatgttctaaagcagttgtatcgttgaacacacttttcagaccctctgccgacattattatagtaatgtatccgtaaacccttgaatcagtcaagataatagaaggattggcaaaaataggtaaagacatagacatcaaatagtcggtgctatttagtactggatccgtcaatatacctatagtttccagtgaagaaggtagcggtgtatcggtggataatgggaacaaactgtctaaaacatcttctggaattagatcaccagttccattattcgtagcgttcaaaacagcattaaatgaagaatcgtaaactttagcaacataaaacaagtttgaagagctcaaaaatttttgaatcacactcaaggaatctacccaattatctgcactcttgttacctgcaacgtaacttgttagtgagctttgcagggcgtctcttgatgccaaatagtacgcctggtaatataagtagtttagagtttggtcaatctgtgatgactttaactgagcggcaatgtacagtctatcggaccttaaatttttatagttcgaggtaaaatagacccctgtcgttacagccagaataatcagtgagcccaaagccactatactaactagtgccgttagttgagttcggatgcctatcctaaacggaggagtgagttccaattttgatggcaggccaaatcgcatttgtattgttaaatcaaaacaaagtagattatacccaacgtgttcttatttcaattctatgcttattataattggatgatagatctataagatcttctccactgctgttacctgtctttatagaattcgtagtaggaaatggaaaacaacaaacaaggacagaatcaaaactccggacggaatctgctaaaatgtagtgagttggcttttgttcgtgctgttttcgatgaactattaatcccaaatttatgtagtaataatcactaaaaaatgcgaagaggaaatattaacgcgcggcgcaaaaagatcgggtaatttgggcgtttaagtacatgaaggtagaatatttcaaatatgatgtcaaaggcgataatagtaacttctaaatgcattcacatttacagcgatagtttccttgaagtcgtcggaatacgctctatgcgctatggttgatttttaattgtttttttgtgttgagacgcgaaagtaaggaatatataaagaaacttaaatttgctaacagaagaaatattttataagctgtttgtttatgtatttatgaaaccaaacaaaaaattgcctgtataatgaaagaattttcatatttgataagcttctatgtaattaaggaaaggaaccaaacggggaatatagatacgcagtgagagaaacagaagtgatagtaaaaaagtgagtaggaacgtgtatgtttgtgtatattggaaaaaggttacaatagaatataacccagtgccaaaatccgattagattcatcaatggaaaattcagagcttttattaaggttctccaaaaattttaaaggtttagaaagagcatgcaagacaaaagtattcattttgccccaagtctccttgattatggtaagacttttcataatgaatccatcggagtggaagtttatctgaagcgtacccttatcaaaccataaaaactgctcagttgaagaaggagatgcagtggcgggcgtattgattgtgtcgctagaggaatctaaggaaagtaaagaggccaatatggagggccgcaaacttaaagacttaactgtttggtgttcgtatgctgcagtgacaaagtatgtcacacaacatccaaaactaattcctatagtaattgaaatgccccaagtgaaccagctcgtgaagaacttctgcttctttctcttgggttttttattcgatttaggggatttcttttttgagttttcggcttttttgttacgacaataggaccgagactttgtatgtatagcttcgtcatcattatcttcctcattcacatcttctccgtattccaaggataaatcttgtaatctttgaaacatttttttcaaatctcttttgttggtcacaacaactggaggaaacaataatttaacaagtttattccttaagaatgacttcaggacgtttttcacttggatgacttgcccaggctggcagatcggtattacaggcttgccttgagaatattgaacgatcctgtttagcagagataccatctctctcagctcctgaaaaattatgacaatccccgtatattgcgggaatgttgcggaatcgtgatatttgggtaattcaaaaagagattggtattcttttggtattgattgataaaagctggaaccagtccttcccagtattagaaggcgaaaaactggattcttttgtgttagtgatagtttgggcataacaaaagagtttgtcgaagaagtcaagctttttgttatcgtcacactatcttcctcaaaagcctcatcttcatcaccatcatcatcttgctcgttaaaaggagttttttccttaccaggcaagggcagcgatattatcttctgtaactgtttaaagggatgagacggtgaaacgacatttgctccttcttgtccttgtttaataatatttattatatcagcagcaggcgcttgaagcagctcttgttcttcttcagaagtatcactagatgatagaatacttccattagtcgtttgagaagagcacctttctgggatgaaagaagcgcccaagtccaaaggctgaatggcttgccacgatcctgatatactatcgtttacattgtggttgccggatatgtcaatggacgtaaccaagttctgtcccattggcgaaggcgaatgccctgtcttactcaacaattccaatactgatagatgagggtcaagtaagcctttgtcttccccagtttgtgcttcagagcatgtgtgaatagtcgttgacgaggaatcaggtggcatgcttttagatgaggatcctttaccttccctttgttggtattccaaaaccatatgtttactgttcctggcagattttttttgcttttgtgattaggacttcaatattgcttatcgataagagaagtcacaactgataagaaaaattgtcaaaaacgagaaatgggctttgtaagaaaatatttcaacaataacccaaaaatatagattttaaaagtataatgattatgcctcaggaagcttactgcaccttatttcctaaataacttttttattacttaatagatctgtttcttttttttttttttgtaaaaggggtgcgtcaaacaatagatatatgctctagacagacggtgatctaagatatttgagaaagcacgaaacaagtgccaaacaacttcaactttgctgaagtagtataaactttgcttttactatgcaaactgtgaaagacgatttgtcctttccatatttgtgttttgagcgatggggatgtcgtcccttcagccgtctaaaaaaaaagtcatcaagcgtgaaatctatcatcccgttgttggtttaaaagaatatcgtgcatactgtataagagtggtatatactgcaacacagacacgggaaggcccaatcacctagtttaaataacgatgttatctattagtctgacgaccgtatcgggtttttcgcggtcagtcacgtatacagcacaactaatgactattggctgctgttcgctggtgttttcaacatcggagagttcatcaagagtcttaaaatctgctaaggaaacatagtcgattttgaaatcgtgggaatcaacgtagggtgcccatatttgagtcacagtatcgatgatttctgatctggagagacgtccccctggtgctagtctcctaatagcattttccgcagctttcagcccgcggtaaaggttttcagagatctttaaagactctggacaaagatatttgtttctactactcagagccagtccattattgtttcttacaataggcatcatttgtagccttgtattaacaaacagttcgtccaccatacactgtaaaacaatgaactgttgaatgtccttctgcccaaaataagccacatccgccataacgatattgaatagtttagtcacgacagttgccacgcccctaaagaagttaggtctcgtcttcccctctaatttttcactcaatccaagaacactaacaaaagggcctttctgctcttctatgtcgagcggaattccctgtggatacatcacgtgtgcattaggagcaaatagaacatccaccttcaacgactcaagcaatttgatgtcgtctggcaaagttcgaggatagttatctagatcttccgttggcgcaaactgggagggatttacaaatatactgaccacagtataggtgttttccttcacagactgcgagatcaaactagcgtgacccgaatgcaggcaacccattgtgggaacgaacccaatagtttctctaaatctagtttccctcagctcctgtgttctccattgaacaacttcttcgacagtatggaagattttcatcaattctatatggatatgcagtataaaaacttgtataaaacagtgcagtatcaacacacaccacttcttgtacacataaatatgtacgctacatcgagaaatgttcattaatctcttgttggaaaatatgacaaaagaaaaaaactcgttaaagtaacatttacccggatatctgttcagccaacattataaaaaagatgggcgcttaatttccactcttacagatatcactccttctaattaacttacatcagtaagaaagtaaaaagagcaacaattcgccacaagaaggtctctgtagggtcaatagtagcagggctcttgtcagggaaagactgtgaatgcaaaggaaagacggttggaggtccgaaaagcattactgatgttaggattgaagagaaattcaccgtactatgtgccagatggttataactgaacattgaaataatatcgtgattatgggctggttgagagccccgttaagtattgttaaagatgtaagcagtctattgcgattagcggttaaaataccatttcaagggttacccatactgaaagtgccaaaagaaaaaaagataacgtatggaatgatatagtcacaaaactaatatttcctaaaataaacaaacaacaccaaaaatggtagaaataattggaatacattcacaggagaggtagaatcgtccctgtaaaaaaaattgaaacggaacaagaaaaataactgacgttcctttctttaaacgttagggtgtactataatatattccataagagatacccgtttctataaatgcaaagctcaacaagtactgatcaacatgtgctacatcacatggaccctcatcggtttacgtcccaaataccaactgcaacatcgtcacaattgaggagaagaaacagcacgaatcaaggtctaaccgacatgatcaataagagtattgccaggaatacaataagcgggactggcattcccacaggaggcataaataaaaataagaggacaagaagcacggttgcaggaggtacaaatggtacagcattggctctaaatgacaaatccaacagtagaaacagcgtcagcagattatcaataaatcaacttggcagcctgcagcaacatctgagcaatagagatccaaggccactaagagacaaaaacttccaaagcgctattcaagaggagatttatgactatttgaaaaagaataaatttgatattgaaacaaatcatcccatttcaataaaatttctaaaacaacccactcaaaaggggtttattatcattttcaagtggttatatttaagactcgatccaggttacggctttactaagtctatcgagaatgagatctatcaaattttaaaaaatctgcgttatccgtttttagagtcaataaataaatcacaaatttcggctgtaggtggctctaattggcacaaatttcttggcatgttgcattggatggtacgaacaaatattaaactggatatgtgcttgaataaagtagatcgttcattaattaatcaaaatacacaagaaataacaattctgagccagcctttaaagactttggacgaacaggaccaaagacaagaaagatatgagctaatggtggagaaactgttaattgattattttacagagtcttacaaaagctttttgaaacttgaggataattatgagccttcgatgcaagaactaaagttaggttttgaaaaattcgttcacataattaatactgatatagctaatctacaaacccaaaatgacaatctttatgagaaatatcaagaagtaatgaaaataagccaaaagatcaaaaccaccagggaaaaatggaaggctttgaaaagcgattctaataagtatgaaaattatgtcaacgcgatgaagcaaaagagtcaagaatggccaggtaaactggaaaagatgaaatccgagtgtgaactgaaagaagaagaaattaaagccttacaaagtaatatttccgaattgcacaaaattttaagaaaaaagggaatttcaactgagcagttcgaattacaaaaccaagaaagagaaaagctgactagggaacttgataaaataaatatccagtctgataaattgacaagctcaattaaatccagaaagctggaagccgagggaatattcaaaagcttactggatacgttgaggcaatacgattcgtcgatacaaaatttaaccagatcgcgtagtcaattgggtcataatgttaatgattcatctctaaaaattaacatttcagagaacttattagacagagattttcatgaaggtatctcctacgagcaattgtttccaaagggatctggaattaacgagtctattaaaaaatctatcttaaaattaaacgatgaaattcaagaaagaataaaaaccattgagaaagacaacataacattagaaaaagatatcaaaaacttaaagcatgacataaatgagaaaactcaaattaatgaaaaacttgaattggaattgtccgaagcgaattccaaatttgagctctctaagcaggagaacgaacgattattagtagcgcaaagaattgagattgaaaaaatggaaaaaaaaattaatgattcaaatctcttgatgaaaactaaaatttcagatgctgaggaattggtaacttcaacggaactaaaattggaagaattgaaagttgacttaaacaggaaacgatacaaactacaccaacaagtgatacatgttattgatataacaagtaaatttaaaattaatattcaatcgtcattggaaaactctgaaaacgaattaggaaacgtcattgaagagttacgaaatttggagtttgaaactgaacataacgtaacaaattaataaaataaatgatatataatacccgagcaatctacagcaaagctcagccccacctttccgcattttaataacctgcattttgttcaattccaccctcactccccttctcaagtattccaaaccaatttaagtaagtattgatatgtagttatttttaaaataaatatatgtaagtatatttggatgctttaattaggaatgttctattttttttttattttttatattatggaagaaaatggacgtgacgaatcaataaaagaaagaacagcgacgaaagaataagaagacggtgggaacaaaaaggtattatgactgaatagattcaaaataggaaggtgacaatgaaaccaagcctattcacttcttcaaattcttataatacatctttctgattaatggatgatgttccttcagttctttgtttttattggtactgtattccatatatgccatatcttcaccgccagcaagaccagacaatgaaccttcacctctaacggcctttgatttaaatcttttgtggccatttgaacctctcccaacagaattgtcagcgtcatcaccgacctcgataccagcagcttcttcgttcttcaataatacttcttgcaatagctctctacgttctctgggtgaagcatatgccaaatttggaatgttctccattccgtgtaaatgtgtaatgactttgaatgcgtaaccttgatctaccaaaaacgcttgtctctttgttgagtagtacatttcttgcgtatccttagaaaccagagaataaaagaacgcattgaaaccttcgtcattacgtcttttagctcttaaaattcttcctaatctttgggcttcttgacgacgagacccatagtgcgaagatatttgaattaaacaggtagcttctggtaaatcgatggaagtatcaccaacttttgatagaaatatggtattgatttggtcattgtactggaaattttgcagaatgttcatacgctcttgttgtggtgtggaaccataaataaatggttttcccattttcaaagcatattcttgtaaggcgtaaacattatctgaaaaaacgatgatcttatcacccctcctttcgtgatattgaattaagaattggcatgcctgaaactttgttggattcatgatatacagtagcattcttttccttgcagtttctcttaaatactcttggtaaaattctgctgtcatgggacaccaaacctctgcacattggacatttgcaatatgtcctttttgggataattccatccaatttgcttcataaagttttggaccaattaaaaaattcagatcaccaattttatcatcttctctaaccagcgttgcggtcagtcccaatttggcgtgtgctgcgatggtggagaccaccctacggaacattgcggcgggcaccacatgaacttcgtcaagaataatgaacccccattccctaccggtcaagaaatccataactttttgtgaatcatgagacctgtttcttgtgtttgccaccattgaataagtggaaacaaccaaaccggattctgtctggaacatttccttattatcagaggtgaaaacagcacaattttcaggttgtaaggtacaccattgtaaaaattgctgcctccattgcatgacggagactgatgaagtacataaaacaattacggatttttttatagtacatgctgcggtaataccgaccaaagttttacctgcgccacatggcaaaacaataatccctgaacgagcacgcccattaccaaacattttactcagcgatttttcttgatagggtctgatttgagtggaaggtttcaaatcaatatctaaatccgggtttctatggtcgtttctaaagtcgtattcttccaacacgggataatcgatttcttgacatcttttctttacgacttcaacagactcattggcaatttcaaaggagtgaacggcatcaatatcatcatcttcttcttcccgctcattatcaccacctataactgcactaaacacggcttccacatcgttcggattaacattagtagcgggttttccagcggtttgctgaagttgttgctgtagtacatcctctggtggctgtacttgatgatcgctatctattcttaggggcccgatgacggaatcattcagcaacatttgcagaatatctgcttgtgtagtctccacgaaatatctattatgcttaataactagtttcactttaccgtatgaaatggtagcccctttaatgaagttgattatcgattcagcaacgggtactttggataatctatccagaactgaaatgatatcatccgtctccaaccctacagaaacagctgcatacaaagagtatgctgtgatcttgtattcatgaatatgggagggtctacttataggctctgcaatggtgaccagaaagtcctgagcctgttctgctaatggagagaaactctccagaatgatcctaccgtcacttggcgagatccaaaggggcctggaagcatggtctggtcttaaccgcaaataactaaagtcatggcttctgaacattccagagacggaatctggaacgaaatctgctggtatatcgctattagtgtcctgcaaaagcgctttatccttagcgtccatttgattcatagaggaatccgccgctgtatgcctgctactcttggtctttttccgaggcttcttcaaccctgttaccatggcgccggtatccctttctccacgtccttctgacgtttccctgttatcatcatagttctcatcgatctctgcatcagtagctggtgaatcctcatctgatgagaaaaaggactcacccatatctggaaagattttccccttgctcttaggttggtagccttcaacgtccgtcatgatttatcttccactgattccaacgtcagtagatgctacttttactaaataatgtagatatcattactattatctatccttactaaggacctttttccttatacttcttagaagaaaaacctcgtttctaacgatctgaaatttttttctcttcgcggtggcgagtttaaaagacaagagcagagcaataaaaaagaggatgaaaggtggccattaaataggcaagaagagtcagtcgtacaaagctcaaaagattcaggatgagtgtacagatatttggagaccaggttacagaagaaagagcggaaaacgcccgtttgtcggcgtttgtcggtgccattgccgtgggtgatttggtgaaaagcacattaggcccaaaagggatggataaattattgcaaagtgcgtccagtaacacttgcatggtaacaaacgatggtgctacgattctgaagtcaattccgctggataatcccgcagccaaagtgttggtgaacatcagtaaggtgcaggatgacgaagttggagatggtaccactagtgttactgttttgagcgcagagttgcttagagaagcagagaagttgattgatcaatccaaaatccaccctcaaactattattgaaggttaccgactagcttcagcagccgcattggatgcgttaacgaaagcggctgttgacaactctcatgataagaccatgttccgtgaagatctgatccatattgccaagactactttatcttccaaaattttgtctcaggataaggatcacttcgcagaattagcaactaatgctattttgagattgaagggctccactaacttagaacatattcagatcattaagattcttggtggaaagctatcagattcgttccttgacgaaggtttcattcttgccaaaaaatttggtaacaaccaacccaagagaattgaaaatgctaagattctaatcgccaatacaactttggatacagacaaggtcaaaatattcggcaccaaattcaaagtcgattctactgctaaattggcacaactagaaaaggcagaacgtgaaaagatgaagaataaaattgccaagatttccaagtttggtatcaacactttcatcaatagacaactaatttatgactatccagagcaattatttacagatttgggcataaactcaattgagcatgctgattttgaaggtgtagaaaggctcgccctggttacaggcggtgaggtggtgtctacatttgacgagccaagtaaatgcaaactgggagaatgtgacgtgatcgaggaaattatgcttggtgaacagccattcttgaagtttagtggttgcaaagctggtgaagcttgtaccatcgtcctaagaggtgctaccgaccaaacgcttgatgaagctgagagatccctgcatgacgcattgtccgtgttgtcacagaccacaaaggaaacaagaactgttcttggcggcggttgcgccgagatggtcatgtcaaaagctgtggacaccgaagctcaaaacatcgacggaaagaagtcccttgccgtggaggcttttgcccgtgctctgagacaactgccaaccattttggcagataatgctggttttgacagcagcgaacttgtgtccaaactaagatcctccatatacaacggtatctccacctcaggtttagatctcaacaacggaaccattgccgacatgagacagttaggtatcgtcgagagttacaagctaaaacgagcagtagtcagctctgcatctgaagccgctgaagttctactaagggtggataacatcatccgtgcaagaccaagaaccgccaatagacaacatatgtaacatatttaggatatacctcgaaaataataaaccgccacactgtcattattataattagaaacagaacgcaaaaattatccactatataattcaaagacgcgaaaaaaaaagaacaacgcgtcatagaacttttggcaattcgcgtcacaaataaattttggcaacttatgtttcctcttcgagcagtactcgagccctgtctcaagaatgtaataatacccatcgtaggtatggttaaagatagcatctccacaacctcaaagctccttgccgagagtcgccctcctttgtcgagtaattttcacttttcatatgagaacttattttcttattctttactctcacatcctgtagtgattgacactgcaacagccaccatcactagaagaacagaacaattacttaatagaaaaattatatcttcctcgaaacgatttcctgcttccaacatctacgtatatcaagaagcattcacttaccatgacacagcttcagatttcattattgctgacagctactatatcactactccatctagtagtggccacgccctatgaggcatatcctatcggaaaacaataccccccagtggcaagagtcaatgaatcgtttacatttcaaatttccaatgatacctataaatcgtctgtagacaagacagctcaaataacatacaattgcttcgacttaccgagctggctttcgtttgactctagttctagaacgttctcaggtgaaccttcttctgacttactatctgatgcgaacaccacgttgtatttcaatgtaatactcgagggtacggactctgccgacagcacgtctttgaacaatacataccaatttgttgttacaaaccgtccatccatctcgctatcgtcagatttcaatctattggcgttgttaaaaaactatggttatactaacggcaaaaacgctctgaaactagatcctaatgaagtcttcaacgtgacttttgaccgttcaatgttcactaacgaagaatccattgtgtcgtattacggacgttctcagttgtataatgcgccgttacccaattggctgttcttcgattctggcgagttgaagtttactgggacggcaccggtgataaactcggcgattgctccagaaacaagctacagttttgtcatcatcgctacagacattgaaggattttctgccgttgaggtagaattcgaattagtcatcggggctcaccagttaactacctctattcaaaatagtttgataatcaacgttactgacacaggtaacgtttcatatgacttacctctaaactatgtttatctcgatgacgatcctatttcttctgataaattgggttctataaacttattggatgctccagactgggtggcattagataatgctaccatttccgggtctgtcccagatgaattactcggtaagaactccaatcctgccaatttttctgtgtccatttatgatacttatggtgatgtgatttatttcaacttcgaagttgtctccacaacggatttgtttgccattagttctcttcccaatattaacgctacaaggggtgaatggttctcctactattttttgccttctcagtttacagactacgtgaatacaaacgtttcattagagtttactaattcaagccaagaccatgactgggtgaaattccaatcatctaatttaacattagctggagaagtgcccaagaatttcgacaagctttcattaggtttgaaagcgaaccaaggttcacaatctcaagagctatattttaacatcattggcatggattcaaagataactcactcaaaccacagtgcgaatgcaacgtccacaagaagttctcaccactccacctcaacaagttcttacacatcttctacttacactgcaaaaatttcttctacctccgctgctgctacttcttctgctccagcagcgctgccagcagccaataaaacttcatctcacaataaaaaagcagtagcaattgcgtgcggtgttgctatcccattaggcgttatcctagtagctctcatttgcttcctaatattctggagacgcagaagggaaaatccagacgatgaaaacttaccgcatgctattagtggacctgatttgaataatcctgcaaataaaccaaatcaagaaaacgctacacctttgaacaacccctttgatgatgatgcttcctcgtacgatgatacttcaatagcaagaagattggctgctttgaacactttgaaattggataaccactctgccactgaatctgatatttccagcgtggatgaaaagagagattctctatcaggtatgaatacatacaatgatcagttccaatcccaaagtaaagaagaattattagcaaaacccccagtacagcctccagagagcccgttctttgacccacagaataggtcttcttctgtgtatatggatagtgaaccagcagtaaataaatcctggcgatatactggcaacctgtcaccagtctctgatattgtcagagacagttacggatcacaaaaaactgttgatacagaaaaacttttcgatttagaagcaccagagaaggaaaaacgtacgtcaagggatgtcactatgtcttcactggacccttggaacagcaatattagcccttctcccgtaagaaaatcagtaacaccatcaccatataacgtaacgaagcatcgtaaccgccacttacaaaatattcaagactctcaaagcggtaaaaacggaatcactcccacaacaatgtcaacttcatcttctgacgattttgttccggttaaagatggtgaaaatttttgctgggtccatagcatggaaccagacagaagaccaagtaagaaaaggttagtagatttttcaaataagagtaatgtcaatgttggtcaagttaaggacattcacggacgcatcccagaaatgctgtgattatacgcaacgatattttgcttaattttattttcctgttttattttttattagtggtttacagataccctatattttatttagtttttatacttagagacatttaattttaattccattcttcaaatttcatttttgcacttaaaacaaagatccaaaaatgctctcgccctcttcatattgagaatacactccattcaaaattttgtcgtcaccgctgattaatttttcactaaactgatgaataatcaaaggccccacgtcagaaccgactaaagaagtgagttttattttaggaggttgaaaaccattattgtctggtaaattttcatcttcttgacatttaacccagtttgaatccctttcaatttctgctttttcctccaaactatcgaccctcctgtttctgtccaacttatgtcctagttccaattcgatcgcattaataactgcttcaaatgttattgtgtcatcgttgactttaggtaatttctccaaatgcataatcaaactatttaaggaagatcggaattcgtcgaacacttcagtttccgtaatgatctgatcgtctttatccacatgttgtaattcactaaaatctaaaacgtatttttcaatgcataaatcgttctttttattaataatgcagatggaaaatctgtaaacgtgcgttaatttagaaagaacatccagtataagttcttctatatagtcaattaaagcaggatgcctattaatgggaacgaactgcggcaagttgaatgactggtaagtagtgtagtcgaatgactgaggtgggtatacatttctataaaataaaatcaaattaatgtagcattttaagtataccctcagccacttctctacccatctattcataaagctgacgcaacgattactattttttttttcttcttggatctcagtcgtcgcaaaaacgtataccttctttttccgaccttttttttagctttctggaaaagtttatattagttaaacagggtctagtcttagtgtgaaagctagtggtttcgattgactgatattaagaaagtggaaattaaattagtagtgtagacgtatatgcatatgtatttctcgcctgtttatgtttctacgtacttttgatttatagcaaggggaaaagaaatacatactattttttggtaaaggtgaaagcataatgtaaaagctagaataaaatggacgaaataaagagaggcttagttcatcttttttccaaaaagcacccaatgataataactaaaatgaaaaggatttgccatctgtcagcaacatcagttgtgtgagcaataataaaatcatcacctccgttgcctttagcgcgtttgtcgtttgtatcttccgtaattttagtcttatcaatgggaatcataaattttccaatgaattagcaatttcgtccaattctttttgagcttcttcatatttgctttggaattcttcgcacttcttttcccattcatctctttcttcttccaaagcaacgatccttctacccatttgctcagagttcaaatcggcctctttcagtttatccattgcttccttcagtttggcttcactgtcttctagctgttgttctagatcctggtttttcttggtgtagttctcattattagatctcaagttattggagtcttcagccaattgctttgtatcagacaattgactctctaacttctccacttcactgtcgagttgctcgtttttagcggacaaagatttaatctcgttttctttttcagtgttagattgctctaattctttgagctgttctctcagctcctcatatttttcttgccatgactcagattctaattttaagctattcaatttctctttgatcttctccattttgctaattgctattttagatgctttctcaacctcatgagaaaaaaattactagattaatattccttatgtttacattcttttataccaacctattattgttgaatctacaggtttttcgtagtatatgacaataataactcgaattctgctaagagaacatcgtttatagtactattttagaagactactaaatctacgtacgatagtgtgttgaaatacttgtaaaaaatcagaccaaggaggccaagtctcttcttatagtctttctggactcttcatcttgctggacagaggcccagatgtcgtccaaagataacaagctttgacccaacttctctttctccaaattaataaacttttctatcttctgtggctcgtctgctacaaacatttgaaagattatcagggaaatactccttaacgccttgtgtagatgatcccccgtggtggtacctttccttgtagccttccgtgcccattggtcaaaattgcccatataccactcccagatcgtttcacgaacgacttggtcttgaggtttctcgtttttgttcagcctcttcttaaagttgtaattaaatccgaataatgccagttccatcccctctgactcaatattggaagtgataaaattcaaagtttttttcacgatatcagaatctaaacagaatccaagagattctattgcaccgttttgaatcaacatggcggtttcgctactgttttggtcatacatattaatgacatggtttgtgataccagtacaggaactgcgtttcaccaaatcgaatattttcttccactgcttgatgtttgcacaatgttgcgatacgacgacaaggattgagttcactaattctaacggtacgctcgaacgtgggccctgtaatagatgtttaaaataaatttgacacaattcagcacattttgcggagtttttatttaaaaacaagacttgagacatgactttcaactcgtgagggtttgtgcttttatcaaattcaccgtggggccaatcaatcttattgaaaaggggaatgacaatttttttctttaagaaagattgtaatttagagctcgttaaactggcacgatcgatcgtttgcagaacttccaaccccttggaaagaggatcccaatattttgatgcaatctttgtggaaggagaagcgatatggtttagtatcttaaagagaccgtgcaaatgaatagaattctggaaaccctcatctccaataaactgcgacaagtctaagaaaatcttccgaaggtcaatctcggataacgtctcctcagttattttatcattaatcaatgcatagcactcttcggactcatatgaaacgcggtaataaccttgggctaaatggttaattactaagataggataatcgaactttaaggtcctatccgtcaatagtacatttttagtatccattttaccatctggcagaaccccgaataagggtacctgatatgggacatcttctaactgatccttttcttcagtagataattgattgataaatctgtgttgagtcaattttgtttgcgttttcccgtctttctcttctacttcgaccttaacgacaggtaagcctggcgttcttgtccaagatgaaacaaagtttgtaatattttgagacttcaaaaattttccgatatgattccatatatccattggtttgacgcttctcgcatgaaatgttttagtatcttcaaatacactttccaggcccttttgtagatgagattcgcctgtagccaattgcagggacctcagcatgataataccctttgtgtatgcctcaggatcaaaaatatcggaggtttgagaatctatgccagtgttccgttgcgcaatctgaaatatgcttcttccattaacgtcagctgcatctctgcacatggtcggctccacttgctgtagtaaataaggttccgaggtccaataatgggataggtcaccattctgttctagtatgtggcaagctaaccaagtagcgaaagactcattaaaccaaagagattcccacgagtcaaaagatatgtagttgcccatccattgatgaacgagttcgtggacaatgagttgctgtgcttgctctctgacggtttcattggccaaggcatttggtggtatgagcaggtggtttagttggatggtgatcataccaaagttctccattgccatgtcacttaaatatggtagtaggacgaaatctaactttggcagagggtatggacatttaaaataggattccaacaaaggtagatatttctggactgtatctaaagtgaaagctgcattagcaatatcccaaggtgcataaattgaaacgggaatagtcctatcaccttccaacttgatttccgttttcaaaaattctaaatcaccaatagaaaaaccaaatacggaagtagtcatcaaaggtgtcttggcaaatttcaccaaatgtttttgagaactatccaaagcttcgaccatctctacaggagtattggaaacggctttatattgtgcatccgttgcaatgttcaattgaaaagtggacttgtttgaaggctcgtcaatacatgggaaaatattgctagcggaaaacggttggcagtgagtagcaacgacgtgattattggcagtaccggttttacgatccataaaattggttttgaaaataccaaaagtcttatcatgatgtgtttttatgtcacgaattttacccacgtattgcacggacaaaatcagagggcaatcgttggacaattgaataggagattcagagttgaaaatcgacaaatgctttccagtgtcctgagaaatttttagatcaaacttagtagaccctatggtggcatgtgcagacaacacaatcaaatccttggaatgtaacttgaactgggtaaaactgtcttcgatagaagctaaggtggtggagttcggattgaatttcaaatggattatggcggatcctttgaaattgggcgacgactgcttagggtcaatttctagacgcaactcatagtgactaggcaccaccggattctctaaagataacaaattatcagacatgatggttagtgatgatcaacctggcgttatatatcctttacacgtcttcggaccttttttttgtatagcacatccaggaatggtttgactgcaaaactcgtttttcactgaaaaattaccggcgaattgtataatagaaaggatcgatttatactaaagaaaagaaggattaatatacaagactacaaccaagggtggtacctcacttgaagggggttctcaaagtactcgagaattttgatattctgtcctgtgtgtgctgagccgttccagccagtcttgttccagaaatatgttgacaaaattgaagttcgtaaatatatatacatttcatataataattgacaagctgatacatacggtgtgcggacggttacattaatgcaggaatctataaatgctatggccagctggcgtccttctgttatgcagatttcttaaaataattggcatattggtggtaaacatgaaatgtgaagacgttgcccctcgtcataggtaagcggtggtcatcacaaccatcagcggtgacaataacacagcaaacagtcttgtttgactctcctgcctgcatggtgtttgaaagtgaatcgtcaggatttgcaacaaccaatagtgtactgctattcgcaggagcacaagctcgccggtggcccgtgtgggttaagggaggagtttgttgacccttattttgtcgagttccttgaagaggagtatatataaggggaaacggttcttgctaaagtcctgcttctttgccctttcttgaaataaagggtatttttgattggccagtaacgttaatcatttaataaaacaagcagataaggatgtcatcaagaataattgtcggcagtgcagcattggcagctgccatcacagctagcatcatggtcagagaacagaaggccaagggtcagagaagagagggcaacgtctccgcttactacaacggccaggagtacggcagttcagcacccccacagttgggaaagctacataacataaagcaaggcataaaggaagatgccttgtcgttaaaagacgcgcttctgggcgtatctcaaaaggctagggaagaggctccaaaggtaactaagcgtgtgatatcaccggaagaggatgctcagacacgcaagcagctaggccaaaaagccaaggattcttcctcgcaaagcatcttcaattgggggtttagtgaggctgaaagaaggaaagccatagccatcggggaatttgatactgctaagaagcgtttcgaagaggcagtggatcgtaatgagaaggagctcttgtccacggtgatgagagagaagaaggccgctctggacagagcatccattgagtacgaaaggtacgggagagccagagactttaatgagctttcggacaagctagaccaacaggaaaggaacagtaatcctttgaaacgcctgttgaagaataacacgggtgacgctaatactgaagaagccgctgcaagaagtgtccaaggctggggtgatacggcacaggagtttggtagagaagagttggaggaagccaagagaaatgcttcttcagagccaagcgaggcgcaaaaacgtcttgacgagctgaagaagatcaaggaaaagggctggtttggttacaacaaaggggagcaaagcgagcaacagattgctgaacgggtagccagaggtttagaaggatggggtgaaacagccgctcaactttccaaggacgaaatggacgatttaagatggaattatgagaattcaaagaaacaactggataagaacgtgtccgatgccatggactcgttatctaaggcgaaggaggacttgaaacagtacggcagccactggtggtctggatggacttccaaggtcgacaatgacaagcaggctttaaaagatgaggcccaaaagaagtacgatgaagcgttgaaaaagtacgatgaagccaagaacaaattcaaagaatggaatgataagggtgatggtaaattctggagctcgaaaaaggactagttagatagctaattgtaaagggttggttcccgcataacatatatacatattcacatgtttctcattttttatatttgaaatcacatatggtctttgctgattatggattggaaaacggagtaaattagtggcattattggggtatacgtgcatacataaaataccgttatatatctatatatatggaaaaaagagacttaaatgaatttttagagtaggagaagaaggttgaagaaatgaacaatcgcggcccttcagttttctttatttggttgtgtctggattcatagaggttattgtagagtttgaatttgattttgaacttggattcgagtttgtgaacgcagggctatttttgatgttattattaatagtattcttgtgtttattagtattattgtgattatcgttaaccatgttggcaattgatggtggttgtgccagttgtgactgcaatttttgctttagattgagtttatctctttcaatcatagtgttgtcctcctcttcggaagaaaacccttcactgccactggattccatatggaatttggatttaggtttcccgatcataatgttggcagcactgccgggcctattgctgtttcttcttgaacgggcgctccctgaaggtgacctttgttgtttaagtaagtactgttggttcgatggcgatcttgatagtgcggcccccgtagtgcttccagcgctggttcccccattggcattgttgatcgttgtgttagagtaacgtctagatatgatgaaagggttggtgaagttcatatgctgaggtggtgatgccgaagctgatgggggggaaggcaaatgagaaggagaattcaaaagggacgacgagaacgagtagtgaccttgcattgggggtcttctcaaggggttcgcagttgatgatgttgatgtcgcattactaacgttgttattgttgtcatcggacaacatgtcagcgtaggaataaaaccttagtagtcttgaaccatggtcgttgggagatcttggatgcgcaggcgacgtttcgttatcaaaagattgtgacgaaagacttcttgtcctacctagggctctatccaggccgatggtagatggccttctcgaataaaccatatcaacgtcatcaaggccagtcgtgtcgtcagttacaatagaacagccagcgtctaatgcaggagggacgaaattctctaaggtacgacggtgatccagtggagtctgcacaacaaaatccggattgtatgtctggtacgatgctattgactcattagtcctagaaggttgcaaatgtagattcacagcagacgatctctggcttaagttatggaagttcctattactagaattattatgattgaacaaactggtcctgctgctctgcctagagagagagtttgcagcgttgtttgacaccgttttataaaggtatgatgggtcctctacatttctttcaaaaatcatagaactctcgctcatggagggggaaggtggcatataattattgtcgttctccctctgtgccgccacgtgggagtcgtggtcttggttgtggttgctggtatccatctttgccgtttacgttcgctttgcttgaaggtagtctatcacaaaagctttcaggatcaaccttttgcgcctcaagaaattgcatatcaccaaagggtgagtttagtctgatactgtttgttaatcacctcacgactgttgcaacattaatatggcgcacacaccgtgttacgtgatgaaaataaagataataaagcgatagcataaataaaataccatttaatacgctttgtaaaacaagcactaacaaggcgttgcttaataacaaaatagtcagcattcaacaacgtgagaaggatagctacgacatctacatctgcagtgttgttaaattcgctgccaacaaccatttatatgtcaccatacacggtcatgctctcttgcaccatttttctcacctatataaagtgaaaaagttttcgatgtctcttcttccttcctagtaaactacactccatgtgtttctgaaagggaccttcaggaggttacgatcaagtatcttgtgacatgcaagaacttgatgcttcgatgggggaagtcttattttcaatgtgttgaaaagagttaattatggaacggttggtcatagctttgtacagctcaatgtcgtcatgtttgtaaggatacaggcgcgacttgatctgcgacttactgctatcaaacgataaattatgtttttcttcgtttcctttttttttcttttcagtttccttccgtttatttttttgttggatttatcatgatgagcatttattttactgcgttatcgtattgacgggggctgtttaagtacagtctgttttataatctatattcatttatattttatatttcttaccgaggaaattgactcttaacagatttgctgaaaggttcatcttacaaaaaaattggaaaacttaaactgaaaaaaaaaaagtgaaggagtacgtgaagagcagtagctttcataggaatatgtacaatatcttgtctttgtactttgcaaaaccagcacgcagcaggaagctcttgataatatggtcgatcaccagtggacgccactgcagaaggaggttatctcaggtctgtccgcgggatccgtcaccacattggtagtgcatccattagatttactgaaggttcgtttgcaattatccgctacaagcgcacaaaaggcccattacggcccatttatggtaatcaaagagattatacgttcgtcggcgaatagtggacgtagtgttacgaacgaactgtatcgcggattaagcataaatttgtttggaaatgccattgcatggggagtttatttcggtttatatggtgtcacgaaagaattgatatacaagtcagtggcaaagccaggggaaacacagcttaaaggtgttgggaacgaccacaaaatgaattcgcttatttatttgtctgccggtgcttccagtgggttgatgacagctatcctaacaaaccctatctgggttataaagaccaggataatgtctacaagtaaaggcgcccaaggagcgtacacttctatgtacaacggtgtccaacaactgttacgaactgatggcttccagggcctatggaagggccttgtacccgcactgtttggtgtttcgcaaggtgccttatattttgcagtttacgataccttaaagcaaagaaaattgcgacggaagagggaaaatgggcttgacatccatttaacaaatcttgaaaccattgaaatcacatcgttgggaaaaatggtctccgtcactttggtttacccttttcaattattgaaatcaaacttacaaagtttcagggccaatgagcaaaaatttaggctctttcctttgataaaattaatcattgctaatgatggttttgttggactttataagggcctatctgcaaacttagtacgggccattccatccacttgcattaccttttgtgtatacgagaaccttaagcataggctttagtaaataaaggctatatgatagatttaatttcttgtaaatatcaaacgataaaaatataaaaagtacgaaagaaaaaggggaggtaatctaaactgtaacggggaggaatggtttctttggtttttattatttctaaaaaatatttgtgattatattacaaaatgtaaagtattaaagaaaaactatttttaatttcttagtaacccaaagcggctaattgtttagcaacatcagattcagcagcagtagcattagcagaggcaactttcttggtgaaagctctcttcttggcatagtattcagcggatgaaacctttctctttgcttccaatttggcaacaacatcttcgtatttccaaccaacggaagtagacaacttacccaaggtggtgtactttctacctggcttcaatctcaaaactctcaatgcttgtgggacaacaactctcttcttcttatcgtatggaggtgggataccttcaaagacctttaaacgttccaaagcggccttaccacgagcagtcttgtgagaaaccataccacgaagagctttgtagaagattctagatggggctctgaaatggaatggaccacgggtcttattgaaagcggtagcctttctcaagaaatcatggtactttaatttgtttctgaaaaattcaccagaaatgtttaattcttcagctctaacaacaacgattttttgaccgtttaataattgcttagcaacaacggaagctaaacgacctactaaatgacccttacctggttgaagattattattgatgaatgaatggatgctcattcaaaaaaatggatttgttagtattatcctttaaataaaacctgtttttcccgttcataattcccatctctctctatctccatgttttagcgtatacacaatctacgaagacccttctgtattccacccttctgcggctgtaatatttttatcatattccttggggactcgtaaacgctgtgcactatgagcaaatcctgcggctgggaaaggaaaacacattcaattattagtgcaaaatcttacgtaccatcaatgacaacaactggttcaacagacattttctcgatttgttcttcaccttccgttttcaaagagaaataatatgtataacgatagcgtgcaattatacagtgtgattactaaattgctaatttaattattattacacagcagcccaagattgaatttccctgcagtacctacattgacccattgcaatagcatattctcaggcataagctcggggagtgcactacaggtactattgcgcatcgggcttagccaagggtctctgttgccgggcatggatacagagggagaagtctagcatcggggtagttttcccgggcaggatttgttctgcattggcgggcgtaggagcatagctaggccgaagtatcatgaaaataatctctcggcccgacgcagaaaaatttaatgtttcatgaataaatgtactggtgttacatggtgtaccgatgctttaattgcacttatgtagtcattcgaataatgaatctgcataatacttccagatatattcagcaagggaatctccatttttaatccgccttctcttgctacgcacagatgacgttcttgtattgttgtttttttttaaataataatctaaaagctgttccttagggaattctagcagtgttcttatagatgcattctcattctcgtcattccccattacacgtaacttgagcaatgtatcccttaacagttcgtgtgacctttgaggggaggatttgaactgggagtttctaaacatgacttctaatccattaatgtataagatgatctttaggggttctgtcacagcgtcttcagtgcctctttgggcgtttattttattcatagataagatttgtagtagtttcaccgttatggcactgagttcttcgagatcaaggcaagtgttgattctaatattctcgtatattctgacgttttctggaagggttggcggtacaagtttttggaattgacttagcgggaatgagcttgtggcatcaataaaaaataactgggtaacaacatgctcctttgaaagattctgcttgataaattggcaaagtttgttctttgtcggggaaggccaaatggtaatcagttccaaatcttcatattccatcctttgccgctagcagtctcttctctccattttttttttattttcttttctggcggtttccttaatctaacattaaaataaataaactactgtagctttcgcgtttggtagcacagagggtacagaagtcataaagaatcaaaaaattcattcaataaaaagatataaatcgagaattcttgtttatttaatcgttaatctaaaaggtgtaagatatttcttaacgggtctttgttctttattgtttaataatacatatgggttcgacgacgctgaatttcaactcagagaggaattgttcacgtttgcgtttgttgttacgtccatggatgtcgtagtagaaatttggccagtgagttgagttctttgtaattgcggggcgctttcacctaaaatcgagctcgtagcttgtaaagactttttcaccttctgtgcttttatccccctcgggtcaattgatgaagattcaggagcaggtatttctccaaatttggacatgtgcaattgcagctgtcttgtcacagaggcgcctcgtctaatcttactcaatttaccagcattccacttgttcaaaaaatcacgcctgacttcatcgctaattttccaattcatccctttaccttgttgaccagctcttttgggcaccttctcgaaggctttatttagggacagattatgcctcacggagttctgccacgccatttgagaaaacctgtaaaatgcgtagttgtcagagataaatttgtaaatatccgctaatgaaatactaccttcgggtgttgaaagaatggcttgggtgatcatcgatgcatacgactgtggtggtttgatatatctgttttcatccagcgacaagtctgatggattttctatatggggtacattaccgttagtgacagcattgttgctactggacgtgtatgtattcggtctaattcctcctctggtgtaattttcatcttcttcatcttcttccatcataatcgtgtctccatgtggatcccctattgggttaacatctgatgatgacgataatggggtgtgtaggtggtccagctgttgtaatcgagcctcttcctgtaacctttgctctcttaaataggtagaaccttcgataatgttacgtagcaacgggttgttgttaccattcgtaccataagtagatagtaatttgggcatgaggtgattcaggcaataatccgatataatagtttcttgttccggcaatataaagatcatttgcacaccacctatgtctatgatacaaccagactgtagcaccgtaggaggagagtctggacctgtgggaatccttctaaaattgaccttagcaccatttctaccgaatatctgtaattcccatgatccgctctccaggttgaatctgattgcagcatgcttcctagacacaattttggcaggaccaagatcaatgtctatattcttcttcacgactgtaccgggcacagcattcaagttcaagctgtctgtgttcctaccaatggtaacttctaatttttgtacataatacgtccaatcacatccggcaattttagcataagcgttgacctctctggcaatactcaagctattggaatagtcacttgacacagccacaggatcgcttgacgagctaagaacacatgtcaccgcattaacaagcccttggcgatcctgggctgtatacgaactatacttaccactaaatttttgttccctactggtaacagacatttattattactgtgtctctccaagcctttctttgctaattgaacgcacaatttacacactattatttaaaccttcaatcttctatagagccggtattcatctaaacctcttaccatcctgttctctctataccgtttctgatttgtttatgtttttccatttttttgtttacctcatccatggatcataacctatttcgtaacttttttagacctatcatatatgctatatttccgttcaagcccttaaaaaacattttataagacctacgctcttcaagccctagtgatttctttttttcttttttttttttttggtaatttttttttcaaaagtgactacagtaatgaggtttgtctacctggacatgaccttctattgttgagtagttccttgcattgaagacaaccagtaatcgaattttttataaagcggttagaaaatctcgaagaggttaacatatagaaaaaaagcctctttttatttgagttccataaggtaagagacaaagaaaaaggagcgcatattataattgataagggcgttatgccagaacaagcgcaacaaggggaacagtctgtcaagagaagaagggtcactagagcctgtgatgaatgcagaaagaaaaaagttaaatgtgatggtcagcaaccatgtatccattgtactgtgtactcttatgaatgtacttataagaagcctacgaagagaacacagaactccggaaactccggagttctaacactgggcaatgttactactggtccatcatcaagtactgtggtggcagccgccgcttccaatccaaataaactcctctcaaacattaaaacagaaagggctattttaccgggtgcttctacaatacctgcaagtaacaatccatctaaaccaagaaagtataagactaagagcacaaggttacaatcgaagattgacaggtacaagcaaatatttgatgaggtcttcccgcagttacctgatatagacaatctggatattcctgtgttcttgcagatctttcacaattttaagagggactcgcagtcgtttttagatgacactgtgaaagaatatactttaatcgtaaatgacagttcttctccgatccaaccagtactttcttcaaattcaaaaaactccactccagacgaatttttacctaacatgaaaagtgactcgaatagcgcctccagcaacagggaacaagacagtgtagatacctactccaatatccccgttggtagagaaataaaaataattctaccaccaaaagcgatcgctttacaattcgtgaaaagtacttgggaacattgctgtgttcttctccgattttatcacagaccatcgttcattagacaattggatgagttgtatgagacagacccaaacaattatacgtctaagcaaatgcaatttttaccattgtgctacgctgcaatcgctgtgggagcattattctcgaaatccattgtctcaaatgactcgtcaagggaaaagtttctacaggatgaaggttacaagtacttcattgcagcaaggaaactaatcgacattacaaatgcccgtgacttgaattccatacaagcaattttaatgctgattatattcttacaatgttccgcacgtttatcaacgtgttacacttatatcggtgtcgccatgagaagtgctttgagagcaggctttcataggaaattgagccccaattctggttttagtccaatagaaattgagatgaggaaacgccttttttatacaatctataaactggacgtttatatcaatgcaatgctgggcctaccgagatctatttcccccgacgattttgaccaaactctccccctggatttatcagatgagaatatcactgaggtggcgtacctacctgagaaccaacactccgttttatcaagtacggggatttcgaatgaacatacaaaactatttttgattttaaatgagatcatttctgaactatatccgataaaaaaaactagtaatataatttctcatgagacagttactagcttggaattaaagttgagaaattggttggattcgttgcccaaagaactgatacctaacgcagaaaatattgatcctgaatatgaaagggcaaatcgtttattacatttgtcttttttgcacgttcagataatattatacaggccttttattcattatttatcacgcaacatgaatgctgaaaatgtagatcccttatgttaccggagagcccggaactctattgccgtggctcgaacggttattaagttagcaaaagagatggttagtaataatttattaactggttcatactggtatgcctgttatacaattttttactccgttgcaggtctcttattttacatccatgaggcgcaattgcctgataaggatagtgctagagaatattatgatattttgaaagacgcagaaactggtagaagcgttcttattcaactcaaggattctagtatggccgctagcaggacttataatttattgaaccaaatttttgaaaaactaaactcaaaaactatccagcttactgcgttacattcatcaccatccaacgaaagtgcctttttagtgactaataattcctccgctttgaaacctcatttaggagattcattgcaaccacccgtattcttttcttcccaggatacgaagaatagcttttcattagctaagagtgaagaaagcaccaatgattacgctatggctaattacctaaataatacacctatttccgaaaatcctttaaatgaagcacaacagcaagatcaagtatcccaaggaacgactaacatgtctaatgaaagagatccgaacaatttcttatctattgatatcagacttgataataatggccaatcaaatattcttgatgccacagatgacgtctttatcaggaatgacggcgacatccctactaacagtgcattcgattttagcagcagtaagagcaatgcatcaaataactccaacccagataccattaacaacaactacaataatgttagtggcaaaaacaataataacaataatattactaacaatagtaataataatcacaacaacaacaacaacgacaacaacaacaacaataataataataataataataataataacaataacaatagtggtaatagtagtaataataataacaataataacaataataaaaataataatgacttcggcattaagattgataacaattcaccgtcttatgaagggtttccccagttacaaataccgctttcacaagacaatttgaacatagaagataaagaggagatgtcacctaatattgaaattaaaaacgaacaaaatatgactgactcaaacgatattcttggagtattcgatcagttagatgctcagctatttgggaaatacctacctttaaattacccctctgaatgaaaacgttatctttgatttatattctataatatcgtggctacagcacttgctgaacataagcttaaaacgtttatgtgtgtatttatatatgataataataataataataataataataataataataataataataataataataataatggtgataaactgcaataacaaaagaaaatagtaccaatcctggatctagttttccctaaaatccaatttttacttatcagcctcacttcctaaactacctcaccttcaaaagctcgataattaaaagaaaacatgaataatatagtaaacaatgataatagtttctctataagattatctaattttcgaacagtattagctatatgcgaaatatcttcatcattggtaccttatcataaaccaaggcctgctttatatttatttgaacgaaaaaattaacttatattcttggctttccattcctgtttattttcacagcaaatgaatcagccaaatgagttttaaatgaaacattggacggtgttctagataagctcctgttcagtatgactgagacctttttgtcatacaactgtggagcagactcaaaggaaaaagtttgatctgtgcgagtggtttcaatcgaatcagaacgtccatgtggaattcccatccccattttagaggagatatttggcacatttgtgtcctttgtgaaaaaactatcaagattatctagctctgcccacatgtgacttaacgaagcatccttttcttccgcaacagaaatggaatcgtttgtgtccattctaccaaggtcataatcaccgtccgcatgaaactcgacaattgtatccattctgccgagttcatagtcaccatccgcatgaaattcgataactgcatccatatcatccgatccgtgagcagatacttcatctgatttgcctgtaccacatgtcataaaaactgcgtgaacgttgtgccttgtcgtagccgccgtcattgttggcataggaacagaccaaccgctatcttcaggcaaaccaaacaaggtagtggtagcattatcgccgtctttcacatccttatttcccatggttatccttaaaacatccttatccattttacttccagaaacatttggtacgcaatctaaaacttccaaggcctttgcttcgtattcagtaaatagtaacctgagtaacggagaaatcaaatcagcaccgacaccaataaattctggccttcttaagtcaattaaaggaaaaacatattttaaaatttccagagtttgaactctgatccatcctattttattgaacagaagacccagaaggaacactaacgtttgagcggagtacgaggggaagtagtttctagatatgaaactcactacttggctcatgaaatctttctttgatctaaacttgttctttgctagagaatctatcaaacgggaaagagaaggttgtttgtacgcatttgcaagttcaattaacgaatctgcagcaacctgaatgcccgtaaaatctttgcgatccattgcattcaaaaatctcggaaggtttgctattaatgcgaaaagcagcctagactctgtatttgctataattcggctatctttcaacaaatttaacttatccaaaaatttccacgtaatctctaaggaattcgctgatcgcaatccagtcataactatttgttgcaagccatcaaagcgaccttcccaattggaaggaaagatcgcaaccaaacactgtacggtatcaggagaatccaaatcgatcttggaaatgaatttacttaaacatgacagcacttcaatgaattcttgttcgtgaatgctgctcaaacatgctgtaatggaccaaaataactgcgggaaactgatcaaattcgtcggatcaagttcggccatgattgcattcaaagtcatcaagatctgcatggcaaatccttgtatatcgacatttccatccgatatagtgttcgaaagtctatgaagcatatcacgcaacatttcctgatctaaaaatgtcaataatgatctaaatatttgaaatgacctgcacgctatgtgcctaactgagcaagtggtagcccacttcaaggcaattctttgccaagttacttgaaattcatctaagtccgagaatatagagattatgttcctaattaataggtccatagtttttggtgatcttgcaccttttttcatcaagttatcatatgaccataaggcatgcttatttcttagtagtttcacggtttcctcagacttttcgtgacttggtgccaatccaaatattaatgtagatgcaattttacacgcgctttcgtgaataagcggcacataatggtcaagcaagcaaatggacatatgtagtagaagaggaattttcgcctttacagattcactcaagttcgttaacaaattgactaaaaagataatcgaaagctgcgccttcgaaaaaatgattcttttcccattgtaatttagtcgttcccagatattccctaaaaaggaatacttattattattcattggctcattaaacgtatgtttcgctaaaggaaccatgtatttcggttctaaattattcaatagagtgtcaagtagtccaatgccaccaggaatatttgccaaatacaatacaatatctctagcatactgaacaaacaatggattgcagtgattcattgaagaatttatgatgtactccagcgatacgtgtatattttggaaagaattacccttgccaagagaaatccatagctgctctacttcgttcggtaaagagtcgttaagatcaatagtgatgtaaaataggttattcaataccataaacgtgtccaactcttctaaagatttcaatgtaaatttgtttacccaaggtaccataagcaccaacaaatctctttttatttcgaaaggaaacaaatcaagtattctaaccaaactggaaaatattctcaaacacaaatcctgagagagcagttcggcaaatatgctagaaatttcttttgcagttgatttgtaaaccgtctttgaagaatttgcaagtctctccttaaataccttggtataagaagaattatgtaatttcgtttcaacagctgaaagtagatcaacagcaaatgtccttgtatcttccttatctgccactaaaccatacaaacccaaggagactaattcatcttcatctaaaaccaaattatccaatttcaaaacggatttacaaagtgtagtgtaatataaaacagctaccgaaggatgtgagtggtgtgaaacacattggaaagcaacatctctaaatagtttaaaattttccctatttttgtccaggagattctccaaagcacgcacaccaagattttttacagtagtattgtccgagtcaaatagtgcttcaatccaagcaagtaaatcttcagtatcgaatgaaatcacaataggcaactctaaatcatcgtccaatgtttgggttattggatctgaacataaaacaaccatagtctctagcacgatcatctgcaatctgtttttttggaattctattccagttgtaatagcggttctatctctgccactctctgtattttttatcattatggcatatctttcttcagatattggctcgtactcaccataaccacaccattccttcaagaaattgaaacatgatgcgcgtgcttggaagggaaataattcatctattagcggatgctctcttactgccatatagtagctcaatataagacctgcaaagtagcttcgcagcgattgatattcgtaggagatttgcacagaatccttctcgaggaactgttttgtcttctgcaaaaactctgataatttccgaagtatccattcgtcattaaatatcatatccgattttaagtacggcgataaaatcgtcaaaatatgaaacatctccactctgatttggttgttggagctcccttctttccatgccactaaaaatacatcaattgcctccacatatgctttaaaaatgttgatattcattgagcttagccccgttattatagcatccctaatcataatatactttgcatttaataagggaagaaccatcttgaagattgatttcgcagatttgattttttggtgctgaacagtaaagatttgttgactttttttcctgccatgctgaggaatattggacggaatatgcagtttttggtcaaacgtggaagttaatgaagtacatgcggcaatcaaatatagcttccattggtttactattgtttccggtaaaacatttttgagtttgaaatcaacatcatttgctacccgcagaattatttcgtgtacttgcacaagtcttatacaaacgatagatcgacacaatgccatcgccataggacaagttttgaaaaccaacgccagtaatttaggaaaagccctttgccatagtgcagcatctactccgtactctgattcggccagtttgataagtagacctcttttatatttagaattcagtcgactgaatctcgttttttcaaccgcacttaatgttgctttatgtggattaattaaggtagtggtattacactcatttaataaatcaataagtcttgttccgcgatcagctgcaaaatgggatgatgatctagaatgcccgtttgacaatttctctgttttctccatcatcgcttcgtcaaacttgaaaataattctcaatatctggatgcccaatctacgaatttttgcatcgtgtgaacaaagaaaaaataagccattcccttctacttcttcaataactgtaactgtatttttccactccagtttttcggtttcgttactctcctcttgttctgcatcgatcggcaacaagcgaattccatccaaaccagtttcttttttattttcctctttattggacgattggaattcttctaaccagcattccaaaagctcaacataaagtatcaataatctgttgtactcctttgatgacaagtacgacatgttataacttgattgtgtcttttcatcgaaatcaaatgaatatttagcaaaccatgtgattagggtgtatggattcttcttagatgctaatgctcttagtgcattttgactgctagaagaaataattacctccgaatgaacagcgttccttgataaaatctcaattgtagatttatatgggatagtgcgtgaaatagaaaggcaacatggtatagcttcaatgatggtgccgaacaatataacataaagcgacttatttttacttgagtcattgtcattagaaaagctaaagccaaatgggctgaatgcgtttgatgattgcttttggtgctgattttcaggagaccaaacttcagaaccgatgctagaatccaataaaaggaataatttataaaagtaatctgatatttctgtatggtttatggaagaggcttcttgaacctgattcactgtaatattgtttaaatttagttcataaagcctgttatcatcctcaggaaaccttggcctctcttttgtaaccagcaatcctttgtatgtatttatagtcaaaatcagtttttcgtaattgatattttccaggttagagccattgaaagattgccgtatcaatggaattaaagcttgttccattaaaaaattcggatgtaaaaatccaattgatattaacgcgtctgtcaatgggttcaagagaccaaaatcgccggttatccaattctcttttttccttgtgtttagatatagttgtaaaagcttggtaagcgtccttgtagtattatttaaagtttctgggcatctatataaatagacccaaactaatctggataaaccaactgcaaagataatcctttcattcagacttttggacttaacttttgaggcatttgcctccaacaacgatagccattgtttagaaaataggtctggtggtgatgcacacaaaatagaaactgttaatttgaaaccacttacccaatacttactatcagcttgtagcctcttggcagtgttcagtaaagtagacattgcctctacccacgttggatgattaacttctgccgtcaacgagccagccaaaggcaacaatagctggttagtgacttcagcatacgccaaacaaaccggaaaattttcagtctttgcgaagaactttgataaacttttcatgaaatctgcactttcttcaaatttctccaacggataatttcttaacttcaaatatctcataccaagaatcaacaaatgagtacttggctctaactcgggaggtatatacgccgggattttttctagatcagctataaatcgatcactaactgacaaaaatttcttttcagacatagagcccagtagttcggcaaaagaattccaattcgaagacttaattaaactagttgatatagaaagtggatcagtagtttttaactgagtaaaaacaatctcttctagcttatcagataaatcttcttcttcattgctggaagcctgcttaacaatttcatttagcaccctgcataggatgtatatactaatcagagatttcctatctgcaaggaatgcttcttcttttgctacttcaattgtgttctctaaacttttcaattgtgagttcgctatggatggacttgaagtagcgctattgttactgctactagctttgattaacggaactttgttgttgaaagatgaggaaacgtgccttttcatgccaggaagattattggtattgttattatgtttgtactttgaggttgtattactggaagatcttgatagccgcctattcattaaaaaatgagcctgcgagggatgtgccttttcaaactcatactcttttaatagtttttccatttcttctgaagcagagttggccgcttcagatttagtcttcctccaaaacatcattgcatcaatcacaggtttcggttttttctttgcaatgtgacctagagatttaataatttcatcaaagctgggatcaacgccttcaccaagaatttctacaattgggggttccgccatgtccaactgctgtagacacatatttagtttgttctccgcgtaacgaataaactttgtaaaaagtatatgaagagcatattcagagggacttttccaatctgtagccatttgctgtctcaaagtagtcacgtagtcctctgctactgattttgctgtaatgtccggcggtgctgattcttgcattctttgctgcttttgttcaggtagtagcattgaaatcttgttttgatcactttgctcctcaacaaaggtaggcggaagagcttgaccttcccccgttccttgttgctgttgttgccgtaaaagtaattgattatttagagaggtgccttcagacatatcagtaggagatggaatatcaataataggtgcatccgtaacggattggtgaagaggaaatgtgttaagtggcgcttcgtttatttcctccaagacatcctggcctgaaggatcaatatctattgatatctggttattgttgctagaaccttctgctttatttgtcggtgggaaggtgaaaccaatgccttgatccctctggggcgggaaagtaaatctcgaggccattttgatgtataacaaaactaaaaagggttattaaaatgggaacacaacaaacaaccagaattttcacactttaaccagtcacgtcctattatgaagacctaaatccacatttgctttctctcttcatttgcctaatcctttatcccaatttctacagttctatatgtattttcctgtgtggctgtcgtttcgtggttagtgatacaaccataacgattcaaccaactcccaatgtatgtgatgttgataccgctaatttggaagggatggtatactctaggtgacctcaatgagtcaaagagagctaggacatacttcgagataggtaataccactttgcagcttctttttaggccttcatgagtgagtagccaagaaaaagttaaaagcgggtaataggtatgaatttttcaaatactgaaatttggtttagttatttaagtgaattgtagattatgtacattttacgtgcaatgaaggagtcacctctatgatcatctagttattagctgttagttttcattgaacttgttttaactgggaaaaagcggaacaattgggccttacaatgacaccagacgaactaaattcagcagtcgtcacctttatggccaatctgaatattgatgattcgaaggccaacgaaaccgcttccacagtaacggattctattgtacaccgatcaataaaattgctggaagttgtcgttgcgttgaaagattattttctttcagaaaatgaggtagaaaggaagaaagcgttgacatgtttaaccactatcttagcaaaaactcccaaggaccacctctccaaaaacgaatgctcagtaatatttcagttttaccagtctaagcttgatgatcaagcgcttgcaaaagaagtcttggagggcttcgccgcattagctccaatgaaatatgtctccattaacgagatagcccaacttttgagattattattggacaactatcaacaaggccagcatttggcatcaactagactgtggccatttaaaattttgagaaaaatatttgatagatttttcgtcaatggatcctcgaccgaacaagtcaaacgaatcaacgatttgtttattgaaacatttcttcatgttgccaatggtgaaaaagaccctagaaatttactcttgtcatttgcacttaataaatctatcacatcgtccttgcaaaacgtggagaattttaaagaagacttatttgatgtcttattttgctatttcccaatcactttcaagccaccaaagcatgatccttacaagatctccaaccaagatttaaaaacagctttgcgatcagcaattactgcgacgccattatttgccgaagatgcttatagcaatttgctggacaaactcactgcttcttcaccggtagtgaaaaatgatacacttctgacgctattagaatgcgttagaaaattcggcggctcttctatattggaaaattggacgttactttggaacgctttgaaatttgaaattatgcaaaacagcgaaggaaatgaaaacactctactaaatccgtacaataaagaccaacagagtgatgatgtgggccaatatactaactacgatgcttgcttgaaaattattaatctaatggcattgcaactatacaattttgacaaagtatcatttgaaaagttcttcactcatgtattagatgagttgaaaccaaattttaaatatgaaaaggatttgaagcaaacctgccagattttgtccgctataggtagtgggaatgtcgagatatttaacaaggtcatttcgtcaactttccccttatttttgatcaatacatctgaagttgccaaacttaagctgctgattatgaatttttctttttttgttgactcgtacattgatttgtttggaagaacatctaaagaatcgttgggaacaccggtgccaaataataaaatggctgaatacaaagacgagatcataatgattttgagcatggccttgacaagaagctccaaggcagaggttaccataaggactctatctgtgattcaattcacaaaaatgattaaaatgaagggctttttaaccccagaggaagtttcactaattattcaatacttcacggaagaaatattaacggataacaacaaaaacatttactatgcttgtttggaagggttaaagacaatcagtgagatatatgaggatttagtttttgaaatatcattgaagaaattattggatttgttacctgattgcttcgaggaaaaaattcgagtaaatgatgaggaaaatattcacattgaaacaattttgaagattattcttgatttcaccacttcgagacatattttggtcaaagaaagcattacatttttagcgacaaaattgaatagggtagctaaaatttcgaaatccagagaatattgctttctacttatttcaaccatatattctctttttaataataataatcaaaatgagaacgtgctaaatgaagaagatgctcttgcactcaagaatgccattgagccaaaattatttgagataattactcaggaatcggccattgtaagtgacaattacaatttgacacttctatctaacgttcttttcttcaccaatttgaaaattccacaggctgcacaccaagaagaactagacagatataacgagcttttcatttctgaaggtaagataagaatcttagacacaccgaatgtattggctatttcatatgctaaaatattatccgcactaaataaaaactgccaattcccccaaaaatttacagtgcttttcggaacggttcaactactcaaaaaacatgctccaagaatgacggagactgaaaaattaggatacctggaattgctgttggtcttatcaaataaattcgtctctgaaaaagatgtgataggattattcgattggaaagacttatcagtaattaatcttgaagtgatggtttggttgactaaagggctgataatgcaaaactcattagagtcatcagaaattgcaaaaaagtttattgatttactgtctaatgaagagattggctcacttgtatcgaagctattcgaagtttttgtcatggatatcagttctttgaagaaatttaaaggtatcagttggaataataacgttaaaatcttgtacaaacaaaaattcttcggtgacatttttcaaacactagtcagcaactataaaaataccgtggacatgaccattaaatgcaattatttaactgcattatccttagtgttgaagcatactccaagccaatcggttggtccttttatcaacgatttattcccgcttttattgcaggctttggatatgcctgatcctgaagtaagggtatccgctttagaaactctgaaggacactacggataaacatcacactttaattactgaacacgtaagcacaatagttccattattactatctctttcgcttccgcacaaatataatagtgtcagtgtcaggttaatagccttacagcttctagaaatgattacgactgtagtacctctaaactattgtttgagctatcaggacgatgttctaagcgctttaataccagttttatctgacaaaaaaagaataataagaaagcaatgcgttgacacaagacaggtttattatgaattaggccaaatcccgttcgagtaaacgcttgtatttaataatttgttcacattgatgagcacgtgaaaatcttagcgagtatactaagtaaatatgattcttttatgtatagtacagcaaaatagcatttatttttattacgtttaatcttcttcactagagtcttcctcgtcgcttagtcctacaggtgccaaacccggtgtcagaccaggatatctatgatctttaacaaaatcgctctctttgatatcttccttgaattgttttcttttgaaccttcttcttttactcctgtctgtgttcgcagtggaaactgtatccttcaagatggattgctgaatgtcttcaagctcatctcgtacttcctcttctaaatcccacgacctcaaattttgagaattccttttgattaacttattcaaatacttcctctcatggtccgttaatgtgccctcatgttgatgttttttcaaaacctggtgttttgccagttgttcaagttgctctttatctaatttatgtttcttaacttttttttttttgaccagtttgcatttttttttaattttgtgaacgtctctgttttgtaactgtactctctttttcaagttcctgtcgattaactgagcttttgacccattgtttacacttgttttgccattattagctctgattttgggaacgccaggcaaaaggtttgatagcagtccattaacaaccgaggtggcctggtatttagatgtttggctcagcgaagatgacattttggcctagctagctccctccttaagttgttcgtattctaaacaacttttccacaaaacaatatttccacagttgccagctatatttccatattccttagttaaagctcatcgcaaaatttttcaaagagcattagggtcacgtgtatacattcacgtgactatctagtacccgccccgtggcaaaaaaagaagacaccaatttggcactgagaaaagaaaaagtttatcaataacgaaaacgaaacttaagaggaaaaagagtatagagaaaaacaaaggcaatcagcggctaatttggtggaaataacaacacaaagaggcagcacagtttagagcaagcgcgaatgcttcaggaacaatctgagttgatgagcacggtgatgaataatacacctacaacagttgccgcattggctgcggttgctgcagcctctgaaacaaatggaaagctggggtccgaggaacaacctgaaatcactattccaaagccgaggagtagtgcacagttggagcagctactctaccgctatagggctattcaaaaccatccaaaggaaaacaagttggagatcaaggcaatagaagacacttttaggaatatatcacgtgatcaggatatctacgaaacaaagttggataccttgagaaagagtatagataaaggatttcagtacgatgaggatttattgaataaacacttggttgccttacagttactggagaaagatacagatgtccctgactacttcttagacttaccagacaccaagaacgataacactacggcgatcgaagtagactattctgaaaagaaaccaataaaaatatcagcagatttcaatgcgaaggccaaaagtttgggtttagaatcaaaattttctaacgctacgaagactgcattgggcgatccagataccgaaataaggatttctgcacgtatatccaacagaattaacgagctggaaagattacctgccaatctgggtacatactcactagatgattgtttagagtttattacaaaagatgatttatcgtccagaatggatactttcaaaatcaaagctcttgtggaattgaaaagtttaaagctactaactaaacaaaaatcgattaggcaaaagttaatcaacaatgttgccagccaggcacaccacaatattccatatctacgtgattctcctttcacagcagctgcacaaagatctgttcaaattagaagcaaagttattgtcccacaaaccgttcgtttggcagaagaattagaaaggcaacaactattggaaaaaagaaaaaaggaacgtaatttacatttacaaaaaataaacagcatcattgatttcatcaaagaaaggcagtccgagcaatggtctcgtcaagaacgttgctttcagttcggtagattaggcgcttcattacacaatcaaatggagaaagatgaacagaaaagaatagaaagaactgctaagcaacgtttagctgctttgaagtctaacgatgaggaggcttatttaaagcttttagatcaaactaaggatactagaattacacagttattgaggcagactaattcctttttggattctttgtcggaggctgttagagcacaacaaaacgaagcaaaaattcttcatggtgaggaagtccaaccaattacagatgaagaaagagaaaagactgactattatgaagtcgctcataggatcaaagaaaaaattgataaacaaccttctattcttgttggcggcactttaaaagagtatcaattacgaggtttagaatggatggtgtcgttgtacaataatcatttgaacggtattctagcagatgagatgggtttaggtaaaaccatccaatctatttctctaataacatatctttatgaagttaagaaagacatcggccctttcctagtcattgtacctttatccacaataaccaattggactttagaatttgaaaaatgggctccgagcttaaacactattatatacaaaggtacaccaaatcaaagacactctttacagcatcaaataagggttggaaattttgacgtcttattgacaacatatgagtatattattaaagataaatctcttttatcaaaacatgattgggctcatatgatcattgacgaaggtcatagaatgaaaaatgctcaatcgaagttatcattcacaatttctcattattatcgtacaagaaacagattgattttaacgggtactcctttgcagaacaatctaccagaattatgggcactgttgaactttgttttgcctaaaattttcaattctgcgaagacttttgaagattggtttaatactccatttgccaacaccggtacccaagagaaactagaattaacggaagaagaaactctgttaattattagaagattacataaggtgttaaggccatttttattgcgtcgtttgaaaaaggaagtggaaaaggatttgcctgataaagtggaaaaagttatcaaatgtaaactgtctggtttgcaacaacagttatatcagcaaatgctaaagcataacgcgctatttgttggtgcagggactgagggggctacaaagggtggtattaaaggtttgaacaataagattatgcaattaagaaaaatctgcaaccatccattcgtatttgatgaagtggaaggtgttgtaaacccctcaagaggtaatagtgatttacttttcagagtagcgggcaagtttgaattactggatagagtgctaccgaaattcaaagcctcaggccacagagtgctaatgtttttccaaatgactcaagttatggatattatggaagacttcctaagaatgaaagatttgaagtatatgagattagatggtagcactaagactgaagaaagaacagaaatgctgaatgcatttaatgctccagattcagattatttctgtttccttttgtcaactagagccggtggtttgggtttgaatttacaaactgcagatacggtgatcatctttgatacagattggaatccacaccaagatttacaggcccaagatagagctcacagaattggacaaaagaatgaggttagaattttaagattaattaccactgattccgtagaggaagttattttggaaagagctatgcagaaattggacattgacggcaaggttatccaggcaggtaagtttgataacaaatcaactgcagaagagcaagaagcttttttgagaagattgatcgaaagtgaaacgaacagggatgatgatgacaaagcagaattagatgacgatgagttaaacgatactttggccagaagcgctgatgaaaaaatactatttgataaaattgataaggagagaatgaaccaagaaagagcagatgctaaagcgcaaggcctgagagtccctcctcctagattgattcaattagacgagctacccaaagtattcagagaagacattgaagaacatttcaagaaagaggattctgaaccattgggaaggattagacaaaagaaaagagtttactatgatgacggtctaactgaagaacaatttttggaggctgtagaagatgataatatgtctttagaagatgccattaaaaaaagacgtgaagcacgtgaaagaaggagattacgtcaaaatggtacaaaagagaatgaaatagaaaccctggaaaacacgcctgaagcatccgaaacttcattgattgagaacaatagcttcactgcagctgtggatgaggaaactaatgctgataaagagactacagcttccaggtcaaaacgccggagtagtagaaagaaaaggaccattagcattgttacggcagaagacaaagagaatactcaagaagagagtacatctcaagaaaacgggggcgctaaggtggaagaggaagtaaaaagtagctccgttgaaattataaatggttcagaatccaagaaaaagaaaccgaaactgaccgtcaagatcaaactaaacaaaacaactgtgttggagaataatgatggtaagcgagcagaagaaaagccagagagtaaatcgcccgcgaagaagactgcagccaaaaaaactaaaactaaatccaagtcgcttgggatttttcccacggtggaaaaattggtggaagaaatgcgcgaacagttagatgaggtagactcccatccaaggacgtccatttttgaaaagcttccttcgaaacgcgactatccggactattttaaagtaattgaaaaacccatggccattgatattatattgaaaaactgcaagaatggcacttacaaaactttggaggaggtaaggcaagccttacaaacgatgtttgaaaatgctagattctataatgaagagggatcctgggtttacgttgatgctgacaagttaaatgagtttactgatgaatggttcaaggaacactcttcgtaacgttttcatcaccacatgttttttttttttacgactatatccctttcccctctaatactctttctagcctttttttctacctctacatatgtttataaaatatataccactgtaacaataagatcgacagagcgaatataattctttgagtaactaatatcctttggcttattctctgggcttattagtgccgcaaaataattacccggcggcgatggaccagttagcttcgaccgtttgcgattccggggctaaggaaggggcctctgcaaataagaaagaggcattacacataaatgattggcaaagggactgcgggagtcaagacctacatgtaagtccgatttacgataacggtttagattcattgggtgtgtactatttatactttaacaaacccgtgtgttatttaataagatcatatcttgtttgtttttcgccctcaattttgtttctgtcacatagtcgcagcagctgaatatagataggaagagagaaggaagcgattctcgttcagcatcatacttcttcctaatttccccaaattaaagtttcgtttgaaagaaacaacaaaagagaaagaaagcagtttttagaaaatactaaattttaccgttatgctaaggttcgtgtcttcgcaaacctgccggtatagttcaagaggactattaaaaacatctttacttaaaaatgcatctactgtcaaaattgtcggaagagggttagccaccactggtacagataattttctatcgacatcaaatgccacctatatcgatgaaatgtaccaagcttggcaaaaagacccatcttcagtccatgtttcatgggacgcatatttcaagaatatgtctaacccaaagattccagctacaaaggcttttcaggctcctcccagtatcagtaactttccccagggtaccgaagcagctcccttagggaccgcaatgactggttcagtagatgagaacgtctccattcatctaaaagtgcaattgctatgtagagcttaccaagttagaggtcatttaaaagcccatatagatcctttagggatctcatttggtagtaataaaaataaccctgttcctccggaattgactctagactactacggctttagcaaacacgatcttgataaagaaatcaacctaggacctggtatcctgccaaggtttgcaagggacgggaaatctaaaatgtctctgaaagagattgtggatcatctagaaaagttatattgttcctcttatggggtacaatacacacatattccatctaagcaaaagtgtgattggttaagagagagaattgagattcctgaaccttaccaatatacagtggaccaaaagagacaaatcttagatagattaacatgggccacttcttttgagtcattcttatctacaaaatttccaaatgataagaggttcggtttagaaggtttggaaagtgttgttccaggtattaaaactttggttgatcgttctgttgaattgggtgtagaagatattgttttgggtatggctcaccgtggtagattgaacgttttatccaatgtggtccgtaaaccaaatgaatctattttttctgaatttaagggttcgagcgctcgcgatgatattgaaggatcgggtgatgtcaagtaccatttgggtatgaactaccaaagaccaactacgtctggtaagtacgtcaatttatcgctggtggcaaatccttctcatttagaatcccaagatccagttgttcttggtagaactagagctttattgcatgccaagaacgatttgaaggaaaaaacaaaggccttaggtgtgttattacatggtgatgctgcttttgctgggcagggtgttgtttatgaaaccatgggtttcttgaccctaccagaatactctactggtggtactattcatgttattacaaacaaccagatcggattcactacggatccaagatttgcaaggtccacaccatatccttccgatttggctaaggccattgatgccccaattttccatgttaacgctaatgacgtggaagctgtgacctttattttcaatttagccgcagaatggagacataagttccacacagatgccataattgatgtcgttggttggagaaaacatggacataatgaaaccgatcagccatcgtttactcaaccattaatgtacaaaaaaattgcaaaacaaaaatctgtcattgacgtctatacggaaaaattgataagtgaaggcacattttctaaaaaagatattgatgagcacaagaaatgggtatggaacttatttgaagatgctttcgaaaaggcaaaggattacgtcccatctcaaagagaatggttaactgctgcctgggaaggattcaaatccccaaaggaattggccactgagatattaccacatgaaccaactaatgttccagagagtactttgaaagaactaggtaaggtactctcttcgtggccagaaggttttgaagtgcacaaaaatctaaagagaattttgaaaaatagaggaaaatctattgagacaggtgaaggcatcgattgggccaccggtgaagcattagcgttcggtacattggttttggatggtcagaacgttagggtttccggtgaagatgtagaaagaggtacattttctcaacgtcatgcagtcttgcatgaccaacaatctgaagccatttacacaccgctaagcactctgaataatgaaaaggcagacttcaccattgcaaattcctcgttatctgagtacggtgtaatgggtttcgaatatggttattcgctaacctccccagattatctagtcatgtgggaggctcaattcggtgactttgcaaatacagcacaggttattattgaccaatttattgccggtggtgaacaaaaatggaagcaacgctctggtttagttttgtctttaccccatggttatgatggccaggggccagaacattcgtctggtagattggaaagattcttgcaactagccaatgaagacccaagatatttcccatctgaagaaaagctacagagacaacatcaggattgtaatttccaggttgtttatccaactacgcctgctaatttattccacattctaaggagacagcaacatcgtcaattccgtaaaccattggcgttattcttttctaaacagctgctgcgtcacccattggccagatcatctctttccgaattcactgaaggcggattccaatggattatcgaagatattgaacatggaaaaagtattggtacgaaagaggaaaccaagagattagttttgctgagtggccaagtgtacactgccctacataaaagacgtgaaagtttgggtgataagaccactgctttcttaaagattgaacagctgcacccattcccatttgctcagctacgtgattcattaaattcttatccaaacttggaagaaattgtttggtgccaggaagagccattgaacatgggttcgtgggcatacacagaaccacgcttacacacaacattaaaagaaacggataaatataaggatttcaaggtcagatactgtggtagaaacccaagtggtgctgttgctgccggtagcaaatcactacatttggccgaagaagatgcctttttgaaagatgttttccaacaatcctaaagatgaattcaaatatgaaaaacatgaaaatacagccatataaacacgtaatatttttaccttaatgtttatggacagcctttttacttgaagaatgatctaacaaatattttttttgatacattcacattttttttttgttcatgatgttagcatctgcttagtctttttaaaattatttaatttaacgttttatttatgtgaacctttttttattagttgtatttactatttattcaagaatcattctttactttatattgatatcgtttttttccccctacttcctcctctggtgtattcacagctaggtgcttctcttgtcctcatccggtggagaaaaaaagtgaaaaataagtcaatggaaagggggaagggggtaggtaaatagagtgaataagttttattcatcatgcccaacttctattaatatatactcaattcaaatattgatcaggatttcaaagagtatgtcggagttacagtcacaacctaaaaagattgccgttgttacaggcgcctcaggtggtattggatatgaggtaacgaaggaattagccagaaatggctatttggtttatgcatgtgcaagaagactagaaccaatggcacaattggccatccaatttggtaacgatagtatcaaaccatataagttggatatttccaagccagaagaaattgtaacattttctggttttttgcgagctaatttacctgatggtaaattagatttattgtacaacaatgccggtcagagttgtacattccctgcattggatgcaacagatgctgcagtagaacaatgctttaaggtcaatgtgtttggtcatatcaacatgtgccgtgaattgtcggagttccttattaaagcgaaaggaaccattgtcttcactggttccttggcaggagttgtgtcattcccctttggtagcatttattccgcttctaaagctgctatccaccaatatgctcgtgggttacatctagagatgaagcccttcaacgtgagagtgattaacgctattactggcggtgtggctactgatatcgctgataaaaggcccttgcctgaaacctcaatatacaacttccctgaaggtagggaagcttttaattcaagaaaaaccatggctaaggacaataagcccatgccagctgatgcgtacgcaaagcaactggttaaagatatcttgagcactagtgaccctgtagatgtttatagaggaacgttcgccaacatcatgcgttttgtcatgatatttgttccttactggctattggaaaaaggactttccaaaaaatttaaattggacaaagttaataatgctttgaagtcgaaacagaagaataaggacgattagtgtttcaccatcgtcaatagctacctatatttatatacaagattccgtatagtttgtacaccacgtcaggacatcaatagctaataatcgttctaatgctaatgttcaactgctctttaagtattgtttacgtctcgtcgtaccagtatgccaaattcctgtcacttcactcattctctttgctcttaccgtttgaaacgcgctgggacggaattcgctcatttcgcatcgtgctttgttgttttttttttttcaaaattgccattgtttatttataaactacatgaaattattctgtatttatcttcgcattccctctcttacttcaaaagtgagaacagcatattcaaatatatatatctactcagttgaataagacactatagcaagaccatttgaactgaaagaaacagtttctttgctcccctctcgaattccaactatttacagtccttcctttataaaaattaactagcgagcaagaaaacatttgtttagtgctacccaactacttacattcctttaaaaaccacaatatttaagttaacctgagctttatttttagtaagttatttaccacaatttttctcatacacctttacaatccgtattgccatgaataccaaggcttgctcagcttctgcagcagttcaaccctttccaataccgccaatgcgtcctcaaaacgttagtttagtcgtgctcaaccgctatttttggttttatcttcgtttctttctcctgaacgacattcgtcacgaaaattgcggcggaaaatttcctgatgcggacactttttcccgatccggacatgcctttttttggcgtttcgcgtcagtcaatagaagtttcagatctacattaggaagaaccagaaaatagccattaatgctttcagcatagcacagcatagcagctgtgtatatcttaaataagatgtagactggtttgcatttggaaaggttttgtgtaagaaaagcaatacttgaggtaaaacaagagaaaaaaaaacactttactaactaatatccaatcctttatttttttgcagaaatgaaattctcaactgccgttactacgttgattagttctggtgccatcgtgtctgctttaccacacgtggatgttcaccaagaagatgcccaccaacataagagggccgttgcgtacaaatacgtttacgaaactgttgttgtcgattctgatggccacactgtaactcctgctgcttcagaagtcgctactgctgctacctctgctatcattacaacatctgtgttggctccaacctcctccgcagccgctgggatagccgcttccattgctgtttcatctgctgccttagccaagaatgagaaaatctctgatgccgctgcatctgccactgcctcaacatctcaaggggcatcctcctcctcctcctcctcctcggcaacttctaccctagaaagcagctctgtttcttcatctagtgaagaagctgctccaacatctactgtcgtgtcaacttcttccgcaacccaatctagtgcttcttctgccactaaatctagtacttcttccacttcaccatctacttctacttctacttccacttcttctacttcctcttcctcttcctcctcctcctcctcttcttcttcttcttctggcagtggtagtatctacggtgatttggccgacttttcaggcccaagtgagaaattccaagacggcactattccatgtgacaaattcccatctggtcaaggtgtcatttctattgactggattggcgagggtggatggtccggtgtggaaaacaccgacacttccactggcggttcatgcaaggaggggtcctactgttcctactcctgccaaccaggtatgtctaagacccaatggccatccgatcaaccatctgacggtagatctgtcgggggtttgttgtgtaaaaatggttatttgtaccgttctaacactgacgcggattacttatgtgaatggggtgtcgaggctgcctatgttgtttctaaactaagcaagggtgtcgccatttgcagaaccgactacccgggcactgaaaacatggttatcccaacctatgttgaagggggtagctctttgccattgaccgttgttgaccaagatacttactttacttgggaaggcaaaaagacatctgctcaatactacgttaataacgccggcgtctcagttgaagatgggtgtatctggggtacttctggatctggtattggtaactgggcaccattaaactttggtgctggctccactggtggagtgacatacttatcattgattcctaacccaaacaacagcgacgcattgaactacaacgtcaagatagttgctgctgatgattcatccaatgtcatcggtgaatgtgtttacgaaaatggtgagttctctggcggtgctgacgggtgtaccgtctctgttacttccggtaaagctcatttcgtcttatacaattaagctacgtgactactacttttccttttttttttcttttttcgaacacatctcaccccctatacctcacacaatcactatggtccccttttctttttaccgatatttatactgtccacctttttcttttcgttaatggcctcaatgtttctgtaccattatccaagtgaacttgttagacgaccaaatatagccaagattcattacgattatctttaactagcaagtagtattcttggatagagagattttcaaagacggaacaattttaaatagatttacataagaaaacacatactgtccgatacccataagaaatttaagaactcttttcatcttcagctttccggcctccttttactgtagcctgttcctagacagctaaaaatagtacatatgcagctctgcaatagtctcaaaggggatattgtgtaggtttacgaaatcatcacatttccgaatcaggacatgaaggcacaactttccgcacgtagtgttttcagcccccagcgcctgtcggcgcgaagaggatctgcggagatgagctttgccccgccattacccgtaaaatattactgttttgggcaattgtggatcaaaaagggaaaatgcggatggtgaaaaaaatttttggaaatttactgcttcagatgggggaactttgtaagttcttccttttttttcgtagaggttggaaaattcagagtgctaagaaattaaaaggtatgcactgcctattctcataaaagcaaaagtgcacaaaaataataaggtgtgaagcaatagtagaaaagacactgggaacccaaggtatcttattttaacagataagtaaaactaagatcaaatcgcgtactgatatcacttaaggttcgcgtattttaaaggctacgcagaagaggaaataaattgcgtgcaatccctgcgcttaactcatacaaaaaggcgcaaaacatttcaagagtcccacgattaattgcagaaattgaaaaaaaataagtaaagacgaaaatcaaagtggatgccatattatgaagcaggagccacatagacaatccgaagaaaaagagaagccgaaaggaccaatggctgttgaacgagagcagcatacctcattatcttctggtacaaccgtgacagctagtacaggagacgagagtaccaacagtagaccagtggaatcatcgcaaacagaaaagtctctatcgcttcgaataagaatattaaaacaacttgggtttgacgatattcaagaactaaatgcatgcgacactggcctagtggagcaatttttaaacgtacgattgataaacgacacaaaagaactagaaaagatacgcgagtcaaatcttgcgaaactaaaccagattattgataaatgtatggaaagtgataaaataagtgattcgacattaaacaagattcttgatatgtccatgaatagagatacaaataatgataacaacaatcatcttacgataccgtctccgataacgacaaagaaacgcaagataaacgcctccgaacttgcaagtccacgaggccatagaagatatagatctgatatacctacagtgtcagaagttgagacaggggtcggataccctcaaatacaccagcaaccaggcgcatatactttacctatgcctgcaaatcagtggatgagcaacccgtatatgcaacctccgcaaccacaagtgcaacagataatgccgcagtatttatatccaccagggatgggaccacaagctcagcttcctacaatgagctcaaactcggagtcccagacaccagtgatgagctcacagtttctttccttgaaccagcatggcctttaccaacaaaatataggtgctcatccggtaatgagtatgggcccacaggcaaatatatacgggcagcagcaccagctgcaacctggtcaggaacgagaccagtcaagaaaaagttttagtcatagaaggtcacaaagtgccaatatttccatggcaaattttaggtcgcccatgcgaaatccccagccggcttcgtcccaaaggcccgtcaattttctcattcatacaccaaaacatcctcctcccacatgacgtgcagtaattttcatttttatcacctaatttctaaaactatatcccttcctaaccttcattcgatgcatccgtccaccttacttcagttcaaaaaaaaatatatatccatatatatgctacagtgttattattacgatttctttgcctttactccttatctcatttcaatcatgaataaacaggatattgataatatatgctgtcattttggattcagtctgcttaactgtcttgtccacccccggtgttcttacccgtctgagcggtcgtaagacggaggtaataatttttcagcatcctgacctcccccccaaatctgtgcctttcaccacatttttctcgagaaaatgtgtcttggctcagatgatgtcgtatgagctactggacttttttttgttggccctgatgaaaatagtaatggcggttacagaacagataaacggcgtcaccatcttttcctagataaagaagcaatctctagataatggggtatataaatatacattgtaaaaacggcaagtcagttgctggtcattttagtagaaactctgctctcaaacttgagtactgcaacgatggcaggagcaacatcaagtataattcgggaaaatgattttgaggacgagcttgcggagagtatgcagtcatataatagagaaactgcagacaaattggctttgactaggaccgagagtgtaaagccagaaccggagataaccgctccgcctcactcacgcttttcccgttctttcaagacagttttaatagctcagtgcgctttcactgggtttttctccacaatagcaggtgccatctactatccagttctgagcgttatagaaagaaaattcgatattgacgaggaattggtgaatgtcactgttgtagtatattttgtatttcagggtcttgcccccacattcatgggcgggtttgccgattcactgggcaggagaccggtggtgcttgtcgcaatcgtcatttattttggtgcctgcatcggtcttgcttgtgctcaaacgtatgctcagatcattgtgctaagatgtctacaagccgccggtatttcacccgtgattgcgattaacagcggaataatgggagatgttactactagagccgagcgcggcgggtacgttggatatgttgctggatttcaagttctaggttctgcgttcggagcccttatcggtgccggattatcatctagatggggatggagagccatcttttggttcttagcaattggatctggcatttgcttcctagcctcgtttttaattttgccagaaacaaagaggaacatatccgggaatggttctgtcaccccaaaatcatacttaaatagagctcccattcttgttttgccaacagtaagaaaatcattgcatttggataatccagattacgaaacattggaactgcccacgcaactaaatctactggcgcccttcaagattttgaaagcttatgaaatttgtatacttatgctagtcgctggattacaatttgccatgtatactacgcaccttacggcgttatccacagctttgagtaaacaatatcacttgactgttgcaaaggtaggattatgctaccttccctccggtatctgcacattatgtagtattgtcattgctggaagatatttgaattggaattacaggcgcagattaaaatattaccaaaattggttgggcaagaagagatcaaagcttttagaagaacacgacaacgaccttaatttggtgcaacgtatcatagaaaatgatcccaaatacacctttaatatcttcaaggcgaggttgcaacccgcatttgttaccttgcttttaagcagtagcggattttgtgcgtacggatggtgcattactgtcaaagcccctttagcggccgttctttgcatgagtggatttgcgtcgctgttttccaattgcattttgactttttcaacaactctaatagttgatctttttcccacgaagacatctacggctacgggatgtttaaaccttttcagatgcattctatctgctgtgtttatagctgcattgagtaaaatggtagaaaaaatgaaattcggaggtgtttttacatttttgggggctttaacctcctcgtcatcgatcctcttatttattctcttgagaaaaggtaaagaattagcctttaagaggaaaaagcaagaactgggagtaaattaagaagtaaagcttcttgaatcaaaggaaaatgttccttttgatcgctccactaccgagaaagaggaattggtgtgataagtcttctcaaatagaaagtaatagtaagtatttttttttttttaatctgaactctgtaataactaaaattagagttagcagcacgattcactaacatagaacggctagtactgagttttgcctttattattctccgccattttttgccaaggccgaaaatatgctggaggtgcgaaattcggagattcgggtttcatgtttctggcccggttgttaacggaccctttatctcatcttctgatcttggagtttcttctagttgataaaaccatggtgaagctgaaaggtttgaagaatctctatcactgtagcaaaaaaatcttcttacaacaaaaaaagtaagcaagcaatcagcgttcaaaggaacttattcttgcttaaaaaaagtgataatctcttagcactaccatcttctattaataaaaaaataacagatagctcatgaagagacttctataagtaaatcatgaccaaacaacaaacttctgtaatgcgtaacgcatctatagccaaggaagaacgtgaaggatctgataataataatgtggacagatccagctcagatgccatcagtgacaacgacgcagaaagatctaattctcattctgaaatagataacgaatcaaattttgatatggtgccttattcaaggttcagccataagcaaaaaatgcttcttgtcgttcagtgtgccttcacaggctttttttcaaccgtggcagggtctatctactatccagtgcttactattattgagaggaaatttaacatcacagaagagttagctaatgtcactattgtggtttattttattttccaaggggtggctccttcaattatgggtggtttagctgatacatttggaaggcggcctattgtattatgggcaatcttagcctacttctgtgcctgcatcggactggcatgtgcacataattacgcccaaatcctggctttaaggtgtttacaggcagcaggtatttctcctgttattgcaataaatagcggaataatgggagatgtaacgacaaaagtagagaggggtggatatgttggattggttgcagggttccaagttgttggaactgcattcggtgcattgattggtgccggattatcctcgaaatggggttggagggcaattttttggtttttggctattggttccggaatttgtctagttttttcaaccttattgatgccagagacaaaaagaactttggtgggaaacggctccgtaacaccaaggtcatttttgaataggtctttgatattgcatgttggttccgtaaaaaaaacattacatttagacgatcctgaccctgagaccttagaaccacgtactagcgtggattttttagcacctttaaaaattttgcacatacgagaaatagacattttattgtccattgccggcctgcaattttccacgtggaccactcatcaaacagccttaacaattgtattgagtaaaaagtacaatctatctgttgcaaaaataggcctgtgctttttacctgcaggaatctcgacactgacaagtattatctctgctggtcggtacttaaattggagctacagaacaagaaaggttaaatacaacagatggattaaagaacaagaattacagctgatggagaaatataaaggtgataaaaacaaggtagcagaacttattcactctaattctcattatgcattcaatttagtggaggcaaggttgcatccagcatttgtgacacttcttctcagtagcattggctttactgcctttggatggtgtatttcggtgaaaacaccgcttgctgctgtattatgcacaagtgcatttgcaagtttattttcaaactgtattttgaccttctctactactttgatagtagatctctttccgtctaaggcttctaccgcaacaggttgcttaaatttatttagatgtctcctatccgcaattttcattgcagcactgaccaagatggtcgagaagatgagatatggaggtgtttttacgtttttgagtgctataacttcatcttcatcgcttttattattctatctcctgaagaatgggaaacaactatcgttcgataggattagggcaaatgataagtcggctggaaggtcagttggtaaaaattcagaaaaagtttcgacgtgaagaaaaaaagtcgtaaaactaaaaagtctctgcccccactttccagaaacagatatctatattttataacaaagacgtacggcatcatttaaagtatctaaaatttctttgaagagatcacataaaaaattttcaccttctttttctctttttggctgtccaagtaaacaaaacataaactgcttcaaccaaagataaaacttgagaaaatccaaaatgaacaataaggacatttcttggtgacagattcgttaagtttcattatttttttcacttattttatagaaaaaaatcggatgttgaatgggcataaatataaatgtatatataagtaatattgtcttgtttccctggagaagtaaatgaaaaatgaaatagcatacaaaacagacataaaatttaaaacagaaatgaaatgagcatttaaaattaattaaaaggtgaaacgacgaattgaaaattattgatgagggtgaagggaaacagggaatgtgctagaattaaaggggtagaaaatttatggtggagacttcccgatacatactttaatgttgttgcataaaattttctgagtctgaagttgacatattatgcaacggtttattttgttggtaaaatttatggtttaattgcttaacttcattttttaagcagtttacttgttcctttaaattttcaatagtgttaaacattgtttgccacatgtatatgacatctgtagagaaaactggggaaatttgttcttgttgtgcatcgcgcggtagctgtataggcattgtttgctggaaaaatggcgatggtggagtttgcaggattagattgtctgccggtgctgatgacaaaagggaaaattgagccgggctaatgaaggatggttctcctttggtatccaaagctggcaaagattctaatttatcgaggttgatacttgactgaatatgctctggtgtactaaaaacattagtactatgattactattcctattaatattattgctattattattgttgctattgttactattgttaatattattattgttattgttacaattattataataatggttattaatattatcattagtaccattcttgttcggcttcaatgttttttgcgacttgagtataatgtttccgtttacaaaactaaaagtgttttgtaactgcactagcaaatactgcattctagataattttgacggatcaaaatttaagtttgagcctgcctcttgttttgatttttttttcttttgcttggatttctttgatggatgcactttcaaagactttgtgtataagactttaaatctatcatgacattgacgagagtttctctcgtacccatattgttggaataggatttttgaaatttttttccaaaaattcttcataggcttgaaatattctacgaatgttagtaattgagaattattcattattgtagtaatgaatgctatatcctcaggctctttccattttttccttatctgtcttgcagacgaggaggatgaattagagttgtttagctcattttcgtcaatagagcctgagttggagttggagttcgaattagaattggagttcgaattcgaatttgaactggaaattattcttggagtaactaaagagcagtccgaacccgtttcttcattaaaatttgaagtaatgggtgtgtttaaatttggtgaataatcagggaaatttttgcttatagtgctagactcatccattaggttcaacttcggttgaagatattccaagtacattttataaatatcagtaataaaatgatgagaaaaaaaaaaaaagacttaaaaaaaaggactgagaaatagttaaacgaatacgataatatgatatactaccatgaactgtagtctggataaccaaacggaaaaaaaggaaatacaaaaaaagtcagattgtaaggaaaaaaaaagagtagtttcagtattacgaaaactattagatctttctttaatttgaacaagaaaacaagactataaaaaaaaatactctttaggatgcagacataaaagaacaatacgaccgtcccttatttatatatagtccatagaaataatctcaaccaatataatatgcaagaaaataacgaagtaaggaacaagcacaatggtacgcccggtcttgaaaaagtttaaaacagtactcgaccctaggcgctagggtgggtgacgcattttaactttgcaacagaatgccatatgcggtgttaacctcacaagatcggctctactatctgcaagctgcggcaaataccagagaaaattccattcccgtcgacaaaatttaaccgaccccccccccccccaatttacgtttatcagctaatccaaatgtggaagggcaacattctcgacgactcctttttccgtaatttaagtttgcccaggcaaaatcttatacttgttttcgtaagagaaagatgcgcagatcctttaaggttaccttcaagcaaatccagaagcacaaatggcaggggagaaaagacatgaagcaggagtagtcaaccgcaaaaacccccgcgggcttgttgttctgcacatttttgatgtgtttgttcctaagacaaagtcctaacttagggtagtaagtgactatattctgcacgctcttaaagcagccacctcgtttaattttgcatgcttatataagcttataaacgaagtacctgaggacctgcatcggccggcccatgtgaaaaggaagtatttactttttcttcttctttactatggaaatagctggaatccgactatgcatatgcgtaagaaaagaaaatgaaggagttttcacaggaaagcacacttgcatactgggcacaagtgaggagaggggcctgtaatgcttctgtgtttaaaagactccgaaattagtcaacgcagatttgcagatgcacgcaagaatacataatcaatcacagtaagcacatctccccaaggaaagagtaaatgccttcgagccagcattgtggtcatgcgagatgtctaagaaaaatacttcgataagcacgaggaaatgtaatatgtctatctaccttattttttttacaataaacatataataaatcccttatctggtcacgtgaattaaacttcgggtgtgttgtaagaatggaaggagtaagcgaaactcaaattgaggccacttaccacttccggtcgagcccggcccagaaccagtcgtcggccaacttttttcttggaacagcgttaccgcacctacgcgagaaatagtagattatagataagaaatacaaggagaggggtgtggatgagcttttttacaaaatagtgtaaggcgtccgggaaaccccaagaacgttttttgacatccactaacaggattacccgtcatagatatactggtgccattacccgttaatggcatcttgtatatttcttttatctttcttaacattcctgaaaattggtaaacagtaaaaagaaaagaaaaagaaagaaaaaacatgtattattttgaatttactggaaaataggcaaccattgattttcgtttttttatcgttctcatctctagctctggtcagcattttttactttataacaacaagtttttcattaaaatccatagtagcacaaggtaaagggaaacaaacatgtcatttctatgtgggtcagcttcaacgtcaaataaaccgatcgaaagaaagatcgttattttgggcgacggtgcctgtggtaaaacttcgttgctgaatgttttcaccagaggttattttcccgaagtttatgagcctactgtttttgaaaactatatccatgatattttcgttgacagtaaacatatcacgctatcgttgtgggatactgcgggccaagaggaatttgacaggttacgatccttgtcttattcagatacgcaatgtataatgttatgtttcagtattgattcacgcgattctttagaaaatgtccaaaataaatgggtgggtgaaatcactgatcattgtgaaggcgtcaagttagtcttagttgcactaaagtgtgacttaagaaacaatgaaaatgaatctaacgcaatcacaccgaacaatatccaacaggataacagcgtttctaacgacaacggaaataacataaatagcacctcaaacggcaaaaacctgataagttatgaagaaggtctagctatggctaaaaagatcggtgcgctacgttatttggaatgtagcgctaagctgaataaaggtgtcaacgaagctttcacagaagccgcaagagttgctttaaccgcgggcccagtagcaaccgaagtgaaaagtgacagtggatccagctgtaccattatgtaatataataagacacggacgcacacacaaaagaatagaacccaaaaagagagactaaacaaataatataataagttatagaagttaataatactcctactattttatattttttatgtaattactaccactgcttaaaaaaaatattgcaaaatatcataaaagtttttactcatcctgttctttcccctccagcatgtgctcgagataagtcgaaggtgtaggttttcttttggactgtacgaccaacaaattacccttactatggttacgatttacgctaccatcactttctggtgaattaagcagctttcgacttggtgaagatgcaatttttgcgggtttccttatgtcttcacccacctccttttcattaccgttatcgagcgacgatgcggatgatgaagagattgtagacaccagagaatttgtagatacattatcacttgtcataatcacaggtttctgtaataatctagggctttcttggtaaagtttagatagccttgttttgtataagatatcacctgttggtgaaatgaaaagtgaatttctgttggattcggatgcaagagagaatagcggcctttcgaaattacttaagaatggtttttcattattagtatgagatacaagtgcatctttcaccgattcatccttatttccgggactaatatcggactcgctgatatggacctgatcttggaaattttctttggcgggataatccatatatggggaatcgccgtaaaactgggtatgttgtgtggaaaacatctttgattcgtagtcctgaacacttctggtcaacctatgcgaagaataagttgttattacccaccatagcaatattgccaaaaaaatcactcccgcgattccccccactacaatgaaaactgttccattaggcatatccccggaatccaaaatataaggattaccatttctagagggaggagtaatacttggtataatagaagaggatgtagagttggacaaaagtggtaaagaagatgaagaagaagcaacagatgttatcgtactacttgaactggcagttgttgtcgaagaagtggaagtggttaattttggaaggcctctcttggcaatggtgattactgtcattcttgcgttttgagtgtcaatttattctattttcaacgaccttttaaagtaataatgagtgctcttgacttaactctaatgctataactgtttctttgcaccgatgcgttcctttgaatgatctcaggtaatatattaaatatttttcaaatgtctttaccacattcttcagtaatacattttctctctaatttttcattttccattttccattttatttttagaacgtgtgacaaagttgtttcaagaacaatatagaattcttagccaaaaagagaaagcaagaaaattaaactttatttgtctaagaaaagcccgaacagcgaaaccgatcacttcccaggatcggaaggtgtcactttgcgccttttgctccgccgctctttcgtcggcgttctttgcttccctgggcgctgtcgcattaagaatatcatgtatattcaggaacaaaggtaaatcacctatagacgtgcgccgcaataaccctgctaagaaaattcatttaaaaaacttacctgccagtcttgttgtttactcaaaccacatactatgattatacttttgtcagagttatgcgatgccgcttaagctttgattaagaatttttttctcttctttaagtatgccgtgcacttttcgcttctccaaaatatgacccaatactcatttggttatttttaccaagtaatcgatcagatagcattaatagcgtgaatatttgatggaataacatattagaaaagctttagctggcaattcttgtactgtctttcgccgaaacctgtttgatgactacttcatcaattttttttttttctgccgcattccaaaggtcataactttgcaaaaataaagggtaaatggttaaaaattgttatcataaataaggtgaccggttatattgagacctttcctggacagtaactaatacagaagccattggtaatgcaataatttatttgatcatgtgactacgatccgggtgagactattcaaaaaaggagtcaagcattgaaataattaatgactaatccgaagttaattgttaggagtcaattgttttttccaatgaatggaatctgagatgactaaactaccaattttcaatagttcatggtatagtgacgtagttagtgcttttttttcttggatctgttgactcacttcaattgatgtttcttaccctgacatgacatacttgatattttatctctcacgttatataacttgaaaaggatgcacacagttctgttcaatataccctccaatatgtaaaaacagtttttccattgattactcttaatttgtttcctgctaaaccagcagtacgtgtgtgccgtatatattaaaattacactatggtttttgatttgaaaagaattgttagaccaaaaatttataacttggaaccttatcgctgtgcaagagatgatttcaccgagggtatattgctagacgccaatgaaaatgcccatggacctactccagttgaattgagcaagaccaatttacatcgttacccggatcctcaccaattggaattcaagaccgcaatgacgaaatacaggaacaaaacaagcagttatgccaatgacccagaggtaaaacctttaactgctgacaatctgtgcctaggtgtgggatctgatgagagtattgatgctattattagagcatgctgtgttcccgggaaagaaaagattctggttcttccaccaacatattctatgtactctgtttgtgcaaacattaatgatatagaagtcgtccaatgtcctttaactgtttccgacggttcttttcaaatggataccgaagctgtattaaccattttgaaaaacgactcgctaattaagttgatgttcgttacttcaccaggtaatccaaccggagccaaaattaagaccagtttaatcgaaaaggtcttacagaattgggacaatgggttagtcgttgttgatgaagcttacgtagatttttgtggtggctctacagctccactagtcaccaagtatcctaacttggttactttgcaaactctatccaagtcattcggtttagccgggattaggttgggtatgacatatgcaacagcagagttggccagaattttaaatgcaatgaaggcgccttataatatttcctccctagcctctgaatatgcactaaaagctgttcaagacagtaatctaaagaagatggaagccacttcgaaaataatcaatgaagagaaaatgcgcctcttaaaggaattaactgctttggattacgttgatgaccaatatgttggtggattagatgctaattttcttttaatacggatcaacgggggtgacaatgtcttggcaaagaagttatattaccaattggctactcaatctggggttgtcgtcagatttagaggtaacgaattaggctgttccggatgtttgagaattaccgttggaacccatgaggagaacacacatttgataaagtacttcaaggagacgttatataagctggccaatgaataaatagattaatttaaacagtatatgtacagttttatatatatatatatatatatatacatatataaagaaacctgtgcgttttttgtattttcaaatacatttagttttggcgccacttctataaaaggtctcatgatattgttacaatatcaatttttcttcgtttctcatgccctgtttctatgatagaggatgaatttattattaacggcactaacaacgtacatatagctaaatatcactattttgccatgttcaaatttttgaagaaatcaccaatttgctttttcgtattcatggccaacccaacttctactactttaaatcctttcatgtcctttgttattgaagaggatgcatcgaacgacgaagcctttttacctttctcctccaattgtaacctactcacttgctcacgcaataatttgatttcttttagtaaaccgtcacgtgcaagagattctttagctagttttgccactaatggattatcgtccaatctcttattctttacagtgaacaattttaaaatgttcagcaactcttcagtatgattaattttggcggacacatcgaatagcttttgacgtaatgtcttttgcattctaaattgatgcgtgctgagatctttaacgtatccactcgaagcatcatcaaaatgcattaaaaacagatactcctcttttgcattggctacatcttcagttatttgtgcaatatctttcctgacataatctgtaactttttccttcaggtcttgaatgttagcatttgttatttgcatttgttcacacttgatattattctgaatatttaatagaatttcagcctctggtattctccaagtatacagattattgatagaccgcactgtacgcttcaccaaagggatgctcgattgatcagtaaaaaaagtatccatattccggatgttttccatcagaacagtaaactcagcttcgaccgtctgaaatgtactctcaatcaaccttaacgtagaattttgtgaaacgaaaggaatatttgatacttttgcacttgtgtaatattctttcaattgctttggtttgcattgctctgctaaataattttcgtcaccttcaaatgtttgaacagaaaaattacatgtttcaacaggctcagtttgcagaccattgtcgactgcttccttcttaacagtttgtgtactgttgtgtttcacgggtatggcatccgtttgaacttcattttccttggaactttctgaaaggtctgtctgtatgccagattcagcataattgtcttctaatgaagtttgtacatcaaaatcagcggaagcgctcacttcacgtgctttaaaagcttctccaccatgaggtagctcatcagtattaatatcttccagtttatcgtaggactcagatatactttcatcccggtcactgttgagtgacatgttatcatctgattctttaacttcactgctttgtctactgtctttttcgctcgcgtcctcttctgaagattggtggtcttcgaattgctttattgccatatttgaatcaaaattctctttttcattgtcttttttcaatgctattccatctccttggacaccatgatttggttgaccgctcctttcattattcttcgaagtttcattcatttctttagacttgttatcgtgatcaaccacagcatgttgactatattttgggtctgtttcgcttttttcatgattgttcacgtcctgtgactttggaatttcttcgtttgctgtggtatcaaaagcactttcagaagtccttacagatatttcacttcctgatacataaccatcttttgggtcatcgttatgatcctttttagaactttctccagttctttcttctttcgctggtagaaacggattctccacactcttcaaggttatggggcccttttcactagtttctttagtatcagcttcttccattggtgaaaccgtagatgtattacttttattcattgtggagttaccaaacgaaaaagcaggtgttgtagagcttggtttggtaatatttgttgcaaatgctgaaaacggcgattcggattttgctttgacatgatttccaaatacaggattttttaaaccagccatgtcaatattggcacttttttttatagtttcagttagcttgcctatgggggatttttgcgcttcctcctcgacaacttcaccatcttcatccgagggagtttccggtaatctagtagaagatgtttgctcaaccgtagaatctgtcaaatcattaccgcttacgttgggaccattgctttcgtgttcttcattatcgtcattgatttcactggtagagcccttacttaaagatccattttcagtatcatcttttgtgaaggaactgaatggtgatttgtttcctaactgtgaagagaaaggtgaagcctgagtaccgaatttaaaagttgtatcggaaccaacagattccagagcctttgaaaatccagatccaaaggaagaactcccaaaatcaaaggcattggtctttggtttcgtagaggtgttaggtttcgtaccaaaaggtgtcgaagaagagtctacatcactcttagactcatcttcactttgatcgccagaagatgggaaaggtgacgttgaatctacctcctttgggctgtcaactgtaggttttgaaatagtaaagtttgatccgaaaagttcattgttggcgggtgcaaaagatgatgaaccaaatgcagcctttccaaatatggatccagagttagtttcgttacttgatgcagttccgaatgcagatgtaccaaaagagggcttaccaaaggcagatccggaagcaggcggctcagcagatgaatttccagagccaaaggaaggagtaccaaaagagggcttaccaaatgcagatccggaggcaggcggctcaacagatgaatttccagagccaaaggaaggagtaccaaaagagggcttaccaaaggcagatccggaggcaggcgattcaacagatgactttccagagccaaaggagggagcaccaaaagatggcttgccaaaggcatattctgatgttgacggttctttggcaatagctccgaacgcgggtttgccgaatactggcttagcagaagcaggatctgttgcgtcttgttcactggacgctacaccagtactggtagatgagactgatggcaagtcaattttaaatgcggatgatccaaatgagggagcaccaaaggttgaagaactttgagactgcaggctattggcagcggctggttgtgttttaagaaaagtgaagcctgatgtatttgctgatgtgaaaggattctctgataaagccttacttgattcattatttttctttttttcttcctgctcctgtccagcaataggaattttttctgatgtaggagagagagatttctcatgttctaaagattccagatttatgctataatggccgcttttgattgctgccacatgaaacaacccgactatctgtaagctaccttcgttattcaatatgtaaacgagcggcaatcgctctatcgtatcaacaccggaacaaggttctagaatagtgcctgaagtaacgacgtcaactgccacacctattggatttgtgtccttatctgtttcctcactgatgggcaatactgctcgttcagaatcctgggaaggttcaataacttgtttcgagtcccatatacttacttcacttgaacatgatgatgctagcacatttacgtttgcatcaggttcaattaaaccagacaaggtaactttgtacatatatgggaaccttactatttgcccgaatggaggtgtaatatcaaaagtttcttgaaatgaggcgctgccgtctatgtgctttataatgtacattttttgatcgtatgaaacttcgtcatcggtctctgatataacattaccgaaaaccgccaaaaaatcctgtggagagagaatggtaacactcaaaggggaatattcttctactggaagctcttctaattctgacggtagagagaactcaaattgtttttccatttcgccatttcgccatgcaaaactttgaaaacttctatcttttagtagaactgctaactgcgaatttgtgacatcaaaagaggtaacgttttgtgccagttgcttagtcgattttgttcttaaatccagtgctgataaatcattgactgaatttaaaattactaaagtgttattaacgttcttcaattggaaaactggcttctcaaaagaagtgaccgttcgaaattcactcaattcctccaagtctaacgaatataatgcatttctggttgaaaccaaaacctgatcaccatgaaagcacacaaatattacatctgggatttctttctcccacttgaacgttaacggagtagagtcggaggtgatatgatctctcagtaattgtaattcgccgaccaccgccttactaccagaggcagcaacgaataaagacttactgtttgaaatatcgagattttgtagagatgcaaatggcagtttttcattgaaggaaggtagaatttgtttttgacctaaaaacttaaaaccgaagtcttcggaagtctcagtgggtacttcatccttcaaagaagacatgttataatggttctgtaatcaatatatatatatttatgtgcgtttctctgctaaaattgcaataatgaaattaaaccttcacgcaaaatcgttattgaagttggagaggagacaaattaacctgagaaatatgaattggtgtgaagcagcgtatgtgtgacagaacaaacaagcctaaacgccgatgtcaaacacaattttttctccagtttatgcgtgcaactatccttcggtcctttgtctttttttctcttttgatcaaacaattgaaaaaacactggtcgtaggtcacgataaaagttgcgatgtcccctcccacctagtttcctaaatactattatataatattaactaaacaaacgtcagaaaaaaaaaaaactctatcaaaagtacaaatccttatttagtaaaatttataagaaaataaaatctctcagggcgagaacgatagagaccagccaaatttgtggactggttcagtcagttgtagcgcattgaaagacatacccacacccaaagaaatatctttattcaaatttcgcttgtacgacaatgtagtcaggcctgaatctgcaatttttgccttaacttgcgaaatagaatctggtacgtatctggtaacaaattcaatgttcatattagaacttgtcttcgattgtaaagtggctttagttcccacttgcaaatagcggttaacgttttgaaaaaatgaagcagttgcgcattgcctgttgttagtagacaaaataaacgaatattctctggcaagatacccgattgacatagcatagcgtgcacataaacccgcagctgtgtcatatgcgatgtcagtgccgccaacaaacccgcggtggcccaaagtaacacttccgacaaagtccttaggttgcaagatgtctatagaagttcttgctgcaaacgatttttgggcgtagctcaaattaaatttggcgttcttgatggattggggagtcaaaaatgcgttgacatcacctttccaaccaggtgctatcttggaaaattcgattcttgtatttaacctgttctggttcgaccaactctgagatagcgacactccctccttcctgtcataaaaccgtccttctacgctagtttggatggggccttctgtcacgccctgcttcgccttcagagtaaaattcacaccattttccgtggttgttgaaatattcaaagagagggggttggtgtgaaaaaagtccctattgaataggccattgacatctctagatatatcgttgaaaaatcgtagtgccatcgtaggtaatttctaacactttcctcttcatgcaattccttcactcgagaataaaacagaagagctccatcttcactattctttcttttctttttgttccatttctgcaattggaagcgagaaaaaaggaaaggaattgctaaaggcgctttcaatcatgtaagacaaattagtatttggttaaaaaatgcagaagctcagtcgcagcatagaaaaagaactaaacttttaaatgctgaaaactacgaacagattttgcagtgtgtcatttctgcggaatccgttattcgtctcatttgctaggcagggcgcacactattggaataggagatatcttccagatagaaaagggtttttgcgtcgtacggcgcggccttggcaactccccttctggaacaggcaacttcctaattaggttgccgcagcgaataactttaatcagttcttatcccctttatggtatactgggtgatataaaagaacgagtaagacaagatcagcaacaaagttgaagataatctattatctaaaataacacatacggctgcgcacttgtagccataatctcgcatgaacatatacacatcacccacgcgaacaccgaacatcgcaccaaagagtggccaaagaccatctcttcctatgctggccacagatgagaggtctacggacaaagaaagcccgaatgaagaccgtgaattcgtgccttgttcgagtttggacgtgcgcagaatctacccaaaaggcccattacttgttctcccggaaaagatctacctttattcagagcccacggtaaaagagcttttaccctttgatgtggtcatcaacgttgctgaagaggcaaacgatttacgaatgcaggttcctgctgtcgagtaccatcactaccgatgggaacatgattcgcagattgcgttggacttgccatcattgactagcatcatacacgcagctacgactaagcgagagaagatactgatacattgccaatgtgggctgtcgagatccgcaacgctgattattgcatatataatgaaatatcataacttgagtctgaggcactcatatgatctgttgaaatcaagggcagacaagataaacccttccatagggcttattttccagttgatggaatgggaggttgctcttaacgcgaagactaacgtgcaagccaacagttatagaaaagtaccgtgagagagaaaaaaaaaaaagatatagcattcaatgaggctttattgaggggcacgatgctctttttttcttctgtactttataaataattccgtatttcttcgctttgtttcatgctctgttctgagcttttagtttctcttattgagagccttttccaaatcaaggctcaggaagtgactcgtccttagaagaacaaggtttggatttggtagggttcttgtacgaagttctcaatataatttgcgcatttactgtacggttcatactagtttattccgggtaacaagttttcttgtgatgctaaatcaatgtgtatattgagaaaactatgtagtaagttacacaaagcaacaaaggatattattatatgtgacagagaagaattgctgtagagattcatgacaatatgaatgagactactacaaaacagccgctaaagaaaaggtccctgagcagctatctttcaaacgtgagcacgagacgggaggagctggaaaagatttctaaacaagaaacatccgaagaggaagatactgccggcaagcatgaacaaagggaaacactgtcggaagaagtaagtgataagtttccagaaaatgttgcatcgtttcgctcacagactacaagcgttcatcaagccacccaaaataacctgaatgcaaaggaatccgaagacctggcccataagaatgatgcgagttcacacgaaggagaggttaatggggacagccgtccggacgatgttcctgaaacgaatgaaaaaataagccaagcaatacgagcgaaaatttcgtcatcatcatcatcacccaatgtacgtaatgttgatatccaaaaccatcaacctttttcgagagaccaacttcgagcgatgttgaaagaaccaaaaaggaaaactgttgatgatttcatagaagaagagggtttgggagctgttgaagaagaggatttaagtgatgaggtacttgaaaaaaatacaacagaaccagaaaatgtggaaaaagatatagagtatagcgactcagataaggacacagacgatgtgggaagcgatgatcccacggcacccaactcaccaataaaacttggtcgtcgcaaactggttagaggtgaccaacttgatgcaacaacaagttccatgtttaataacgaatcagattctgaattatcagatatcgatgatagcaagaatattgctttatccagtagcctatttagaggcggttcttcacctgtgaaagagacaaacaacaacctttcaaatatgaattcttcaccagcacaaaatccaaaaaggggttctgtctccaggagtaatgatagtaacaagagttctcatatagctgtttccaagcgccccaaacagaagaagggcatatatagggattctggtggtagaacaagactacagattgcctgtgacaagggcaaatatgatgtagtcaaaaagatgattgaagaaggaggttacgatattaatgaccaagacaatgctggtaatacagcattgcatgaagcggcgttgcaaggtcatattgagattgtggaactgttgatagaaaatggtgcagatgtaaatatcaagtctattgaaatgttcggcgatactcccttgatcgatgcttccgccaatggacacttggatgttgtcaagtatcttcttaaaaacggtgcggacccaactatacgtaacgctaaagggttaactgcgtttgaatctgtcgatgatgaatctgaatttgatgatgaagaagaccaaaagattttgcgtgaaataaaaaaaaggttgagtatagccgctaaaaaatggactaacagagcaggaattcataatgacaaatctaaaaatggcaataatgctcacacaatagatcagccaccttttgataataccacaaaagccaaaaacgaaaaggccgctgactcaccttcaatggcttccaatattgatgagaaagctccggaagaggaattctattggacagatgttacttctagagcgggaaaagaaaaactgtttaaagcttcgaaggagggacatttaccatacgttggtacgtatgtagaaaatggtggtaagatagacttaaggtcatttttcgaaagcgttaagtgtggccatgaagatattacaagtatctttttggcattcggatttcccgtaaatcaaacttcaagggataataaaacatccgctttaatggtagctgtaggtcgtggccatcttggaactgttaaactgctattagaggcaggtgcagatccaaccaaaagagataaaaagggtcgtaccgctttgtactatgccaaaaacagcataatgggaataacaaacagtgaagaaattcaattgattgaaaatgctataaataactatttgaagaagcactctgaagataataatgatgatgatgatgatgatgataataataatgaaacatataaacatgaaaaaaagagagagaaaacgcaatcacccatattagcaagccgaagaagtgccactcctagaattgaagacgaagaggacgatacgaggatgctcaatctggcagacgatgactttaataacgatcgtgatgtcaaggaatctacaacttcggattcgcgcaagagattggatgacaatgaaaatgttggtactcaatactcattggactggaaaaaacgtaaaacaaatgccttgcaagatgaagaaaaattaaaaagtatctcaccactctctatggaacctcattctccaaagaaggcaaaatctgtagagataagtaaaatacatgaagaaacggctgctgaaagagaagcaagactcaaggaagaggaagaatacagaaagaaaagattagaaaagaaaagaaaaaaagaacaggaactactacaaaagctggccgaagatgagaaaaaaaggatcgaagaacaggagaagcagaaagtcttagaaatggaaagattggaaaaagctactttagagaaagcaagaaaaatggaaagggaaaaagaaatggaagaaatctcttatagaagggcagtaagggacttatatccgttaggactgaagattattaacttcaacgataaacttgattacaaaagatttttgccgctatattattttgtagacgaaaaaaacgataaatttgtgctcgacttgcaagtaatgatattgttgaaggatatcgacttgctctcaaaggacaaccaaccaacttctgagaagattcccgtcgatccctcgcacctgactccattgtggaatatgttgaaattcattttcctgtatggaggtagttatgatgataaaaagaacaacatggaaaataaaagatatgttgtaaactttgatggggttgatttggacacaaagattgggtatgagcttttggagtacaaaaaatttgttagtttgcccatggcgtggattaaatgggataacgttgttattgaaaaccacgcaaaaagaaaagaaattgaaggaaatatgattcaaatatcaataaacgaatttgcacgatggagaaacgataagctgaacaaagcgcagcagccgacgcgcaaacagcgttctctaaaaatacctcgagagttaccggttaaatttcaacaccgtatgagcatatcctccgtcctccagcagacatccaaagaaccattttggtaaaacaattcatcggtccgttggcatatgctcatacatagttgcattttcgattcattaaatactattcatgttaacataattccatataatcgtactgttttgtcattattatatcggcatgacactcaccaatttctttttttgattttgtattgttcgataaggcaacgaacgagtactcgaaaaaatgtcatggaccccttaaaattactgaggggttcagaaaataccgtgcaaaagacgaaaaaagacgaatttcatttgatttatattttataaatgactgttgcattaaacaatagaccaattatttcaatttaatattctttgcaggaaactttcacaatggaataacgccacatattcattgtaaagagcatgtataacaaacactgatttttgttttgagttttaaaagatatccatttactaacattcgaggtgtacaagcacaagttttgcagtgttgcgtacttctcttactaaaggggcacggctaactgggacaagatttgttcaaacaaaggccctttcgaaggcaacattgacagatctgcccgaaagatgggaaaatatgccaaacttagaacagaaagagattgcagataatttgacagaacgtcaaaagcttccatggaaaactctcaataacgaggaaatcaaagcagcttggtacatatcctacggcgagtggggacctagaagacctgtacacggaaaaggcgatgttgcatttataactaaaggagtatttttagggttaggaatctcatttgggctctttggtttagtgagactattagccaatcctgaaactccaaagactatgaacagggaatggcagttgaaatcagacgagtatctgaagtcaaaaaatgccaatccttggggaggttattctcaagttcaatctaaataagtagacgaggaaaataaaattgtttcgtatattccgtgtttggggtataagtagattgttttcatatatacgcatttggtcttagttcagtaggttgattacttagttccttgtaccttcttctgcaaatatcattcattgttacttcgaagaagaaaaaaaataatcatggaaaattggaaaaaaaaaaagtccaatctaaaaaataaaaatgttcaagtcatcgattctatggggaggaaaaggacaatcagaaccgaagtgttgtgtagctaaaatatgtcattttccttcggctttacttccaatgactttgatgatgatgagcttgttgctcaacctgaaacattcgttgaaagcagcaaagaaaacgaaaataccactgcttacatcaatccattagattcggatttcttgtcgcaagctggagttgtgcagccaaatgtggaagacctaggaacaatattggaaagtcttaaggatgttagattgacatttgaagagttccaatctccgatatatagaaaaccattgatcaagagggaactattcgatgtcaaacatcagctaatgttagagacagatgcccaatccaacaacaactccacggaactggacattttactaggtgatacttctgaagatttgagaaagaacatctatgaaggtgggttgaaatcatgggagtgctcttatgatttagttgatttgttgtcagagaacgttgatagaataagcaacgatatcgacgcggttgtcgaaataggctgtggtacggcactaccctcagagtttcttttcagatctgctcttctacggaatgatagaagtaaaggtttaaagtttgttttgactgactataatgccagtgtattaagattagttaccataccgaatttggttataacatgggctaaaacggttttgacaaaggaacaatggtacgccttacagaaagacgaatgtgaagatattccaataaataatgaggaactgcttcttacctcaaagctgttagctgccttttacgacgatgtacaaagcaggaatatcagcgtcactcttatatcaggatcgtggggacgtaaatttagtaatttgatccatgaagtactctcaggtagccaaaaagtcctttcattatcctcagaaacaatttatcaacctgacaatttgcccgttatagcggaaacaatacttgacatacacaatttaccacaaaccgatgtcaaaacttacgtagccgcaaaggatatttattttggagtcggtggtagcatcactgaatttgaagcttatttggacgacaaaataaactccgaacatctaccaattcattctgaaaggtttaaagttaactctggcttaaaaaggtcgattatatgcattgaaacaaataaagctatccgatagttagtataatttgtttcaacttcatttccttaagttaatccataagtcttttactgtatcttttatttataacatggatgaaaatagaaaagaaatatagaagtaaaaattaaagtaactgttcaatatacataatataattggaaagcaaaaatgcaaccaacaaaaatatacagtttctttttatcattgattcccttttagccttatttgctaattctggctttcatgatttgtaagaattctctgtaactttcgttattcaaaatcttatcctccactaaggtgctagaagcccatagtcttagcgttgcaacttccctagcagatgcatggttaacgggctcgctcaaagaggcacccctaacaatatacaatgattggtaagtgatgacatcatcatggtttctcaattggttgataatgtttcttactctttgattgaattcagaattttcaacaacaggtatttcctgtttgccaattggaatgtcaaagatatcctgtgttccaaacacatcgaatactagcgctggtacagcgtcaccacccatccacaaaaacaattcgttaccattatctatcaagtatagaccgtatctttcaaacaacgaagaggtagcattgattggttgaggcaaaacaattgtgccagtagcttcaccatcttcagtttgcactggtaacccagcctcatcagccatatcatgcagcgaataaacatcagggtagatgtttttgattagatatttcaaaggtaatgattctaagttgttcaaggccgaggcgcgatggtcacttgggacaataccagatctaaatgccatatgcttagttaaagaatgcattaacaatgggaacattctcaaattggcacataacctcaatggggccccccctgcagtgttggacaccactatttccttcttgtacgtggctaagatatcttgcacggatttgttgatcaatactcttgcatcgtccaaactggaattcaatgctttctccaccgccttcgagttgtaaaacgacgctatagctaattggtcagcagatgcgtagacttctgccaacgattccgtggttggcatagccaatgttataattcttattctacgttgactattattcagagataaaagtaccgctacttgaacataacaatagtcagccataatggattcatcaacgttaacttcgaataagtatgattgatctcttggcatggtggaaaatgcacataaatcagatgatctattgaagaagtgaccatagaatctactcattctcaaacctgtggaaccacgggctctcattacggtttccatacagaaatccatggaaatgtgcttggcaaactcagtggaaaatttgacaatatcatttgggttcttgcctgaaaaaccaggatagaaatgcgtttgaccagcagtgaaacgactcaaattcgatagtgatgcaacgtccatataatcttcagaagccaaaaataaatcgacagtaatctgtactttagaacaatcgatggtgaaattcttataaaatgagtcttgacaggaaagtagttgtgcagtttccttggatgtattaacaacaccactttcatttctcctttgtaattttcctatgcctaagttgggcaaagtacctgacacaacaattattttaccaccaacgccaccaattaaatgataagcggatttcaaagcggggcccagtgcgaaatttgtgattaaattagattggaagatttgaggaatcttggtcaataaagtttcaatgttttgtctgcaggcctttaaggacacaaccatagagtttggtctgggcaagaaaggctcttccaggtcggcaatatccatcatgttgatttgatcggcggactcttcattgttttcagaatccaatgggattttaaagtagtgaatggcgttgtctacacataagatggaaattctggttctttcatcatggtttggaatggaatcaagattttgcaaaagggtgttgatggtagtggccagtaacccactcttgatagaggactgggagacatcgatcaggaaacagtaagtggctggaggtggttgtcttagagtatattcctttggggccatatattccatcacagcacatttgatttcatttctgtcgtatctactctttgggtcgtttggatcgctctggtccatttgcataggaacgtcattggccagacgacaaaagttacatctccatcttctgccttgctcgataaaagtgacaaaagggttcatgtaagaacgacaacgacgacaacggacaataagtccatcttcattcaatggaggcgggtcgatatcgtcgtacaagtgttggtatggtctgataacaagcccaaatggaagtttagacttcttcagcagggagctgttcttaggaacggcgttcaaggtcgacctgatataatctggagacgcattggacaattcagaaggaactaacatcctttctggaggaataaccaacggtgggggaggcaaggtcagatcggtaattggaggaggcaattccgtcaacagatcgattggatacaactggttcatgggcctcatgttttggcccattgcggcgctaggttggccatacgcaggcgctgccattggttgttgctgttgctgcaaaggtgtgcccatttgcacgggaacctgtggctgcatataagcgttaggatcgactagcggtacgttgtgcagatgcatatcgttcatggaagtggtggcctgatcaatttgctggtgtaactgttcttgagcaggggttaggaattgttgctgccccatggaagggactgcaccctgtggcggcattcccatctgaccatagctcattccagctgcagcaggatcctgcggaggcatgaattgtgctggctgttgtagaggggtggcattttgtccatactggagctgagcttgtgggtaaacacgtttcttgtgatgagacattttgcagatggtctcagacttatatatttatgtctgtttcaatgcggcaaaaatggacctgagtgccagataaaacctttttgtagtgctatttttggcctgtttcctgatgtaccatcctccttacatagttttgtttttcttcgttttcgttcttccagttttcattttcttctgccgtaaatggaaaaaacaagaaaaaaaaaaagagaacagctaagcgttaacaaatctgctccagtggccatgtccaagactgtttttcaagcccagatagtgcctgaatagactgcattaagctgaaaaacttatagcagtggttagtgcaaaatgcacacttgtcagtgctatgtatatttgtgacacgattctatcacccaaacatagcactaattacttttttgttacccggcattctaggcggaaatttgctgaaattttccatcaattaattacgtaacctattcttttaagagcatgatgttgtatataaatatagatcaccttaggaacagtcaggctttcttaggtttcagaagttcatgtgtcttggcgcagtcaattctctcgatctttttttggtttggacgtttaagagtagcggtcgccggaaaatagagagaaaaaggaaatttaaaaggagttcttctttcttcttattattagatcgtatacagtaaaaaaaaaaaaaggaagtagtagttcgaagagaaagaaataaatggtaggctcgaaggatattgatctattcaacctgagagagaacgagcaaatcgtttctccttgtcttatcgtgcacggaaaatgcaataagcaaaatggtgcgaagaccgttcaagtgcagcatccacaattgcctccaattacttaccccatacataatcagttcttcaaggccactgtgatattgactcctggtgagaacaagttgacctttgttacagacactaacaccgctaggacaatcgtatgttactacacaccactgacgcagaaccctcccgtacacctgtgtctgatcttggccaaggattcgcctttacagtttgactctcctcgagaacagaaggacagagagggcgggaatggcctcgaattggcaatcaagaagctaagacttggggccagactcatgcaagcgtacacgaacgagcaaatgctgagaaacagtatgggaaataggacgtttccctttgttgaagaatttacctgggacacgctgttcgaacggcctgctatgagaaacaccatcaaaatacatgtagttcgttcggaaaagacggtgaaggaaatccaggaccctgacatagctcaacagaattccaaagggaaaaacaccggcgccctttttgggatagccatggacgcccttaaaagttacggcggacccttcaccaataacgaaaagcctgttcaggcagcttgtatgtttctagacacccactgggatggtaagttgattagaggccacgccgcattgggtgggggtgacgacagcattaagctcgccatttttgggtcgcacgggctttactcatggcctacttgtctcgagcaattggtgccttattttactgatgagacaagatcctccaccagtgaagtcgccaacgactgtaatgagtgtggtacttactgggaatgtttgactatcacgttgggagcatttatgcatgagattggtcacttactgggttgtcctcatcaggaaagcggtgttatgctaagaggctataccactttgaataggtctttcttgactaaagaggcttattctgtaagaactaattcaactggtgctagtcctcccatcttccccaaggaagaatgtacctggaaccgtctcgatacggtaagatttttgtaccacccctctttcactttaccacaggattattacgatccatcgttcatgagacctacaaaattgggcggataccccaatataaaacactctgtatatcctttgggtaacggcagttgccgcatattatcgcccacaggaatctatttgattgaaattatatgtgatgatttggccaggggccatattgaatacttgccggtttccctaggtggacaggggcctcaacgggaagttatagtaacattagatgatttacgtgccaggttgcccaagaatgaactcgccaagtttggcaataccttcaaattgaaaattctttctgttaatgcaccggaaaccgagttcgacaagttcccatctttgttagatgttcagccattagacatgtcgaaatatgggttttctaaaaatgttcaaggtatcaaatcaccactttatggtcgcagcgacggtggtaatgctgtcggcgtcgtcgcttttgatgttagattagtcactgctgtgagaatataccatggctatgcattagatggtgtgaggttttattacaaggaaaaaccaactggaacaaaggatgctcccgcatccaagccctctgtaccaccaagaaattatttctcaaaaattacacatagtatcaaaaatcatgcttcaataaacgaagaaaatctaaaaagtgtactctttggacatgaaacacaaaattttacggatgctacactagaaccgggtgaaataatcattgggtttaatctgaggtgcggagcttgggttgatgctatccaaattataacgagtcatgggagaatgaccgacatgtttggtaacaaagacggaggtgggttcgctgaattgcagccacctaatggccaatatatcctaggtgtgactggcagagtcggtcaatgggtcgacgccttcggaattatttacggagctttatagtaattagtcaaggttttttttttcttatttttttctatttcataacttagtcatatcaaaatatatctattaaattattttccatatatacgtagatattcttcatttgcataattctttgggaaaaaggaaaacagttatagaaaaatataaacaaaaaaccgcaacacttcatgattgcgtcgaacaatataccttaaagaagaaaaaaaaaggttggttttatcacttcattagtctatttgaataattcataaaatatttctgatttttttttttttttttttttttcatattattttaaacgtgactttggctgcgattcatggtttttgcccttatatcttcgttgtcattattatcagcattattaggataatcctttccatgtaatagaaaacttttatttttcaacatggataacttttcgtccactttatctatttcaaaaatttgccttggtgtagccgctgacttctttacattaggtacattagaagccgctttattgttgttagccaaaagaggattcacgttgttttgatttggaacaaccctgggacgatgtatcgaaattgaggtacctccaccatctaagatgttattagaagtattagtggccataagtggtgcagataatggtattctcgaatcaccattttcattcttgatgttaaagttgctcccaatgagagtggtattattgctgccagtttgagcactaacgctattcttgggttgttctgataattcactctgggatgaagatgcagaagtaggattagatctttttcttgacaaaaagtcacttgcaaagctgcttcttgcacttggcggagctgttggtataacagaatatcttctttcattataaacaaggccaacctcctttactctggtggtattcaagtccgtttgtgggaccttagaaaatgaatccgatgcttcatcatactcccataatgaccaagtgattccatatggttttggttctaggcaatatacacaatgtaatgggacatccaaattggcaataatacccatactcaagttcataaaataacccaataaggctcttgccaccacccggtgtgtaataataagaacgttatcctcgattctttctagttctgtgataacaggtctgagtctattaataacgtccatatacgattcaccgccaataccagggtatctgtatctcaacttatctttctgtcttttttcgaattcttcaggaaagttgtttttaatttctggatatgtcataccatcataatcacctgcacttaactcatctaacattttcatttgtttgataggataatcatcttcgttgaaatattgagcagtccctatagtcctagcacgcatgctggtccaaacgaaaaagtcattataaatgttcccatctgtattttcattattctttttttgttgcatgagattttgataaaatatttctctctgtctggcaatgaattttggtagacttttagcaaatcttagaccacgaggagtcaaatgggaatttccgcctatacggccactaacattatcttcgctctcgccacttctcgttatccaaatttgtctgtcagccaaattgaaatttaacaaataatataccgtctgcgaagctaaaaacccttgaatattgtatgcgatgactttctttcccacatctatcattttgatgtactgcaaattttcgtcatcctcaattggttcataggctttcaagtagtttgccaggcgacttttaaaatcttttaaagagctttcaggatctttacctttgtaatctggaccaaataatttgagtctaatatttttctgtaccagtgcatgatccgaacaaacagattctaaaaataaaaccttcaaatgaggacttctctttctgattctagccagaacgttttttcttctttcacgagaggtatttgtagcatcaaaaattcccacagatcctgaaccttctaataaataatctagcaattcatccagagtatccatggcccatttgtctctcaacctagtagagtcggcgtttttcggctcgaaaaactttgaatcctggtcctttaggccatgctccttagcaaacttccttctagtgttaccgacattaaacactttacaatagtataaagaataatttaaaaatctggataatttatttgtaataaatgactttcccgtagctggcagtccgaccatgacaatcactaactttgatccactatcttcctttgatatgagaccatctggagatgttttagactttgttaaaccaggaacatcgatggtggtaggtcttcttttatggtgtctcgtaggtgatttaatgtctttcaaatcaatccgagttacctcatttgctccatctgaaggaggcatgtagtcagtagtatcgtttgtgggaattttagcattttttagttgcgtttcgtcgttaatatgcaatcgatgtagcgatttcaaattagtagcgctattttcaggagagtcagaaggtgtattttcttcagtgattccaggagagttccaattgctcgatataggagtatcgctcaaaggtcttttctgaaaaagtggtaagtgcttagataattcatcatgcggacccttttcagcatcaattttatcatcggaactccgggataaaagatcataactggagtcttgactaggtgccacatggtgtggagattgtgtaggagcaagatcaatatcaggcggcacaggagatgtttcagagaagtctactggtttgaacatgagcttttattcctcttgcctttgttcccttgaataaacccttcttctacgcctcttgttattatttttactcttttagcttatggcacaaaagtacacaaatagatactaaaaggcgaaatttatttcacttgatttacccgtaactgaatacttgagtttgtctatatatatatatgtataccttttattgttaaaaaaagaatatgccaacaaaatctataataaatagtccatgtactccactataaattaatttgctattgtcagtaatggcgcgattaaaaataaataggaaaagaaatctctcctcaaaaaatcttatgtcccctaatttccgtatgttgtgattttggtattcagagatgatcacgtgatataaacgtgattattattatcggtcgggtatcccactcgtataatatgacaaatacgttcgatcaaaagaagggtaatactacttcccaaaatggaaatatcaaaacgttagaagaattacaattatagctttggtaacattactgatctaaaagagccttagctcagcccgtttgagctgtatagatatttttttagtttattcgagagaaaaccggtttttttgttagtatcttcaacaaaattttcctaattcaataaggacttcaatttccatgtcttttctacaaaatttgtatgttgctattttcttttctacttcaagtattattgttcatcttttattaacaaactgggtatgagttaccttttgaaagcagtcatataagtcccggccaaacaataagatctactagaggtttcaagtggaatactgccaatgcagctaataatgcaggctctgtatcgcctactaaggcaactccccataacaatactattaacggcaataataataatgccaatactattaacaatagagcagattttacaaacaatccagtaaacggatataatgaaagcgaccatggaaggatgtctcccgtcctcactacgccaaagaggcacgcccctccgcctgaacaattacaaaatgtaacggactttaactatacaccatcgcatcagaagccgtttctacaaccgcaagcaggtacgacagttacaacacatcaagacatcaagcaaattgtggagatgacactggggtctgagggagtccttaaccaagctgtgaagttaccgcgtggtgaggatgagaatgaatggctagcggttcattgcgtggatttttacaatcagattaatatgttatacgggtccatcacagaattttgctccccacaaacatgcccgaggatgatagcgacgaacgaatatgaatatctttgggcatttcaaaagggtcagccccccgtttcggtaagtgcccctaagtatgtggaatgtttgatgaggtggtgtcaagaccaatttgatgacgaatctctttttccttccaaagtcaccggtaccttcccggagggattcatccaacgagtaattcaaccaattctaaggcgattattcagagtttatgcgcatatttactgtcatcattttaatgaaattcttgaactaaatttacaaaccgtactaaacacaagttttagacatttttgtctttttgcacaagagttcgaactactaagaccggctgattttggtccgctgttagaattagtgatggagttgagggataggtagtattgtatatttatataagtctgcttgtaggttgtattcttccatgcatgggacacaaaaacaaaaatacggaaacatattaatataacatatggatggaaggaaataaaaacattctagtttactatacttgtatttatgatttgaaatcgtttattggagtttgaatataaatattgggaacttgatcttgtaattcagaatcattagtatcaggtaatgaagacatggatgtattcgtatttgtttgattgtccaattttggtgttaccgtggaccccacataattactatttatatcatcgttttcatcattttctaccattgtgctattggcattactcagctgatacttattaatgctggtatggttattggttagcttgggtttcccatctgaattcaagtttaatttttgtgttatgaatttatacttgtcttgtatattcgaagtagatgttaagatcttcaaattatcaaaccaagacatcattgattcataagaatcggctttaaaaacccaattgtgaccacgacgaattatgccgttttgcttagcatgcaacacaaacttagcatccgaaccagtcgaatttggtgatgatgtactgtttttccgggaatgttccgtcacagtacattcacttaatgctaacgacatcactggtactaaatctttttttctgtccgcggtcttgaattcatgtaaaaagttcggtgtcagcacataatacccttttgaataggattttagaaattttgatcttctttctaaaaaccctgatttgatttcataagtcaaaggatcgaattggtatttgtaaacgatttctttgaatgtcctcatcggtagattaggcaataaaaagttgggatcccttgaaatgaagttatcccattcaaattgtgggtcaacgttgaaaaatccagaatctaatttggatatcaatatatcgaaaaccaattgtgcttcttgtcccagtaatctggcatatattgttaaagagttttgaatttccataactacaattttttctaattcagcgcctgaagtctctaaattatcaaaagcttcatgcagaaagttttcctcctgaagttgctttttaatttgtctatcaagcgccagcttggttaagaatggatcttgttttggcactgaatagcgcgcatcctttaaagactcctgaaattgcttcatggcctgttttgtttgttgtaactctttggaacaagaatttttgaaatccgactgcagtgattttatttcctttatcttgactattagatctctcctcaagtcttccaaacgaggaataacatcattggtcaattcccttgatgccttagacgcgctggatgctagggattcatgatactggttcaaaattgttggtaagtcctgtatcgagccattacccaatggcaaaaaaaacttttgtactgatttatcctcctgcgagcttggttggtattgattctcgatcgaaaagaatgggaattgtacagcatgtgataatcttagttgctgtctaacaatttcatcctgaatagaagcgatttctgttaagtaaacgatcaccgacttgatgacatttctccaagctgaaaacctcgctgcaagaatatctgttggttgcgcagctgtagggaccagtattactaatggagatctaggatcttgttgttgttgctgttgctgagcaagtctttgacgttgtaaggaagacctagccctcgacagtattgaagtgttggttaaagagtttttcccttggagctgtttcccgttgttattattgggatctgggacagcaatggttacattggtgttcgagtcgatattaggagaaccattgcttatgataccttgcaaccctccagaattcatcgtcagcgtcctattgttttgaaacgttgaattactagtggaaggaactggttgtccattcaaatagctttgttggtttatatcggatgtcaaactgccattttgaaagcttgcgctctgctgctgttgctgctgctgctgctgttgttgttgttgttgttgttgctgttgttgtaaaacgttggcatgatctgctgaagtcatacttctcgtatgctgctgcaagttatgcaggtgctgaagatttagctgttgctgtgacagcatatcagagaccgcagaggtcattgtgttgtttttcgacatttttttttcttttaatgttgtattcttttattgttaactactttttttctttaaaaagcttcaaaagaagatgaccaaatgcagatataagaacactctaataggttgtaccaattcaagggctcaacagatgtcctcgttgtttttcccccccccagcttggatcgctgtcactcttcaaggcttgaaagccttctcccttcttcgatggaatacgtaatgccatgaggggaaaagccgcgggaagagaagggtaacccaattttaggcccctgcaggaacgttaatcaatatatactctatctaatgcagtaatctacgctaaacattcaaatgatcttcattgtgggttctgctgctgctctcggtattcagactctgccaaaatttccatctctcttatatttagtgtctcccactcaggttcgccagtttgttcgttgaacgatgcaatacattcaaattcaatatcctgcttggaaagtgactcttgctcttttctcatttccaaggccagacttcttatgacgttctcactaccctgagaaatgaaccacgcagtcagatcatccaagagaactttgtcgtagacgtagtaaacatcatggaaacgaaatgtttcatgaatgtccaaaagcgcccttatgactagtctcttaccacctcgtagaatataatatacgaatgtccacgctttcattgctaggtcatagtttctatgtagtggataactcagggctctcctgatacctgtaatgattgcaatcttgatgagagagctgtctttattaacctttgatatttctttcataccgtcttgcagttcgttcacctgttttaattgttggtctaagaatgatatttgagggcacaattttcccatggtccaagcactctctgtggtatgagtaccttcgttttcgatctgttcaaacacataactgaaaagaacgctgagtatagtgacataaagtggttttatatcttccacgagataagacttcttgggtaaattgtcctgcatctgtttttgttcctcgtcagtaaactcaattggcatgaccagatttgggttcgtactgtctttgtaccattgcaggtattgctttacgatcgaaggtgtaaacttcagtagttctttaatgccgttaatttccaagtcttcctcgttaccgtatttatgtgtcatatactcggaaacatagtactcaggatcaaacttcaaattttcttttcttaacctttcaataactctatcgttcgcgtcagtgtgttcaggatcgtctaattcattgatatcgttcccgttgcttgtcgacactgatataactgtatcatataagttatcaaacccatattttgtcttcaatattccattattggtgctggaatccatcttttgctctatctcccaattaaacccctctcccatttgaccaatagtcttcacatcatctttaatattattcgacacgccatcagtttcgacctcttgaataaggggcttttgggtttttttcgcatcagtattttctgttaatgcatcggcacctgcaagatcgccttgcctagccaacaactttgtcggtaggtccaaatcttcgaaatattcatttttattcagtttggctacttttacattgatgcattcatctttggaatcgtattgagcggtagacctctcatcatcgattaattcgtgaggaaatcttaatcttaaatagtaaggggataagtgaaaaatgatcatattttcttggatgattatctctaaacccactgcactgaacctaatattacttatgaatattttgagaaatataaattcctcatcctgtgttatagagaatcttggtgttatcattatagttcagaagtgatggtagattatagcaagtattcttcttttgtgaatcttaatattactctgagcacttgacactgaatatttagtattcaaaatttttcagctgatttttgcgatgcgatggtgatgaaaaaaaaaacatgtagtagtaataacaatcaaataaaataagtgaaatctcatgaactatctgctgcgaattttaaggataatcggatagcttgaagcatttctttttcgtaatgagtggctctacagaatctaaaaaacaaccaagaagaagatttattgggagaaaatctggcaacagtaataatgacaaattaactacagtggctgaaaatggcaacgaaataatccacaagcaaaagagtagaatcgccctaggtaggagtgttaatcatgtgccagaagatatattgaatgacaaagagttgaatgaagccatcaaattattgccctctaactacaactttgaaatccacaaaactgtgtggaatatcaggaaatataatgctaaaagaatagccctacagatgcctgaaggtttgctgatttactcattgattataagtgacattttggaacagttctgtggtgttgaaactctagtaatgggggatgtgtcttatggtgcatgctgtattgatgattttactgctagggcattggattgcgattttattgtgcattacgctcattcgtgtttagttcctattgacgttacaaagattaaagtactatatgtctttgttactataaatattcaagaagatcatattatcaaaacgctgcagaagaattttcctaagggatctagaatcgctacatttggtaccattcagtttaatcctgcggtacacagcgtcagagataaactgcttaacgatgaagaacacatgctgtatattattccaccacaaatcaagcctctatcgaggggtgaagtattggggtgtacttctgaaagattagataaagaacaatacgatgccatggtattcatcggtgatggtagatttcatttggagtctgcaatgatacataatccggaaattcctgcattcaagtatgacccatacaacagaaagttcactagagaaggatacgatcaaaagcaactcgtggaagttagagcagaggccattgaagtcgctcggaagggtaaagtttttggtctgatcttaggtgcattaggtagacaaggtaatttaaacactgtaaaaaacttggaaaaaaacctgatcgcagcaggtaaaaccgtggtgaaaattattctaagtgaagtttttccccaaaagctcgcaatgttcgatcaaattgatgtttttgttcaggtcgcatgtcctagactgtccatcgattggggttatgccttcaataaaccactattaacaccatatgaggctagtgtcttactaaagaaagatgtcatgttcagcgaaaaatattatccaatggattattacgaagctaaaggatacgggcgtggggaaactccgaaacatgcgattgaatagtttaaatagtttttgttgtcacttgtcttcctgttacatatgtataaatagttagtatcatattcttcggagcatcttttctattgtttaaacgtttttgacggcttgcaggcgaaactaaattgtctaaaattcaaaacaatgccttctaacttgatatcactgctggtcaagcctatttttattctggtttctcaggcaaacccaaatgatattgtcaaatttttcactgagtttgccaagcatatttccatggacttttgtatggaaaccgtgatgagaaatccgggatttctcatcgaggaaagaagtgactcgagcctcttaaggcttagattaaacttttttctttttatcgctgcgtataagcaatacacctaaaacagaaccagttaaagtaaacccgatcaacagtaagaagatgggcaggaaaattgcaacattgctagaaatggggaagagtaaactcacaactggattggagttctcgatctcgaagataggcaggagcgaccatatgacataataagtaaaaagaaggcaaataattacaaaacggttcatgaaactaaacagacgtttactatgcccaaccggtgactattcacatttttgagctagtattgcatttagagtacacgcagtcatcaacagtttctttgtatctctttcaaatatattcctttacacgggaatgctagcggaaatgaatgtaaggcggaaaagctctccgtgcgaaactattcttttagacactgaataaagttgtagcctcattccataatctgggtcagattttatgaaaatgtagttatttctgttagttgctgggttctacgatattctgctgcgtggtttagctttcatacttgatttttactccttcatcactccatataggttggatatggctgaatctgtttttatcgaggcacccttatgaacataaacaacagtatcccgtctaagaaatactttcgctacaatgacttcgaaaattaggagttgactgtggcttcaggtcatcacattgagttcagtatattccatccaaacgtcgaggcaggttgccgttgaagatgtgctggcccgcttacaggcccatgtttaacagcaattgcaccacatgcatgtcacatatgcatgtcacatattagccctaattgtctagtggaattttcgcagtaagaatcaaatgtgtttaaaagtcatagcattgatgaacagcttactcgtatctctctatttgatttggacaatagcttgagcaaacgttggcaaaacagctgctctgaataatggtcagcaattaaatttgctttttttgcgtacggctgttcagatatactattgttggaataataatcaatcgtctattgactaatgttttcatacgtattattactgccttcatgaaataagtaaccctaaatttttatcacaacattctaatgttcttcattttctgtaaagaaagagcaggactgtggcagaatagtaccattttcatcagcaaatgtgaggctatgccattatttgcgaatgctatgaacctactgcgttgcattctccaaggttcccgctgggtgggtcgccactaactcttccgtgtggccgtctattgctgatgcattcaaaccatagtcacctgcgatagggttagttgtgtaagaggtaaaacagtgaccaggtgttaattcttcccagttcatcaacaagcttgctgaaccattgctcattatagttgttatactgcaggaatatttcatctcgatatctacttcttccagaaaagaattttttaaacaataatagacctcgaatcgcttcaattttttgaacttttccacctttagcatctaacttggttctttaattacgataattcaggatatgcgcaagccacctacagattatagaagcagtcgagtacgaatcactgtgaccgtcatcctagataaatagtatagcttgatgaagagtactgaaccaacaagtacgagcttctatggccaagttggtaaggcgccacactagtaatgtggagatcatcggttcaaatccgattggaagcaatttttttcttcggcacgtcatacaccttgtaatgagtgtactaattctctcttcaaaaagatcattgtatgttttatgttttgtctggaaaaacatatagtacggatatttttgaaaaactttgaaataatatgtaaattatgtaaaaaaattaaagaaccattataaaagaatattaccaaaaatgtaacagatgacatttttattgttttgagtttgttttaaatttgaaattgttcagtgaattgttcgcccttggcgaaaaagaggtgtccatattggtatttgtattatgagctggtcgttggttttgttgcttataaacttcgctagcatatttcaaaaaatgatagtgatcatcaccataaggttgagggaaagtgggaggagcaggcgcgattggtgaagaggggacgttgtagtgtcttggagactggtactgagaaggaactgggtgaatgtggtcgtaagtatagtttagctgccgctgtggcgacgagagctggtttggtgggggtaaagagtatctttgctgtggtatatagatatttcccggatatgaataccggtgaccgtgggtgttgtagaaggatgctaggtttgacaaaatttgcaccgttggatctcttggccctattggagaagaagtttgagaggtgtatgtggacgacttttgccttttgctgttttttttaatgaagttcttgtcatttgaggaaaggcccaagttttctacaaatgagtcgaatgagggcaaggcgtcctcaataacaagtttctgcgctttggaatgggacatggaagtagatctttgtcttggcctgggtctgggcttctgcctaggtcttgccactgcagtagacgtaaaattggtacttgtattagcagcagcagtagcagcagtagcagcacctgcaccagtggtagaactagcaaatgtaacgttttgatgagccaaataccacgattcgcaatctttggggaaatctggaccaaaaataggcaccagaaagtatctgatcggaaaacaaaaccgcaggcatagcaaccttgagatttccatcggcaaccaagtaccctgaattttgatgtaaccacctcttattcttttcgtaaaatttgccggatttaagttgggcaagtctatttggtcaggaccaagttcattgatcaggaagtctttgtaagactggcaaataaggtcccgcagttcgggcttgatgttgttccaatgaaaatcgatgtaattgtttgcctgcgttgaagaagtagatgaagaagacgcattggcgtccaagaaggtagaccctgtggatgtccgtctctttggcggcgaagaggtggaggacgacaacagtacgcttgaagattcctcagaagtgaacgaactgtgattgtaaaagcaaaaagatagaattttctcgaattcagccttgcaaaagaactgctgttggctagtggaaacgctgtcacctctgggcaagtttataagccccttcataacatcctgatacagccgccagatgcccgtcatgaacacatagccggagtcatgcgaccatattacgcagttgttagggttgatgagcttgtcattgatcagattatggtccattttggtcaacttgaactgctgattctttgtcagcgaggaggtggcattttcacgcgatgctgttgacagagccttcttttcttgcttggtgggtgatgctgagactggtgttttgttagaccgggaaggtagtatgatcttacccatcagaatatttttatcgtgcagatgcaaggcggagtgaggagtggcggagctagcgagctgcgatagcaacgtttgttcgtggactaggctctgaattgtttgtaggttgggaaactggtactcgaagcagttcagaacgttctgcgccgccgcctcttccccgttccctgcgtcccgagcactgataatgaagtttggatgtgtgaactgcgcagcaatggaggatttatagttaacctttctaatattgagtccggcgctgaaactggccggcggcgagtccctatccagtacgctgacgaggtagagacgctgatagtcgtccagggggttgtccgttaagtgtaccgtgtcactgttaatgctaaaagcgggatatttcatgttggagaaggtgtctatgataaggtattttgagcttgccgttgtgtggggagaagaactggatgcgtaccgagaacgagcaagttaaaacactagtacacgaataatagatatatatatgtatgtatatatatgttgaagtgtgtacacacgtacacgcacaagctacagacgccacgcggcccggcattcatatatgtacatacatttatgcacatatatatatatatatatatgtatatgtaaatgtatatatacagcttgtgatttcgcgcgccgaatgggctgaaaagcacagtatagtggagaagaagagagaggagaaggggagaggggcaatagcaatggatgtggtagaatacagggaaggccaagctgttgttcaatggatgcggttcgaggcccagcgcaaggggggcgcttcgaagcatagaacattatccgcggaaacgggtattaggggtgagggtgaataaggaaagtcagggaaatcgggccagagtaacacccattcatagcactcgtacaaggtgcttttaacttgcctgcatgtgtggagtcacaaattaggggactcaggcacagaagcaagggtccttttttggttccctgtttcctcctgcgcatttcgtattttttctcatctcttggctctggatccgttatctgttctgttacacaagaaatcgtacatttacaatatagtgataatcgtggactagagcaagatttcaaataagtaacagcagcaaaatggcaagacaaaagatgttttataacaaattactcggcatgctcagcgtaggattcgggtttgcttgggcgctcgagaacattactatatacgaatttgactttggcaagggcattctcgatcaaagctacggcggtgtattttcaaacaacggcccttcgcaagtgcagctgcgggatgcagtcttgatgaatgggacagtggtatacgattcaaacggcgcttgggacagtagtgcgctggaggaatggctccagggacagaaaaaagtttccatcgaaaaaatatttgaaaatattgggcccagcgccgtgtatccgtctatttcgcctggggtcgtgattgcgtcaccatcgcaaacgcatccagactacttctaccaatggataagggacagcgcgttgacgataaacagtattgtctctcattctgcgggcccggcaatagagacgttattgcagtacctgaacgtttcattccacttgcaaagaagcaacaacacattgggcgctggcattggttacactaacgatacagtggctttgggagaccctaagtggaacgtcgacaacacggctttcacggaagattggggtcgtcctcaaaacgatgggcctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaagtcgctgtcgtattttaacgcctcagaacggtcgtctccctttgttgaagaattgcgtcagacacgccgggacatctccaagtttttagtggaccctgcgaatgggtttatcaacggcaagtacaattatattgttgggacacccatgattgccgacacattgagatccggactggacatatccactttattagctgcgaacaccgtccacgatgcgccatctgcttcccatcttccgttcgatatcaatgaccctgccgtcctgaacacgttgcaccatttgatgttgcacatgcgttcgatataccccatcaacgatagctccaaaaatgcaacgggtattgccctgggccggtatcctgaggacgtatatgatggatatggctttggcgagggaaatccctgggtcctggccacgtgtaccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagctcacgtgggaacagacggggaactaagtgaacaatttaacaaatacacagggtttatgcagggtgcccaacaccttacctggtcctatacttcattctgggatgcctatcaaataagacaagaagttttacagagtttgtagacaaaaaaaaaaataaaaggaaagcgagaagtatacacaagtgtatttcctagatatttacatcaaatatatatatatacttatttacaaaactctgatattataaattgattagatactatgtcggaacgtccagcccaaccacgtttgcagttcttttcactttctcatcctgtgtcaacttgttgccaggattgtatctgtcgaccagctcctcgtattctctttggttgtccaagaacttgatgatgtccaaagcgtgttcgaatatctcgtcaacgttttgtccctgggccacctttttctcccactttatatcgttttgtaatatggaacgtaatgacttagagtcggctataaacaaattcaaagatctgtcgcttaccggatctagttttttccatttctctaactgtctgttgatgttctcatgcgagtctctctgattttgtttcttagcatattccaactttgttatcattgcctttcgtagattgccccaattgactatcttgcttggcctttcatatttcagaatggctcttatgagtcctctatatgtgcgtaatgttcttggtctatccatttccctggcactctctctttctctctcttttcagctttttgttatccacttatcgctgcaaatgaaactctagtgcaatttgagatattcactttttgcaaaggcgaagagaagggggtggttaaatctacaatttcatacataaaacagagaaaatgattataaattataggaaagtaggtaagccatggcagagaaatcaatatttaatgagcctgatgtggatttccatttgaaattaaatcaacaattatttcatattccttatgaactactgtccaaacgtatcaagcatactcaagcggtaattaataaggaaaccaaatcactacatgaacacacggccgcattaaatcaaatatttgaacataatgacgttgagcacgacgagttggcactagcaaaaataactgaaatgattaggaaagttgaccatatagaaagatttttaaatacgcaaatcaagtcctactgtcagattttgaacagaattaaaaaaaggctggagtttttccacgaactgaaggacatcaagtcacaaaattcaggaacatcgcacaatggaaataatgagggtaccaggactaaattgatacagtggtatcagagttatacaaacattttaattggtgattatctgacgaggaataacccgattaaatacaactcggagacaaaggatcattggaactctggcgtagtgtttttgaaacagagccaactggatgatctcattgattatgatgtcctcttggaggctaatagaatttcgacttcgttactacatgagcgtaatctcttacccctaatttcatggataaacgagaacaaaaagacactgaccaaaaagtcctctatattagagtttcaagcaagattgcaagaatatattgaactactaaaggtggataactataccgacgctatagtatgttttcaaagattccttttaccattcgttaagagcaacttcaccgatttaaaattagcatctggacttctgatttttatcaaatactgtaatgatcaaaagccaacttcttctaccagctctggattcgatactgaagagattaagtctcaaagtttaccaatgaagaaagatcgaatatttcaacatttttttcacaaatctttacctagaattacctccaaacctgcggtgaatacaacagactatgacaagagttccttaataaatttacaaagtggagatttcgaaagatatctgaatttattagatgatcaaagatggtcggtattaaatgatttattcttgagcgacttttattccatgtatggcatatcacaaaatgaccctttattgatatacctgtcactaggtatatcgtctttgaagacaagagattgcctgcacccttctgacgatgaaaatggaaatcaagagacggaaactgccacaacagcagagaaagaagttgaagatttacaactctttacgctacattcactaaaaaggaaaaattgtcccgtttgcagtgagactttcaaaccaataacacaggcattaccatttgctcatcacattcagtctcaattatttgaaaatccaatactattaccaaatggaaatgtttacgacagtaaaaaattgaagaaattggccaaaacattgaaaaagcaaaacttaatttctttaaatccaggtcaaattatggatccagttgacatgaaaatattttgcgaatcagattctatcaaaatgtacccaacctgaaatagtttcaagctatatgcatttttttatataaagatttgtccaactttcacaactattttacagatacttacgctatataagaattagggaaaatgaaagttctttcatcaacatggcgacattcttccttctgtacttagtctgaatcagaatctgtgtcttttttgcttttacggttatgttttgaactattcgagacatatttactaaagatgtagaacctagcatcacgttctttcgcaggttttgtagtatcttgttcgctattcgttctccggtgatgatatcctggaaaattttcccattggaatttgctcgatctgctcagagttagtccattttttttggctaaaagtttgatttgccatgaatcatagggctctccatcgaaaagggacagtatgatgttaccataaccttcggcggtcaattttttagcctggggagtatcctcattaagatcatagccttgcgtataacgaagagtatcattttgaattttcgtgtttataagattaaataattgtaaggaattttggaaaaagttaaaaattaagtcctgatgctctctaatatttctttcttgatccttaataccttttccattatggggaaaattgaaaactatattttgtaaaggtttgttaccccaacgatgatcgctaagcctgttgattattttaaaccaagtattatttttggaaattttaaagctctttacgagcttcgtaacgtcaatctggaaaaatatcggaatatttagatcttttaagtactggtaattttcctcaaaagtatgcggatatttcaatttcagctcattcacagaattatcgtaacttgttatgattaaattgtcactttcaatatagttttgttcaacaatggatctggcaaaagaaaaatctccttcaccacatagcatcaaagtttcatccttctcaaagggcataaccttcccttgattaagtttttggaattcttggtttctcttcacggttttgttattagcgctcgaatttttctttcttagttcatgtttttgcttactttcaatattcctcactaatttcactttggccttgtgccttaataatgcaccttttaggcctttactcccaatcttacccttcaatttcctggccattgataattttaggttatgattggtgttaatctatgattttaacgttactaaacgttgtcaggctccaatgaatttaagtaatggaaggttttcttttaagctcatcgcatcgccaattcttttctttttttttttttttttccgaataatttacattctttctacaggagaaaaatatgggagccagcttgaaatactaaaatcattaataatactgatgtacatgatccaataacaagatcaactacgacttttgttattactgattcagaaggaaaaaaaaattgacttccaagaagtcataaaaataagtggtctctagcgggatcgaaccgctgatccccgcgttattagcacggtgccttaaccaactgggccaagagaccaggaatttgttgaagtatttcatgtaaatttaatattagtactgatagagatttccgatatatatgatcgctctcaattattttatatcaagtaaatgtcaatgtcgttagtttgcactagctgttactatttattcttagtaaaggtttttaaaaaaaactgtaattataaccaggcaggcgtatgcagagcgaaggtcttggaaaaagaaaaatatagaacagtacatttaggaaacgctaaaaaagtcaccaagcaggcaggtcacaggctccacttgaacataagttagttcgctaatacaggttgaatttccattgtgggatagtttattatcttcagcgaaaaaaatcttttttgattgaagtgttgatcaagattatttgtaacctcctatctttagttgaactgatccaaaaacaatgaatactccacagattagtctgtatgaacccgggacaatattaactgtgggatctcatcatgctaagattatcaaataccttacgagtggtggattcgcacaagtatatactgccgaaatttcccctcctgacccatatagcaatgctaacatagcatgcttgaaaagagtcattgtcccccataaacagggtttaaataccttgagagctgaagtggatgctatgaaactccttagaaataataagcatgttgtttcttacatagattcacatgctgcaaggtctgtaaatggtatagcatatgaggtgtttgtgttaatggaattttgtgaacgtggaggtcttatagattttatgaacaccagattacaaaatagattacaagaatctgaaatattagaaattatgagtcaaaccgtccaaggtataactgcaatgcacgctctgcagccgccattgattcatagagatattaagattgagaatgtacttatttctcatgatggcttgtataaagtttgtgattttggttccgtttccggtgtgataaggccacctagaaatactcaagagtttaattatgttcaacacgacatcctaacaaatactacagctcagtatagatcacctgaaatgattgacctgtacagagggttacctatcgacgaaaaatctgatatttgggctcttggtgtctttctttacaaaatatgttactatactacgccgtttgaaaaaagtggtgaagccggtatactacatgcaaggtatcaatatccatcctttccgcagtatagtgacaggttgaaaaatttgatacgtcttatgttaatggaagcaccatctcagaggccaaatatttgtcaagttttagaggaggtttccaggttacagaataagccttgcccgattagaaatttttacttgttaagagcaatgaatcagaatgcgaatacccaattggccggtgaaccgtcttcgacaacttatgttccaacacagaaatttattcccgtacaaagccttcagagcatcaaccagccaccaaatatgatgcctgtaactcacgtcagtactactcctaatttgggtactttccctatatctattaatgataataacaagacagaagtaacggcgcatgctggcttacaggttggaagccattcaaatttgactagtcccttaatgaaaacaaaatccgttccactttctgatgaatttgcatcactatattataaagagctacacccttttcaaaagtctcagactttcaaatcagtagaaagtttccaatccccacaaaggaagtctatgcctccattatcgcttactcctgttaataatgacatttttgatagagtttcggcaataaatcgtccaaataactacgttgattctgagacgcaaactatagataacatggctgtgccaaacttaaaactatctcccaccattacaagcaaatcactaagctccacaaaagaaattgctgctccagataatataaatggaagcaagattgtgcgttcactaagctctaagttaaaaaaggttattactggtgaatctcgcggcaattctccgattaaatcaaggcaaaatactggtgatagtatcagatcagcatttggtaagcttcgtcatgggtttacaggaaactcagtgaacaatagcaggtctgcttcctttgataataacaatgtcaacggcaatggtaacaatacaaacaggcgattagtttcgtcttcaacctcctcctttcctaaatttaattctgataccaaaagaaaagaggaatcagacaagaatcagagactggaaaaacgtcgcagtatgcctccttcaattttatcagattttgaccagcatgagaggaataactcgagaactggatcaagggactattacaggtctcattctccagtgaagaaaactcaagcatcagctaaaacgacatcaaagcctactttgataccagataatggcaacgttaatataaatcaagaaaagaaggaatcaattcaaagaagagtgcataacttactaaagagttctgatgatccggtaacgtataaatccgcatccgggtatggtaaatatacagatattggtacagaaacttccaatcgacattcaagtgtaagaataacaccaatcacagaagaaaagtttaagaaaacccttaaggatggtgttttggacatcaaaacgaaaagcaacggtaaagataaatcaagaccaccacgtccaccaccaaaaccactacatttaaggacagaaattcagaagataagaaactttagtcgtttacaatcaaagaaactgccgattgaaagaatttccagcgaagccacagaaactattgttgatgttaacgtagatgatttagaagccgattttagaaaaaggtttcccagcaaagtttaaaacttgctctcacacataatagactatgtaatattaaaagtcatacaaaatgtacaaattttctttcgtcaatcatttgaaattttttgaaatatatcttgtcactcattcatttatttattcgtttctattttcctattatatgctctataatctcgacaaaacgtcgtcaacgacttgttgagtagaagccttaccacctaaatctggtgtcttgatagaaccctctcttaagttagcatcaacagccttgtagatatcttgggcagcttcgttgtggcccaagaattccaacatcaaagcagtagatcttatagtggcgattgggttagcaatacctttaccagcaatatctggtgcagaaccatggcatggttcaccaatgacaatttctggacctacgttggcgcttggaacaacacctaatgaaccgactaaagcagcagcaccgtcagataatatatccccgtataggtttggtgccactatcacatcaaaacattgtggttctctgaacagcctataaaccatggaatccacaatttgttcgttatatttgatttgaccgtacttgtccttgttagattcgtagacttccttacagatttctctgaatagaccatcactttgagatagaacatttgatttatgagtcactgtcaaagtggcttggcctcttgtttgtaatcttttcaaggcaatatctaatgcaatggttgcaattcttcttgttgcaatttcggatattctctttgtggcatcagcaactcttgtacctgtggccttgtcaatgtatgttttttcaattttaatgtacaggtcctcagtattttctctgacgataaccatgtcaattggtttacccttttctccctctacagacttaacaggacgaacattagcgaaaaggcccatttccctccttagagcaacaattggtgaggagtaaccttccaccttagtagttggagactgaactgcaccgaaaagagcaccttgacattgttccttcaacactttaacagtctcatcaggcaacgcctttcctgtttcttggaatgtttggaaaccggcgtagagatcaataaagttgaagcttaggccgtgcttggagttaaggttttccaaaacttgcttaccagcaggaatgacttccttaccgataccgtcaccggggataagaccaatagtgagtgatttgcgagcagcgttagatgctaacccacggcaggcagataatctagtagcaacagatctaaacatctttttgagtgcgttactatcttagttatataaatatgtcgcactaatataataatcgcatagatacagtcttagctaattctaaatcagttaagatgtccttatataactgtagaaccagtttagtttcttgttgttctttcctctaattagagtcatcttaagaatatttttccacgggaaaaaagtgaaaaaaaaaaaaaaaaaaaaaaaaaagagtgggaattttcagtgcagttgaaaaaatcgaggtggaatttgagaacgacaattacttagcactacatgtgttgttctcgtttgtttttaattatatacaggttggttaggtgacgttggagaaaagaggcagcccacctagaagtggaggttctcggaagtggtggattcttcttcttgcgccgtattcaatgtagtgtcgtccttccacgaccctgcagggttacttgtccttgctgccattagttcagtttcttcaactaccttcttttcccagacgtctaggacctcttgttccttttgtataccatgttcaatggcagaaactccaaagagggatccgaacatctccgcttcttccaaagccacttgctgctctgtttcttcttgcattctcaacgcatagaattcatatctggcatggtcatatgcttcgaccatgtccccatactgcttcgttttgattaagtacatagttcgctggataacactttcaccatcgagtggtcttcctatctgaagcatatggctccaatcgtagttttcatcaccaatttcgttttccactaaaatcttaggtctcgacaactcccatggatgttgtttgtaaaagagcgatctgagcctatcctcaacgtatgttagtttaggtggcctgtacagccttttcacgcccacccttttgtcgctcgagttgggtcttgtcttgtaaagtcccttattgttggcatgcggttgttctgttacgtcaacaagttttcctatgatgtgtccattggaaggattcttaaaacgaggttcacgtgtaaacttggttgatggtgggatagacgctacaacgttgtaccacgcaggtgtttctttcaacaatcctgatttcaagtaagcggacgtccgttgaaggacgtttacagcatttgtttgtatcttcatttctcagaattctaagatcttcttcttgaatggtgcgcaatgtccttcttccttttccaagcttctaatgaggttattttcttagacttttgtgcagtatctaaatattattggttttattgcttgtaacttgcacttttctgtaattgccgaagtatcaaagaaatttcaactctcaaagaagatgcgcaagaatgaagaccaaatgaaaaatgtcataaaaaagcagtatattagctgtcttgggttagggtcctcgttcaacagattctttttgcttaatggtgcaaatgagatccaaaaacatggcatacgagtcgggaactaataactatagtgatacaatagctaatggaaataccctgccgccgcgaagcaagaagggacacagtggacgtagaaagaggagcgaaactttgcccatagcgtgtaataatttttgtgttacaagacagattgatgacgatgaacaagcgttcaaaatgctagataaagtgagtcatctgaaaaaattcagtgctgaagacggtgatgataacaatatattcgtccaatgggccgatgatattacagatatcttatttggactatgctgtacaggaacgtttttgaaacttcttataagctctgcattatccggccgggctaagacatggtttgattctacaacggagggaatcgatgaccatgtgataaaggcttacagttttgaaaaatttcttgctctactatcagaagaatttgatggagcaagatctttaagaagggaaatttttacggaactattgacgttgtccattgattctgagaagtcattagaagcatttgcccataaatcgggacgtctaactccatattatctgtcttctggtgctgcgttggatctattcctcacaaaattggagccacagttgcaaaagcaactggaaaattgtgcattcccaatgactttgaatttagcactattgataactgcctgtgaatttgcgaagagagcatctaatcataaaaaataccggtataaaaatacgagggattccgacatttgtactccaaagagtaagaatactgctatcgttagcaaattatcgaatactaaaactataagtaagaataaggttattgaaaagagtgataagaaaaattactttgataagaacagtcaacacatacccgatcctaaacgtcggaaacaaaatgaacctggaatgcggctctttcttgtcatggatgaggaaaagaatattcttacatctaggaatgtttctgccaatgcatacacatcaaaaaatggacacaccaatttaagcgatctccatacgaatcttaaaaacagtaaatctcaacaatgtgcagtggagccaatatcgattttgaatagcggcagtttggttacaggcacaattaatattgacctaattaatgatgaagttttaggcacgaaggaggaaactacaacttatgatgaacgtatggatggaaactcacgttctttgaatgagaggtgctgcgccgtcaagaaaaactcactacaacctataacatcaaatatatttcaaaaaaacgctgaaattcagggcacaaagatcgggagcgttctagatagtggtatatcgaatagcttctcctcaacagagtatatgtttccgcccacaagctctgcgacagttagtaatccagtaaaaaaaaatgaaatcagcaagagtagccaggttaaagatattgcccagtttaatccgttcatgacaaacgaaaaggagaaaaagttaaatccatcagaaagcttcaaaagccctggagtgtctatggaaataaataggctaagccgtatcgcgggcctcagaaatattccaggaaacatttacgaagacagcaaaatgcttaatttgaaaactcgaaagtgctacccactgcataactttgctgtgcgcacgaggagtgcacattttaatgaccgtccttctaattatatatcaccgcatgaaaccataaatgcgactctccgatcacctgcaagctttgatagtattcaatgtattactaggtccaagagggtagacgcagagaccaataaagcaactggttcagcaaaaagcgaaaatatagaaactaagagcagaaagttccctgaagtaataaacccttttcttgtgaacacaacgaacaagaaagaaagcgattaaaagtatttgtgaatgataatattcttcattgtgtactctatacattgtggcagtgctaatatttatttaaattcataaatttccttttgtgcatgcgataatacagctgctcttttcgtccccacaattctttcgagtgaaagaccatcaagcttgctataaatgcatctaacagtggatatgtttaaatcggtattacctagaaaggcgttcttaccaataaatctgacaacttcattgtaaaattcaggattgtttggaggcttataaaaaacgacgctcttgacacccttgatttcataacgtctataatggtgcagtctttccgtatacaacataacttttagacgcccctgttgaaacaatgacctatttgcattgagctgtctttggctagagtactcatttatatccccaaataaaatcgtcgtcttctctttcatgtagtttctaatacgaatgaaatcagtgtaatcaggaatgtaaatcagtattccgtcttcatacccggtggatttgacaataccaggaatgatgacacttgtaaaaaatttaaatctgtagtcaggctcttcaataatcgaattcccaataatgtcaaatctttgaaagatttgcctgattttcaaaccggattgcccaatactggagttttctgatcctattaccttgtgattcttccatcttcctgccatgttacggcatctaccattgattaatgaattagccgctggcgagatgtattttgtgaataccattgtctgtctgaagagcttagcttgttcattaatgtaccacatccgaattctgctaaagtcagcttcatgttgttgatccgggattttgttaagatggtcaaagatggtgaaaatatgagatatgttctggtattctattgaatgtaattgatcaatcaccatcaactctattgaggacaaaaaatcgtcctgcctcttttttttatctgtattttctaagatcatttgaatacccaatggcgaacatacaataatgtcagactggtaaaaattgctataaagttttatagcctttcttgtgaatttgagaccgacaacaaaaaaatcgttggtgttccccctaaatatgtgttggaaagattttggtttggactttggaggtaaggagtcgtcacggaattggtcgtagaactttcccttcttgtcaacctgatctataccagattttgaaattatcttatctacaacgcggtacgccacctctctagtagggactacaattaacacttttggtcttgtaaaaccttgatctaggtgttcagtgtctgggttatcctgtaatctttgattatttttcaagattctatctcttgtcttgtagatgtgattcaaaacatgcaaagcatataaatctctgtactcgtcttcgtccttttcgtaggagtcatactcgtataatatgtctttatactgaaacatggggtctactaattttttttgcaaagcagtcaatggatcagtttttttatccaatagtccattttgcacttttagcctttgtttcaaaaagtatgaatatatagatgatgacctgtacggactttccaccaatgcttcctcaccaattactaccggtttagcatatatatatgattcactgtcacttagtgagccctttacggatttgtattttacacttttggtcttgaaagcattcgacaacttatcaacgaatttctccggaacttggttgaaatgagactcgaaaggatcttgctcatcttcactgtctatatctttttcgtctccactgctgtcatcgtcgttatcatcctcgtgattacccaaaaggccattctctatctccaattgatcatccactggtccatgttctgtattttcgtgctcatcctccccaacttcggcaggagctttgttactctcgtcagcctctcgccttcttctttttggctctggatgttcagatttgagaatcgtcaataaagcgtcataaactttttcctttttaccctcttcatcctcaatatcgaaatcatcgccactgtcgacatcggacacttcatcctcatcggatctatggtcaatatcttctgctacgtcctctaatgtttctgtgcttccgccttcagttctggcagaagatcttttaatcttcctcagttcttgtcttcctcttttccgatagccacggaaattatcattcttttccctcacagaactgtcactcattacaatttggtcacttcgcaattataccaccgtctcactgaaccaatgcagtttattccctgtattatattattgcaaaatatgcgatgagctaaattatagtagtattgcgaaggaaaaatttttcagatcatggtacacgaggaatcgcatcagcttgaagcgaagcaagggactggagcggttactggtttcggagagatgattgatgagaagatgaacataggtaaaggatcgaggtgtagtgatactggaagggctgtgcgtaaagtgttggtggatcttatagtattcgtgaagcttctttttccgttttgctcccctcagcccatcgcgtaattgcttagatctattagagaggtgctgtttgtggccgatcacgctaaagattaggcaacgatgaccagtttgtccaaaagcttcatgcagagtggacgaatctgcgcagcatgtttctatctgttattcacactactttcaattccaatctcgtttaaagttggtggtttggaatgcgggctttccttcacggtgacactgttcactttatatttcataactacgactcttaacgtgttggcaagacgacatggaggaagactatacattttttttaccaactgtctgtattactcacaacattttatcattgcatctttgctatacctgtttttgtctggattttctaatgatgagttgggaaacgttctgaaaaataaatataatgagtcggagtcgttcctggaagctttgaaaaatagcttgaattccaatcaaattaactacgtcttatattattactactatcgatttgttgtacaaccgtggcaattcgtgcttaccaagtccacacctttttttactctatcggaaggttttttcactattttagccattcaggccgtcggggaaactaatagatggttatcaaatgacttgaattcaaacacgtggattatttcctcattgttaacctccggaggtgtgattaccgcatcgctgtactatttgtatcggatttatgtcacccccatatggccgttatccatccaaacggcgtccttattaggacttgttttgtctatggtatgtggactggggttgtatggtattgtgagtcaaaaaggatccgtcatagagagctctttattttttgcgtatattgttcgttgtatttatgaaatttcccccaaattagctactaccgcgactgatgaaattttaaatttgttcaaagacgtctggcagaaacatcaaagaaatctgcccacagctgacaatcttttgtgctactttcataatgtcatattgaaaaatgcagaggtgttatgggggtcctttattcctagaggaagaaagaaaaccggtgattttcatgataaactcattagcattctatcattcgaaaaagtatccttgatatctaaaccattttggaaatttttcaagaatttcacctttagtgttccgctatccattaatgaattttgtcaagttacaattaagatggcaagcgaatcagtttccccagctatagtaatcaatttatgctttagagttctgatgttttactcggcaacgaggattattccagcattacaaagaaaaaatgacaaacagttgcgcaagagtcgcaggatcatgaagggattgtattggtacagtccttgcatattaattgctatgtatactcacctgattttacaatattcaggtgagctaaagaaagacctgtgcatatggggttgcagtgaaaagtggtttggcgtagatcaaccagaaattatagtagattcatggggattttggaactggtgcaacattttctgtactattttggtatacgctacagaattaataggttctggtagttgaagctgatgcattgtcaaaagagccgcattaccagctttgccaaatacgcgaagacaaaaaggaaggtgaaataccaactgacttataactaagtgatagatgatatctgttttaagtgccattcctgaaccatttttacatttggttagtttctttttttgttattatttgcattagtcccttgcacgttcatagtgaaaatcccttacgctcaccactattttctaataaatacaatgaacattttaactcatactctaatatgtagacacataaatatataaatatataacatttccctgaaatactacttttattacgtggtagattttaacctgaagccgatgcagattattctagataattttatttcggtttttttttttctgttttgctaatttccaagaaccctttttcttctcttatcacaacgataagaggtacttaagatgatcttcatccttggattattattctttccctcttagaaaagtgaataatgagaagaatccattcttaaatttgggaatgcaacgtacgagggaattggaatcgagtgtcgcaatagaccaaactgaagtaccccgatctagattttttataatggttaaaaaattatcaagagttgccgatatcgtctatatagttgacacatttctaattccgccattgcatcctttaaagaagcagcatccaaaagttgcaaagtttttgaaggtacaacttgtctttgatttgatatcactgtttatttttgctacgcaccaactcctactgctagaagatggtaactttgggaagcactacttcaaaaggaaaacaaaacggtgctcgaaattttcgtgctctcgctgtaatgcaaacgctcaccaccccaagtggttcaaattcaaacattcactcctatgtctaggaacgttctgttttggggtttattcgttggtaaagattaataagttctttaaaactgatcagactgttgatctaaacagactcttagagctattcttttggcaacttaatgcaattcttaatatgaagttattcgccttttacggggaccatttagaatcacatagtgcgcctcttgatgtgtatgaggattcttttgcaaacaaatcatcgtcaggcggtgacgaggtttaacaactgtagttttttcgatagtatcttgaatctggatagcatttaattgcgattgaaacaaaaatggactactgcacactgtctagcgttcgatattttcgtgccattatcacatatgatcttcggaaaatgaagcagattataacatcggctgaattgattaaaaatgttaatagtctccggaagctgatgcgtaaagattaacattgtagtgggagagtgggtgacagggtataaaaacgcagagagaaataattattaagaacgatatgaattactgacgttttttaatttcgtgtttagaaacacaggtgaatcttcaaataataatgtaaattgcatttttttaaaagcaaatctatggatatattgggtatactgtaagttctcctcgatagtacagaaaaccataacagaacatataattatatgtaattgttgataattagaggttaaaaattagtattaatgaagaagtgagtactgatcttcttatactaaataagagaggtatataaaacacacgccgattggtcatattaattatgaccaatataatagtgattccggtagttactatacattgatgtgacgactcatattcctcatatatgtacctaccataacatgttcaactaataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacagtaattaccgtggttattaatacggcttgcttatttgttcccagttgtcaatgaacagtaattgaaaggcagtaataattagggataaatactgtatattcttatggtatataagagagaaatgggtgaattttgagataattgttgggattccattgttgataaaggctataatattatgtatacagtatatatactagaagttttcctcgaggatttaggaatcctcaaaatggaatctgtatttctacatactaatattaagattattcctcattccgttttattccttattccgttttatatgtttcattatcctattacattatcaatccttgcatttcagcttcctccaacttcaatgacagcttctcataacttgcgtcaccatttaacaccgtatatgataatatattgatagtgtaactactagttgatagatgatggttgatttttactccaacaggtttttattcctacaattttccggacatatatatataaataaagatcattcatatttactgatatggtaacatgtttttctattcaaatcaagctaatcaaatccgatgtagtgtaacggctatcacatcacgttctcaccgtggagaccggggttcgactccccgcttcggagttattttttattcttttttttttagggactatttaggcagtatttttaccactaaagcgcatgaagtcacattctctgagcctgctccattttttcagggatctttattgtttagcagggtaatacctttttgtaagtgccatagaataaagtattaaactagtcgatgatcgcgttaagcataaaactttgagtctgctgtctctgattctatttactatttactatatactgttttatacttctcttgcatgactattggtccatttaggcttcatctgaacggttgaatacagttacatacaatgacaaaaacatcacagatagtccgtagaagactagcaataagctgcaccttttgtaaaatctatcttttggtggaatcatcttcccaatagccaaagaatccaagcctattaatttgtaacctaataatccaggtaaagtgaatgaaatagacgttgaacctgtagcccctacaaatgaaagaaccagtgcaaatgactggacagacaacgccaaggtatacatgcttattagtaataatgcagtaatccagtaaaatctagacttaacaaatggcgcatgatgctcgttatccccggcgaccgccatagtccctctttcatcattattgttctcttgactttcaattgaaccattatcaaagttcccgttaggtagtaaacattcttgctcgttataagaagttgcgtctagtgcatcactgggctgggctggatcttccacagtcatgctaattggtcttaggttggaagcacgagtgtattccgaaacttgtgggtcctcttcgggatttgccccaccataagtgatctcaatccagatgatgacattgttaactgctatgcgcagcggatgaaagagaagcgggaaggaaagaattaacattgagccaagacagaatttgccaattactatccaaattgagttaggatcgtagttcaacattaaattacccaaggtttcattaccgaaggttaaatatcctgataaaccaacgatcaaaaatagtgctgttgataaggatatcgaattattgataacgaaagtgatattttccatgctgttgtcttttaattcatttatcatggggaataggttcattgatcccgtaaaagcaaaaattataatgctaaaagttgataataatcctttaaagtcgtgaattttccaccagcatatgtcatttcttaatatatttgttaattcaccctttcccagctcaaacacaaaatgactgaacaccagaattgatatgtatgctagcgcgaaaagacctagaatactagaatacttcaattgatctagtttcttcactaaacataggggaatgatgattacagctgatgcaattatccaataatttctttcaccaccaaacagtcctggaaagagatcaccaataagaactaagtaacttaagcccacaccaaagcattgaactatcattgccaaatcaaaaattggggccaaagtgggataggtgagcatgcataatgtgaagaaagaagagtttcttggattaattaaggtcttggaacatttcgatagcacaaagagacccagaccggatgttaccgccgccaataatgtaagaataacccctaccagaacaccatcgcttttaaaactgtacggaatggcaagtgtaccagcgccaactattgtcttaacgagattcgccgtagacgaaagagcacttgatgtagcctccataccttagaattccttttctctttgatgctatgtcctgattgtagaattcgcctttccgttgacgcttgttcttggcgtcttatctatttgagggtcaaatctgacttcggatgaagaagttatgaacgtatgataagaggtgaaagatgtggaagcaaatccattcatgttaagtcacgtggttcatacagataatacagaggatacaaaattaaatattaagacattaatagatgtaagcatcactggaatccggtagcaaggaaccgttggccataaaggactgcgttggccaatgaaaccgaggatagcaccaacggccaagttcttccatatcttaacgcactaaaggacttcttgccccctacaatcaaatataaggcggaccatgtagcaatgaagccagccccattttccaagtcgttgtcatagatcatgtatgcacctatagcttgcattgtagaaaagaaaagggcggttttagtagttataccgattctggcagtagaagatttagagaataccctagacattggtatcgagagggcaggagattgcgttggaggcactttaaagcttggggatagcaccggagtggatgctaatagtgctgcgtttgcgagcgcaggataaggtgtccttgtcaatgcatatagccggcgaaatggtgatagaagttcatctttggcatcgtcagtagcgggtttagcagacatttcttgtgtgttaagtatattggaaatcgtagtttatagaatcttttcgtcagatttgccttttcccttcgcatgtctccctaaaggccgtttcttgaaatatcttggacaaaagaaggtaatgcttttataagttagaagtgaccccttggccgaagaattgatgtaattgaattctgaaatattgaaaatagtagctacattgccatcaaaacctccatgagttaaatatgaattgttattaatgtaaacaaacttagatgtggtccgaagactgttgagtacaccgccagttcgtagatatctggagaagttggtagactcttttataattttgttcatacgtataaatgtatagaaaacactgtatctattcaattactctaaaattttctcttctgatctcttcaatcacgtctttgtcctttatggagggcttgtaacaaccagggaattccttctcatattccctgccgtgaagcaattcaaaaaaaatatccatgcaaggggtggagtggtcttcgatgtcttcacctttcttggggcacacgcatcgacatccacatccgaagttataaccttcatcgaaagtgttgagattttcttggctttgtaaggcattcttcggacaatgctgcagcgatgagtgtctataaccaatgtctctgaaataatgaacgtcttctagatccaaggtcattcccaacccaattgaatgaattggcgcgtcaccccacctttcagtccagaaacctccagactcttccaaaaatttaaaataggcgttatagatctcattgtcgaataaatcaacgcgggcaatttcaaagttactccaaaaatgacacaaattgtaatcttccccttcaagggaatcctctagcattggcaccttagagcgggccctttcaacgagatattgtataccttccaaatcttcctcattattgacttgaccatgattctctagcaaaaagtctaccatcaacttttctgtcaactttggctttgcatcccagggaaaattgacccacctagaaatttcttcatcatctgtatctagaatattataattaaatgtaaataatttccacaacgtgccgagattttcctttaaacctgccgttttttttataaagcttttggttgttctgaacaagttggggacagtccagtacagttcagttataagtacggtaaacccatatttcttgttatgtttggccatctcgaaaaagggatcatacgagatgtcacaaaaaaagtccacatcaggttctattctccaataccattcatacttggaaactaatggatgtttataaaagatcccggagtaaaatcgacacatcttgtgatatgattccatattaccatacattataccgcgatcgttttggtcttctaatgaagccttaaactgcaatgaattacgaaccttagcaggaaactcccacataatttcatcaacagtgccaaactctacagtggcattagttgcagcttgaatttggtccttaaaatgatctgtaaaggggtcatcattcaagaaaacgtacggatatttgaaccacttattgaaatggccctctatacttctcatagttttcagtacgtcttctatttcttcgtttctcgttagcataacgaaagatgcgttcattttggagtaagcaggattttgcaagtacagctttgtatcagtgcagccccggaaaaatggctcgtctttgtcagtcgaataatcctgtaaggaataaggcaaattatttggatcatgtacaatatcttttgcgaaaaatggccaggtccccatacagtaaagtatggcgaagatacatcctaaaaagaggaaaccatatcgtttttgtcgacacttatccagcaagaaccttctgacttttggattcaatcttatagccatgctaattgcatctaattatgatgtatattctagcccttctttggtacaactgtgcctataatcacagattgttagcctgatgtatacagtaaattttagccaatttttttttttcgttttccacttgtatccgagaaaagaaagcaaaaacaaaaagagctcacattgaaatataaccatctaatgtaatataatacaaagttaaagtggaaggtttgcagcataaaataaattagtcagaccttagtctgaaaggagccggaggctgacctgttaattctctgatcaaggaaatatcctctgtgacctcatctggtttcaaagactgtaaaggtggagctgttttggtggaatatcgttgagcaccacggttttttttcttttcattcccattagcattgtctttggggttcttttcgccaaacaaaaatgcatatagatcagtaccttcatttataccttgtagaaaatctgagtcagagttcatgcctgacttgtaggttaggttgttgaaatgggggaattgcgacccttgtctagaaccatggccattacttccagaaccattaccagtttgaaaatcagattcatcttgattgttgttgttacctctcgtgtctttagaagcattccttctccttagcgttcttctatcgtttccagctcccgtgtcagtagcactttcgtttgctgtatctcttccatattcgttggacgaagaatcccaaccacttactgtgtgacttctcgtgttcttctggtattgcggtctgctataattcatggcataggagtgcacattggccacatccattagtaacctctcctcctgtaatttctttattttttgctctatagacgaatacagtctttctttgcataatttaatgagtttctcgtgttcagccttagccttttcaatatcttcttgaaattcgataccggaacgagaaacacggtactcttcaaacaggcgcaacctgactaactctagatctctttcttcctccaaatctcgtacttggcgggcatattggccattatcaccttgatgcagagaagttaaatccgtttgcaatgctgtcagtctatctttatattgattatctctttctgagtaaaaattttgataaatcttattaactttagattcgatattaaatcttcttttgtccttgcgggacaagtccttgttactaaccttttgaatagccatcaatcttgaagacaatgcacactgagctctacagtttctcttgttctcttaaagcttttccaagggttcattttagctgaaaaattgtttgcgttttttcttcctgaaatctcaagcgaaatgatcaatacataagctaaattaaataatgagaaaaaagatacctgaaaacataattaaggcatagaagaaaaagatttgataaaagataaattttcagttcaataaaaaggtttacatacatctaatttttttttttgacgcaaatttttttgattacagacaagagctatgttttatttcgtagctagcttagttttcgaatgcgccacccatttgtcatggcgtgcgatgacttctgggattatcatctcttcaatgatatggtgtttttcatccaaacgtacccaatctccctttctgttttcaggggatacgaaaatgacctgtttgtttcttgtctgtaaaaggtttccgataaccagttgatggttgtatctatccagggcttgtgtacatttgtaaagcagcatggattcatcagtttctaatttgaacgaaacgatcatcgcttgagtggcccatgattccactaatcttctcaaaaacttagggacagggtcaagattcacaatcagtttaccatcaggcgtagtcctagttgtaccttcagtgtcattatttgctcccatcttaccgttgtctcctgattgaatcttgtgctgaggtagtcttgaatatggaacaaaaaaatcactgacagcagcagctaaataaaacaagcaaccactattattcaatagcttggctatacttttcagtgaccataagtattggttgaccgtggtgaatggtagtaaaagtagtttctcctctttctccatatacttgtcataaagctttttgttcttcaaaacattctcagcaaattcaggtttgattttaccttcagaatcaatgtagtccaagaataaagtattaatgctatgggagaaggacctattatacggagttaatgagaattccctatgtaagaaaataacactatatccgttcgctaagaactgttcagcactcgatgcaccacgagtacctgcagaaaaattatcgataaaacgtactgtattgttttccaatggaacagtagtaccaccagaggtgataagaactattttgttccttttcagggaatactgcaaatcaataaactctttagcgtccttaatcaattcatcgatataggcaggtttagggttagttttgaaatattgctcttcttcagtagtgtaggcaacgggaaagagctcttccttgattgtacgatcaattgcatgacttatttcagtaacagacgtatgaatttgaggtctgttgagcacgggtagaggtggcattgctatagtatgaagaaaaaaaggagtgtctgctgctaatctacacagtttatgacaactaataaaagcgttgtgtgcgtaattgtcttagcctcttatacagatgtcctgttgatgacaatgcctttaaaaaaaaaaaaaaaacgttaacaataggtcactcctccagtttttgtcgtttggcgaattcgggtcatcgaattcttcccttgccaataaagttggtggaaaatacccaaaacatcgcctacatatcaaatccgcagatttcaggcacgcaatttagagcctaccatctgttcatagttaggttaggccataggtggtcatcgtcgcctctactttcttagcataatcaggtttttttcttgatttttttatcataaattgtaactccgatttaagtagaagtgaaaaaaaaaataccctgttaattgtcacagcatcacttcttcctgttactttcaaagctgtaaagtgttagcatctttgtgcaagaagtaataagaatttaattgttaacagggtttgtagcactggtatacgtttttccatatcatggaacatgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacacctggtagcgttaaaggttactaattgttcaaacgaaccatcgaaaagccgaacctagctacaccacaccccagtatgagctttatggatcaaatcccaggaggaggaaattatccaaaactcccagtagaatgccttcctaacttcccgatccaaccatctttgaccttcagaggtagaaatgactcgcataaactgaaaaactttatctccgaaataatgctaaacatgtctatgatatcttggccgaatgatgccagtcgtattgtgtactgcagaagacatttattaaaccccgctgctcagtgggctaatgattttgtacaagaacaaggtatacttgaaataacattcgacacattcatacaaggattatatcaacatttctataagccaccagatatcaataaaatctttaatgcaatcacgcaactttccgaagctaaacttggtattgagcgtctcaaccaacgattcagaaagatttgggacagaatgccaccagacttcatgaccgaaaaagctgccataatgacatatactaggctattgacaaaggaaacctataatattgtcagaatgcacaaaccagagacattaaaagacgccatggaagaggcttaccagacaaccgcactaactgaaagattcttcccaggattcgaacttgatgctgatggagacactatcatcggtgccacaacccacttacaagaagaatacgactctgactatgattcagaagataatctgacccagaatagatacgtccacaccgtaaggacaagaagatcttacaataaaccaatgtcaaatcatcgaaacaggagaaataacaacgcatccagagaagaatgtataaaaaatcggctatgcttctattgtaagaaagagggacatcgcctgaacgaatgtagagcacgtaaggcgagttctaaccgatcttgaactcgaatcaaaagaccaacaaactctttttatcaaaaccttaccaattgtacactatatcgccatccccgagatggacaataccgccgaaaaaaccataaaaatacaaaacacgaaagtaaaaaccctgtttgacagtggatcacccacgtcatttatccgaagagatattgtagaacttctcaaatacgaaatctacgagacccctccactccgttttagaggattcgtagccaccaaatccgccgttacatccgaagcagtcaccattgacctcaaaatcaatgacctgcagataactttagccgcgtacatactggataacatggactaccaattgttaattggaaatccaatcttacgccgctacccgaaaatcctgcacacagtactgaataccagagagagccccgactccttaaagcccaagacttatcgctccgaaaccgttaataacgttagaacctactccgctggtaatcgtggtaaccccagaaacataaaactgtcttttgcccccaccattctcgaagcaactgacccgaaatccgctggtaatcgtggtaaccccagaaacacaaaactgtctcttgcccccaccattctcgaagcaactgacccgaaatccgctggtaatcgtggtgactccagaaccaaaaccctgtctcttgcaaccactactcctgcagcaattgacccgcttacgacccttgataacccaggtagtactcaaagtacatttgcgcaattcccgatacctgaagaagcgagcatcctagaagaggatggaaaatactccaacgttgtctcaaccattcagagtgtagaacctaatgctactgatcacagcaataaggacaccttttgcactttgccagtttggttacaacagaagtatagagagatcatacgtaatgatctcccaccaagacctgccgacattaacaacatccccgtaaaacatgatattgaaattaaacctggcgcaagactacctcgactacagccataccatgttacagaaaagaatgaacaagaaatcaacaaaatagttcaaaaactgctcgataacaagttcattgttccctcaaagtcgccctgcagctcccctgtagtcctcgtcccgaagaaagacggtaccttccgactctgcgtcgattaccgcaccctgaacaaagctaccatctccgacccattcccattacccagaatcgacaacctattgagccgtattggaaatgcccagatatttaccacgctagatttgcatagtggttaccaccagatcccgatggaacccaaagaccgctacaaaaccgcctttgtcaccccatccggtaagtatgaatataccgtcatgccatttggcttagtcaatgcacctagtacattcgcaagatacatggctgatacatttagagacctgagattcgtcaatgtttaccttgatgatatattaatcttctccgaatctccagaagaacattggaaacatttagacacggtactagaaagattaaagaacgagaacctcattgttaagaagaaaaaatgtaaatttgcatctgaagaaactgagtttttaggctatagtattggaatccagaaaatagctccactacagcacaaatgtgcagcaatccgagactttccgacgcctaaaacagtaaaacaagcacagagatttttaggaatgattaattactacagacgattcattccgaattgctccaagattgcacagccaatccaactgtttatttgtgacaaaagtcaatggacagaaaaacaagacaaggcaattgagaaactaaaagccgccttgtgtaactcccccgtcctagtaccattcaacaacaaagcaaactaccgacttacaacagacgcctcaaaagacggcattggtgctgttctagaagaagtcgacaacaagaacaaacttgttggtgtcgtcggttacttctctaaatccttagagagtgcccagaaaaactatcctgctggcgaattagaactacttggaattatcaaagcactccaccacttccgatatatgcttcacggaaagcatttcacgttaagaacagaccacattagtttgttatcattacaaaacaagaacgaacccgcacgacgcgtgcaacgctggttagatgacctagccacatatgacttcaccttagaatacttagctggacccaagaacgttgtcgcagatgccatatcccgtgccatatatactataacccccgaaacatcccgacctatcgacacagaaagctggaaatcttactacaaatcagacccattatgtagtgctgtcttaattcatatgaaagaattgacacaacacaacgtcacacctgaagatatgtcagccttccgtagttaccagaagaaactcgaactatcagagaccttccgaaagaattattccctagaagacgaaatgatctattaccaagaccgactagtagtaccaataaaacaacagaacgcagttatgagactgtatcatgaccataccttatttggaggacatttcggtgtaacagtgacccttgcgaaaatcagcccaatttactattggccgaaactacaacattcgatcatacagtacatcaggacctgcgtacaatgtcaactaataaaatcacaccgtccacgcttacatggactattgcaaccactccccatagcagaaggaagatggcttgatatatcaatggattttgtgacaggattacccccaacatcaaataacttgaatatgatcctcgtcgtagttgatcgtttctcgaaacgcgctcacttcatagctacaaggaaaactttagacgcaacacaactaatagatttactctttcgatacattttttcatatcatggttttcccaggacaataaccagtgatagagatgtccgtatgaccgccgacaaataccaagaactcacgaaaagactaggaataaaatcgacaatgtcttccgcgaaccacccccaaacagatggacaatccgaacgaacgatacagacattaaacaggttactaagagcctatgtttcaaccaatattcagaattggcatgtatatttaccacaaatcgaatttgtttacaactctacacctactagaacacttggaaaatcaccatttgaaattgatttaggatatttaccgaatacccctgctattaagtcagatgacgaagtcaacgcaagaagttttactgccgtagaacttgccaaacacctcaaagcccttaccatccaaacgaaggaacagctagaacacgctcaaatcgaaatggaaactaataacaatcaaagacgtaaacccttattgttaaacataggagatcacgtattagtgcatagagatgcatacttcaagaaaggtgcttatatgaaagtacaacaaatatacgtcggaccatttcgagttgttaagaaaataaacgataacgcctacgaactagatttaaactctcacaagaaaaagcacagagttattaatgtacaattcctgaaaagtttgtataccgtccagacgcgtacccaaagaataaaccaatcagctccactgagagaattaagagagcacacgaagttactgcactcataggaatagatactacacacaaaacttacttatgtcacatgcaagacgtagacccaacactttcagtagaatactcagaagctgaattttgccaaattcccgaaagaacacgaagatcaatattagccaactttagacaactctacgaaacacaagacaaccctgagagagaggaagatgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacagaacatatgaaatatctggtctcttggcccagttggttaaggcaccgtgctaataacgcggggatcagcggttcgatcccgctagagaccatatttttttgtacaaatctcttctactactgctaagacagtaagtaagaaatacgagactccaacaatgtactttttttttgctttgtactgctctatcgatacaaaaaatccctataaaataaacatatatatgtttgctgcaatgagaatggaaaaaaaattaaaaaaactcacatataatctcaataacggccatttctttggcttttgttagaagatgatcggcccctcttattcttaggacccttggggaagtcgtccctattatagctgaactggctcgaataatcgttcgttctgttgttttggctacttctggggaaatctaaggggtgtgtctgaactcttttatttttcgtcactttgtagttctgtgcgctaaatggtgacttcttcttcctgttattactgctttcatatctattattgctactatttttgttccttgttgactgcactttgcccttccatttcattttatctctataagtccttgagccagggaggtcgtatgcatcgtcgttatattcatagtcaagcaggttgaattcatgttcgttatcaaagtgttgcctttgtgaagcttcacgtttatagtctttcaattggttaaaatagtgttgtttaaattttgtggctaagttatcaccgcaaaatgcacttccatcagtgttcggcactctcgatgaccttctttcagcacagtcatcgccaaaatgaccggcattcccacagttataacagaaaactgtttgaaaatcgaagtcaccttggttagcatcttttgtttttaataaataagatctccaaatactaggacatctttctcttgagtgtcttttgctattgcaaagcgtgcagaacaccttcttccatttatgaggacactgtgatttataatggccgtttgcattacaattagtgcaaataatagccttagggcagtgttgtgagtaatgatcatccataaacccgcagtaagtacatatcacatggggacaattccttttcaaatgacctctttgcgaacaattattacactttggctctgcctccattatcgcaccgtttgagtcataatctgttattccaaaataccgtccttggccacgtaaagtcctcagttcctctgggttagcatctacatcctctatggaaggagccaataatttattaaatgatgacgagtcacttcctgtcggtgttgtatccttcacatacggcaaagtatcgatactttctacctcagataacaatgtcgacataatatcttagctccgtggtccgcttcctttgtattcctcatgtgagaatgttggacctttcccactcatcgcatcgctaatttttagtaatttttcattttttcatggaccaagaaattgaaaagcctgtcaatgagctttaacagtagcaagaaacaaagacaaaggacaagcgcctatggaagtcactttagaaatattgaagtcacattttcatataatatataaatgaatttacagatgtgccattgtatatgctgacgcaaacgctttctttttactgtttaaatgactcttaccttgtgatatgtataaatcatcatatacggctatcttgctaaaaaatttttttcgaggaattttcacttgaaaaaaatacttgcgatggcaacaaaagaaagttagataaatcgtgcattaaatgatgtgtcatctgaaagattacaggttaacgaaaaattaacagctaacagagcaagaaaataaaacggagatgagtgctagtgaagcaggtgtcactgagcaagtcaaaaagctgtctgtcaaggatagtagtaatgatgccgtaaaaccaaataagaaagaaaacaaaaaatccaagcaacagtccttgtacttggatcctgaaccaactttcatcgaggaaagaattgaaatgtttgacagattacaaaaggaatacaatgataaagttgcttctatgccacgtgttccattgaagattgtcttgaaggatggagccgttaaggaagccacttcttgggaaaccactccgatggatattgccaaaggaatttctaaatctttagcagacaggttatgtatttctaaggttaatggtcaattatgggacttagatagaccatttgaaggcgaagccaacgaagaaatcaaattagaactgctagatttcgaatctgacgaaggtaagaaggtcttttggcattcgtctgcccacgtcttgggtgaatcttgtgagtgccacctaggtgcccatatttgtttaggtcctccaactgatgatgggttcttttatgaaatggctgttagagatagtatgaaagatatatctgaatctccagaaagaaccgtctcccaagctgatttcccaggattggaaggcgttgccaagaatgttatcaagcaaaagcaaaaatttgaaagattggtcatgtccaaagaagatcttttgaaaatgtttcattattcgaagtataagacttacttggtacagacaaaggttccagatggaggtgctactaccgtctaccgttgcggtaaattgattgatctatgtgtcggccctcatatcccacatactgggcgtatcaaagctttcaaactattaaagaactcttcttgttatttcttaggtgatgcgacaaacgactctttacaaagagtttacggtatctcttttccagacaaaaaattaatggatgctcatttgaagttcttggcggaagcctctatgagagatcacagaaagattggtaaagaacaagaattattcttattcaatgaaatgtccccaggttcttgcttttggttacctcatggtactagaatttacaacactttggttgacttgttgagaaccgaataccgtaagagaggttacgaagaagtcatcactccaaacatgtacaactccaaattgtgggaaacctcaggtcactgggccaattacaaggaaaacatgtttactttcgaagtagagaaggaaactttcggtctaaaaccaatgaactgtccaggtcattgtttgatgttcaagtctagagaacgttcttatagagaattgccatggagagttgcagacttcggtgttatccacagaaatgaattttctggtgccttgtctggtttgactcgtgtcagaagattccaacaagatgatgctcatatcttctgtacccatgaccaaattgagtctgaaattgaaaatattttcaactttttgcaatacatttacggcgtttttggatttgaatttaagatggaattgtccactagaccagaaaagtacgttggaaagatcgaaacctgggatgccgctgaatcaaaattagaatctgccttaaagaaatggggtggtaactgggagatcaatgctggtgatggtgctttctacggtccaaagattgacattatgatttctgacgctttaagaagatggcatcaatgtgccaccatccaattagatttccaattgccaaacaggttcgaattggaatttaaatctaaagatcaagatagcgagagttacgaaagaccggtcatgatccatcgtgccattttagggtctgttgaaagaatgactgccattttgaccgagcattttgctggtaaatggccattttggttatcaccacgtcaagttttggttgtgccagttggtgtcaagtaccaagggtatgctgaagacgtccgtaacaaattgcacgatgctggcttctatgccgatgtcgatttgaccggtaacactctgcaaaagaaggtcagaaacgggcaaatgctaaaatataacttcatttttattgttggtgaacaagaaatgaatgaaaaatctgttaacattagaaacagagacgttatggaacaacagggtaaaaatgctactgtttctgttgaagaagttttgaaacagttgcgtaacttgaaagatgaaaagagaggtgacaacgtcttagcttaatgagattttatgtagttaaattttgacttatttaatttatgttttgtaaagaataaaatgagtatgatgaaggaatcttacctctattaactatttcttctttttttttccttcgataagatgtgcgcgaattcaatatggaagaaagcaatttggtatgcagatggtgttcaccggcagtgtttaagttacgaatatataaaaacaaattcaggaacccgccgaatttggcccaaacatatacctatatacaaattagtgaccatacgctattattactccgtcgtctaggagcggttcccaccatatctcccgctctgcagtaaacgctgatatttgtcatcagaagaggaattatcggtagcattaccatcgtcagaaaatcctgagataaatatatcggattcatgatccactgaagcatctgattcctgcgactgatctctactggtgttccttatattttcccatgatgaagacgaactgttgtcgccgttcctgattttttcccaggaagacagaacaggactgtcgttttgctctccttcaattgggtcaggagattttctacccttattacgatacaatcctataggatccctttggttcataaagggcgagccgttaaaaactccgccttttttcatttgctgcagtttgactttcgggtctggcaatcttctctccggattttggtacgttatgtaaaagtacatcgaccaccttgagggggagcctgaatctaataagcgcatcatattgtactgcctttgatttctcggaatttcttttgtttgatcatgttgaaaggctccaaagtcgttgtcaccatatttgttggaatagttatccttcaaaacacctgtggggtcacgttcgttcaactgtcgtgtatacatggacctaccagcaaaatttgtagcaaaaaataaagccattacacccaagacaaaattcctcggcaccttaacacctttaatagccttggtcttgtagtaacgataggcaaatggagttaaaaatacagctgaaaacccaagccaaccaccccacatctcagctttagcaatggatctataggccttcgataactccagcctgtctcttgcatccagcaattcgtctttttcatgaaattcaatagcattttcataagcctttttaaaccaaggcctcttcataaagggtagttcattttccattcccttaccattctggccatattgctgttcttcttcttttcccaacatcaccttgttctacgcttgaaattaggctgctccttaaaacgaaaatcatattaagcattgacacataaaaagttctgttctgcgtcaaagtagcattagctcataaggctttcacccttgcttgacttacacccgcggaaataaaaacacagaaaaagaaggaaataatgtataaacaagtaactatgaacgaaatttcctgttacggattgttacgctagctattaaaattcgtctcgtcaaagatcgactgtagcagcgtgctgctgatgtcaaagaattgggagccacaagctggtgaaatggtatctgtcttagtactcacaacattctaggctgcaaaagaggttataccggaacaatagttgctaaaatggaattcaggagatggctccaacgcaacgatcaggacgcccgctgatctcactctttagtgtccacactatatagtaacattacattcaattggaaccgtaatgttgtataaaatcttttgtcttgctgtataggtgcgtatgcagcgtcttcaatgggataaagatattctatttttaatttttaaggtgatcttaattttttgttggttctttttcagttttttgtcaagcgaaaaactacagtttctacagaaaaacacgtcaagctacagtataagaacggattgtgaagaactcggtggagaacatagaaacagacaaaaaatcatggattactttaatatcaagcagaattactacacggggaacttcgtgcaatgtttgcaggaaatagagaagtttagcaaggtcacagataacaccttattattctacaaggcgaaaacccttttagctctaggccaatatcaatcacaagatcctacctctaagcttggcaaggtactagacttgtacgtccagttcttagatacaaaaaacattgaagaattagaaaatttgttaaaggataaacagaattcaccatatgaattatatctgttagccacggctcaagctatcttgggtgacttagataaaagtttggagacatgtgtagaagggattgacaatgacgaagcagaagggactacagaattattgctgcttgccatcgaagtcgctttgttaaacaacaacgtttcgaccgcgtccaccatctttgataactacactaatgctattgaggatactgtttccggtgacaacgaaatgattttaaacctggctgaatcgtacattaaatttgccacaaacaaagaaacggcaacatccaacttttactactatgaagagctatctcaaacctttcctacttggaaaactcaattgggattgctcaatttgcatttacagcaaagaaacatagctgaagctcagggtattgtcgagctattactatctgactactatagcgtcgaacaaaaagaaaacgccgtattgtacaaacctactttcttagcaaaccaaattacgcttgctcttatgcaaggtcttgatactgaagatttaacaaatcaattggttaaattggatcacgaacatgcattcatcaagcatcaccaagaaattgacgcaaaattcgatgaattagtgaggaaatatgatacgtccaactgatttacgtaatatctcacattaaacatgtaggttttttagaaaaagaaaaaaatatttcatgtatatgcctatatactattttgataaagccgaataagatggtaccataaatgaggttgacatggcttgaacaaaatcatataaagtataattaacaaagcggaaacaacatttgtcacgttagaattatgcgtaaagtagctaatcctggcagaataattcaatgatttttttttaaaagtatgtacactattatttattttctggcattttgaactaattcttcattttctgtacgaccatgcacccttgatctaagcactagggaagtcgacattatcatcgaccttaaatggggttggaagtggagcgttaacatctttcatttgcctaacagtttcaattagtgctacaggttccttgggttccctatctcttaaaaccaccacaccgttatttcctttgaatttacgtacaggaacaaatctgtcgtccttaataaaggaaatatatctcgattgttgtggtagtatacgggtcatattgtcgactttataaggtttagaagagtacttatttttgtaaaattcttcgtcgttttcttttgtttcttttatgccttttttattcgtctctctttccttttctttttcctcatgctcttttttcttttcttcctcatttggacccttttccttctttgtcttctttgcccttgcttttgctcttgctgtcgtggaaagaacagctgttgctaccttctctacctccttaccacttgcttcctcatacatcctcggataactgaatgcatcttctttagcgtaacaattcatttgaaatttgggtatagcttgatcgctaccacgaataccaatgacagttgttggtgtaaaagaaagggataaaaagtgagccagtgggaaccagtaccagaattgtgagaacatgaccaaaccaactacggacttggtatccaatgtgcctgtatccgcattttccagctgaattgtaacattacgcccaccggcattcattataccttgggccacacatgcaccgaatttggctaaaccttcttggtgtttgtttgtaatcacgctcaaaaaatttttgttaatatcagcaacttgagggtttagtttttctgtttgttgaatcaaaatcatggataaagctatcatggcagcctgacgaacaaaatctactgggtcctttgttagcggatctaaaacgtcaatagctgattgtaaacccttgccggcacaagcaatcccaagagcaaatgcggtaccacatctgacatgagcgttatgcgatttagatagaagttggacaatccttggtacagtggtataatcacgcaagagaacaaaccctaatgcgatgactgctgcccttctgacatcatcgttagaatccgagactgccacatgcagtaatctcttgacagctgaattatttcccgtacccgcatacgctaacgcgattgtgaatgcacctccatagcgtaacaaggactcatcacttgctaacatcttagtaattaaatcatcagctaactcttgacggccgtaatttatcagtgctaaaccaacggctagaccacgagtaatattgccatgctgcgtttcttgggaatatgtaaacatatcgtgaatcgcttcaggcttacctgttccgagcatacagagacccatacctaatgcagctgcttctccagatgtggcagaatcgttgtacagaacttcctttaaggcttcataaacttcaatattagcagaacccatagcagcaagaccgatacccagtgaagcaccatgtaacaatacatctacgtcttcatcgcctgaagttccgctattctcaactattatgtttttcagatagtcagttgtatcacgaccaaagccagcataaattaaacccaaaccatacaatgaaccacctttgataaacctagaagaagctcgactgcctggcaagtaaggggccatgacttttttaccctccaataaattgcctttatgaattacacctaaagaggctgtagctgtaaatttagcccaattttgagccttacctaaccatggcaagttcgccttgataaatgaattgtcggtagtaccagcgtgcataaaaccgttggcaacgctgactgcggtgtggaacaaagaaaatttcccatccaaagatgatttagacttgtttaaaagaccgatgtcaatgtttttattattcaaaaggaaggtattgtaataatcacaagtcggtagcccagatagaatattcaataaggcaggatcgtaaccctgggcagttagttcggttactaaaatctcaagcaactgctgagacgcagacgaaaccaaatcaaatgcaatttgagcagataatccttcatcgttctcttcctttaattttttaaatagctgaagtgccaatccggcgtcattcaaatttacaactactttattgagcgttaagtaatcgcagttaggcatattcattaggaaatcaaatgattttctcaatatcgaggatctgaacttggaatttgtcacagtagttatagctaaggtcaataagtagttaataattttaacgttttcagaagtggaatcctgatccaatttgctctttaaagcactttcaatgatatccaatctgtaaccttctaaggcaattcctaaagctaattttaattctgaagctttcaaacatttttctatcattcgctcaaaaatagaggttaattttgggtcaataatatccttggtgtaaaattgttcgtccttagtgtattgcttggaagcctcttggacgtacatctcaatactctttgagactatagtttcaacaaattgtgacttttcgtctatatcaaaacgatcctttgcggcaagtgcatacttcacagccgattcgtattcaccaagattgtaataaactttggatgcaatcaaagcagccatttcacggtctgaaaaggtatcgtcatcatacaatgcctcaatatccggcagttcattcgagatctcagaccataattggtccacaacattatttatagattctagggcatatgttttaacagaatcttgattctctctcaacaatgctaaaagaggagcagcagtcgtcaaagacatcttttccggttatatttgaactcaatctattctgggtggtcttttactggatagagttccacaattttttttcccttggattcaaagcattatacttttatgtatccagttttgccaccgaaaataaatgaaatgcgcccttctcctattgaaaagcaatatgctattacccgcactaaaccctcgaaataatggcaataagaggcagatcgaaaaagctcgacagattatcgtccatgaatcgtgagacagcactttgtggagtttaatgggcaatcaaaggctatttttttactcgattccgtttcaacatatcttacatactatgaagataggggaggattttaaatctatacatatatttttatttatctgagtaattagtataataacctgatggaaactttggcagaagtttggttcaacttttcatatatatccttgatttcactttgattaacagaagagatgtctgccattagataagcgatctcgccgtgagaatcagaaaactgtttctcgatattatgatcggataagatatcattaacggtcttcaaaacaccaggaacgttacgatgaatatacaagacacgtactgtgttctcttgatcgtagtccaaagacttcaaactgacttctgggaagttcacagaaccgacagagttaccttcattgatgtatttggacaatgcagtagccacctcaataccgattgaactttgagcttcttctgtagagccaccaatatgtggtgtcaggattatatttggtaatgaaaccaactcagaagtccagctgttaagttcatcgttaaatgaaccttcaccgttcttagctggttcatgtggataaacatctaaagcagcacctgcaattttgttggccttgacggcttggatcagagatggaatgtccacgacagtacctcttgaggcattaataacataagccccgtccttcatagcagcgaattgtggagcagataacattttttcagtttctggagtagctggtacatgtagtgttacaaaatcagatttattcaacaattcatctaatgtagaaacttgtctggcagtacctaaggccataattgtcacgatatcatagtatagcacatgcaggcccatagcttctgcaagaactgataattgcgaaccaatgtgaccatacccaataataccgagagtttttcctcttacttcccaacacctagcagcgactttattccatgtacctgtatgcagttcaatggatctatcacctaattgtcttgctaaactaatgatctcaccaattaccaattctgctacggatcttgaattggagaatggcgaattgaaaacagcaatacctttactagcggcatattttaggtctacttgattggtacctatgcaaaaacaaccaatacaaactagattcctggcatgctgtagtattttttcagtcaatctagttttggatcttataccgatagcgtgtacgtctttgattttttcaatcaattcatcctcaggtagagaagacttgtggaactctacttggtaaccctgatccttgaagattttgattgcagttgcattgacattttccaacagtagaatattcatgtcaccagtagaaaaaggttttaaagcctttggttgctttgtaatgcttacacgacgaggtagtgtgttcataaatgactgagttggtgaggttgagactgcaccaggagagccagaaaagttcatggcacgttggaatgaatcttgtaaattatcggcagctgaataagacatgttagggaggaaatacccgaaatcagtgtttgttactttttaatgttacaataatctacagctaaaacagacaaagtattttttaatgtagtagctcgtaaccttcttatgtattaaacctgggagattccattagttttcataacggtgactcgtttccagcgtgaagaatctagcccacaattaatctgagcgctgtccggctgacggccaaattcttcggtgtaaagaaaaaaatgtggcattttgtgtatatttggcaagaacaagagtgtaatattattgatagtgcacgtgacattatgaaaaacaatagcacttattaactatgctaaaaattttgtagctaccgattctatcacgcttcctggtacgggtgcaggcaaagattgctagggaattaagggtcagccagtataaacgacagtaaatggaataaaaaaggtttatttagcaatactattgatatcgatatttgccgaacttgctaaagactcccataaagagtacaattgctcctgcaagccttcattaaccatgtttgcgaaccccattgaatgtttacaccaaacaattccattgcttttgttgtctttgattatgtaattgacgccgatattccaacagtaagtggctatagtttctaactctgtttgaaggacaccatctgtgtcttgaagacttgattgatttatatttaggatcttaagaaccctatccaatatgcgtagttcgacctcatggttaagattaattgcattttccagtaaaattcgcagccagctacagagttcccgttctttcacttcagggcccatgtttctttttaatactgtttcaagtatctctatgagaactcctttaggtaaatcttccatattcgacgagatatcaataagtagcgcatccacgcggctatcttgatacaattccgttttcttcaatatgtccagaatcctagtttgatcaggcatcattaaggcactttccagatgtatagtcaacgcctccaggaaacattcatgtaatgtatttctatcttccaatgatgacccatccttaaattccgagcttttcttcataacatttatgctattaaccaactcttctgacttctcataaatatcccaatccttttggtgttggtcttgctttgctttttctttggctattatcaactgcaagattgtggctttgaacctccaatatgtgaaatgatacattttcgggaaagtgaagtcttggaccggaataaggtcaataaattgaatgcaatactggggaaactcggagatggattcacaggactgatcaactaagcattttacagccacattataggaaaaagaggcaaaccactcgatttcgtttacagccactgattgctgatatattgcttccttctcaacgtctggtggtaattgatttagtaactttacagttttgagaaactcgacagccttctgtaaaagtttctgtactgttggtaaataatttatgaaggtttctaaaggctcctcttccgatactttgacaatcatctgtagggtatacctgagaatgctcagtgtctgagaactcgacgtagatgatatagtttgcgaattgcttttagattgtaatttgtcaaatatcattaagagcccttgaacagacaaatctgtctttcgtttgcattctgctactgctaatataagagcgtctgtacttttttcatcttcagacgactttatcttctggaggcacgtaagcgcttcctctgttttatcatccgctagaaaagactgcaacatcaaaagttgacacagaggagattgtctatctacttcgtccatatcctgatatactctaactgtgttggaatagtcttcaattttgttatatacgacttgtagagccctttgaattttcccccggtcggaataattttgactgataatatctttgagtgctaatttgtaaaatctaatactaacaacgtatttttccatcttttctaacttttttccagtattccataataaagttattatgcaagagatagcatgtttggtgaggggttctgaaactattctttccatctgtgtgctaaaattctctaagctttccgctatctcggaatcattcattgtttttgattgtgttgtaattaaaaacctggagcaaatggcttttcctaagaatttactatcattcttagaattcagtttattgattaacaaataatcgagacacactatagagaatttggtgttcatttttgataagtcattgatagaagctatgacagcttgaaaattggatattacatctactgacataatcattcgcatgagaatttcctctatggtttctgccggatttacgatatttctccgtttagttaaattgatagccaatataaaagggtccactttgtttggatattcattttgcaaaagacttaaatagtgatcacattgttcaagttcagaagcttgtgggtgtccttcaaccaaacaatttgccataaaaatcaaaactgaatactttaaattactataatcagtatgagattttaaattttccacaggtaactccaaatatttttccacatccttcaaaaaagaaattatatttacgtctactaactgagtttcaggattattaatttctttcaacataactgtggaattatagatcattctgcataattcgatgagcaaatctgcgtccatatatttggaattatcagtgatgtttacttttgcagtgtaaatatttgctgtatccaggtcattttccgaaagatataattgaaaatttaccaagtaaaactcgaacgtcagttttttaaactcagttttctcttcattggagaaactttccacattctcattgattatctgtaagtatttctctgaatgctgctgtgtattagttattaaatcgtcaaaacgatactcactagcgcttttgaaagaactgatataacatttgaagttccgtaggaggttggtgtttgtccgaaacaaagcctcatggatggagagaagcttggttgcgaaaatcttacatttgcaaaagacttcattaaaatatttgtctgaagctttttcagctttcatagcaatagtcaacgaattccatagacttgatgctgcattttccaatttcaggataagttcttcgtctaatataactgtagtggttctgaatgatctatcatatttttctgcaatgggatacaatgcgcttattttattatctactgtaatcaaatcgtttttctctaaattcttagccgcataaacttgcgatgttatccaagttgcagtttctttatattattaaaataataaagctgttagttgctattgctcgtccagataaaagttaataagggtatgttttgcattttgttatataccgcataactcgaccaaagtttttctaaaagtggagttaacgttgtggtctgacattgaaacttgttgatcactttagaacatagccttttactaatattactagaagtgtcattattcatggaacactcactaaaaagcttcgctcttttctctttttatttatttgcaattagccgccgaagtttgtattccgtacgaaaatgaaaatgaaccaggtaacaaatctggtgaaatcaccattaaacatataaaaaacaggatgaattagtgtgaaaattatataaaagccgctggtccaagaagacgtgatttacaagacatatacaggacccaaagaaatggatttcactcatgattatttccattgaaaatcagatgattggcctttcattttcttcttgaaccaactgaattttgaatgattgcccccctcaatttaaagcgccaggttatcaaaactttcaacacacgctagtctgttgaaagtaaagggaagatctacgtgtgaagtgatatatgtttttaacctgggcggctaaattgtactttatatatagttgaaacaacagagaaagggcaggataaagaaagaaattgactgcagtttcctatgatcatatttcatttttgtaattaacaatataatataatacacttataaacggtttaaaaacagctttatctcagaaaagtcaggaattatgtctaataaacaactagtaaagccaaaaacagagacaaagacagaaataactactgaacagtctcaaaaactgctccaaacaatgctcacaatgtcttttggttgtttagcctttctcagggggttgttccctgatgatatatttgttgaccaacggtttgtaccggagaaagttgaaaaaaactacaataagcaaaacacgtctcaaaataactctatcaaaatcaagacattaattaggggcaaatcggctcaagcagatttattactggattggttggagaagggagttttcaaatccattcgtttaaagtgtttaaaagccctatcattaggtatatttctagaggatcccaccgatctcctagaaaattacatttttagttttgattatgacgaagagaataatgtcaatattaatgtaaacttgagtggcaataaaaaagggagcaaaaatgccgacccagagaacgagacaatttctttactagattcgagaaggatggttcaacagttaatgagacgatttatcataattacccaatccctggaacctttaccccaaaaaaagttcctcactatgaggttgatgtttaatgataacgtcgatgaagattatcagccggagttgttcaaagacgcgacttttgacaaaagagcaactttaaaggtccccacaaatttagacaacgatgctattgacgtcggtactctgaacacgaagcatcataaagttgctctttctgttttgtcggcggcaacatccagtatggaaaaagctgggaacacgaactttattagagtagacccctttgatttaattttgcaacaacaagaagaaaataaacttgaagaatctgttcctacaaaaccccagaattttgtcacaagccaaacaaccaatgtgcttggaaatcttttaaattcttcgcaagcaagtatacaaccaactcaatttgtttcaaataacccagtcacgggcatttgtagttgcgaatgtggattggaagttcccaaagcagccaccgtgttaaagacttgtaaaagttgccgtaaaacactacacggcatctgttatggcaattttctacattcgtcaattgagaaatgctttacttgcatttttggaccttccttggatactaaatggtctaaatttcaggatcttatgatgattagaaaggtttttaggttcttggtgagaaaaaagaagggatttccggcctctataacagaactcattgatagttttatcaacgtcgaagatcagaataacgaagtaaaagagagagttgcattcgccttatttgtatttttcttagatgaaacactatgcctcgataatgggggaaaacctagccaaactattaggtacgttacgagctctgtactcgttgatgtaaagggaattgtcataccaaatactagaaagcaactgaacgtaaatcacgaatataaatggcactttaccaccagttcccctaaagccgagagcttctatcaagaggttctgcctaactcaagaaaacaagtcgagtcgtggttacaggatatcactaacttaagaaaagtctattctgaagctctttctccgtcgtcaaccctacaggagcttgatcttaactcaagcttgcctacgcaagatccaataatttctggccaaaaaaggagacgttacgatcttgatgagtacttagaggaagataaaagctcagttgttaatgatacgataaaagcaaaagattttgatgaaagtgtaccagcaaagattcgcaaaatcagcgtctctaaaaagactttgaaaagtaactggtagcgaaaaccgaattatattatgctcatcatttaaacaggcacttcttcaacagattgaagaaagtgctttaaatatacctaatttctctttagcgaggatttgcttaaaatagtttctttatacaataataatgaataataaagtgacgttacttccccccagagtttttttctgcctgtcatggtctgtcatggtgaatattgatcgaaggaagagtgatcgctccgtaaatctagatgatcagcattcaaacaaacctccctctgaatcactaatatcacttctatcgttaacttcatctatgtccatatcgtcactgctttcattattgataatagtcgctgtattgtttccaccgctatacattagtggattaccttggataatgtctttcaaatccgtgttttcattttttagtttatctataacctcgtttatcatggtgccatttctgctaatttcgttaacaatactttgtaaaatagaactatcctcaaagtgtatcacgtccccgtcaatttcgaaatttaactgccctgatattattaactttgtcaattcttccttaatatcctccaaatcaatacctagtgtagatgataaataagaaaactgtagcttttttgatatccttaagtaaaagaaatatattttgcacctcatgataacagcagccgacgacgaccagctaggttccaaaaaaaggctttccatgcatattttatttatttcaccatgccaaattttgaaaaatttgttgaaattagtgtttatcaacagttcgagacaattaaccaataagggtgtcatctgaaaaaattgctttaaatcactcaaatagataaaatcatcataattatccaaaggtattgaaataagtacggatatattcaccatcattataaactcctctttcgatataaaattcatgcagtctaagtgttctgacagaactttcaatgttaaaggttccgaagtcatcattgtaaaaaattttgtgcaacagtcaaaatacctttcctgaaggaaatatgagacgcaaagcaacatttgtatcctgagaagtgagaaggaatcatcttgaacaacttcatgacttatccgatctttttccatggaatttaacatatcaaaatttttacggccttgaatgatatttttcacattatattctatttcttcaatgcctttgaaattcttgcatagtagggatatttgggtaattttttctaaatgctgatatcgtttagtcaatggaacctcttctgactccatttgaaatattgcgttctgaaaattatgtgaaattatatctcgtgcgatgttttcatcgaatcctccaagcaatgaaaaatgaggttttcctactagttggctgtttagtaggctcacaggtcttaatccgctctcttctaccaaaatttccaaatagggagtgcttgtacactggacttcctgtaaataactaatgccttgcatggcccatcgttttcgttcctctttctcgccataattgatagaaagtaaatgaccaatgcgttctatcaataaaggtcctttagcgccatgaaacatgagtttttagatgtcgagaagctgcctgttgccaactattttattgtgcggttcaaaattgtttttgtctgcacgttatgccctttcaaaaattaatctattgaatttaggggccagtcagaagataagaaaaaaggaaaatgttatcattgttaaaaacataaagttgttgaaaatgtattaacatgtgtattatatatataaattatttacagttaaatttgactacaaactaagtaaccccgagtcgcgaaataaagcaaaggtatcttgtttcttagtggaaaaacttcttcatcttttccaaccaagaaatatactcgttattctctttgaactcggaatatgcactaatgaaagaggctagctcttcattgacacctctactttccaaataagcttccagagattcttgtagttcttcgtccaagtttgaaaaaggtgggccatggtataccaattctcttgttatttcggcctcagcagactgattcaaagcagcatcaactgaggggtatggagtagcactatcaacataaaatgaaccttcctgtaaattcattagtaattcaaatgagactgcaggttcgcttgcgctttctttagaaataacaacattaacgttggcaaagttgtctgataaagcatcaaaatcatcctcattaatgccgtcttcattttgctcggtattttcatccattgcgttgttgtaaggcagattagcaatctgagctacgtcaaaaaaaacatgaactgtttcgcctgattcggttcttctaactatttcagcttcattcttaccgggtgtctctactaatgagaacttatatttgttcaaaaagtcattaaatgagtctaacgacgttgactctggtaacgtttccttctcaattttcaattcagattgcaaaatatcacctactctttgggtctcttggttcctcatgattgcagcgggtgtgaaacatctcttagagttagcaacagtaaaaactctccacgatgattttactacggctggcttgggcgtagtcaaaatgcttctagtgacggcacggttaacgcttcttaagaacattatttgttatttgttagtatatgtgatagtttatgtatctttggtaaatgaagttaacctttactaaaataatgtgttaacaaaatcgatccctatcaactaaaatgctccggattgttgtgctaaatatccaattcgcgttggttttattttactggaaaattgaagcaccgccgggtattggtaaaaagtgtataacaggaatcgcaatagtaatataaaataatttaacaacattcattcgctcttccacccacttcttaatcttaatacatgatacgattactctttttgaagttttgaggtttttgctttataattatgcaaaaaaaattgtttacgtagctgtacaacctacatagaaatatgaattatattatgaagggttcgatgatgaggaaataaaaaggacaagatgaacgtcaaaaaaaaatagtcggggacataaccgatacaaatatgtgtatacttgagaacttcttaatcagcgttacgacgagcaacctttttggccaatcttttaccagtaccaaagatcttcttgtctctgttcttcttttgctttctttgttgtctggaagccttttcaaccttttcagccaaaccgtatctgactaatctgtaagttggttcgaacttcttagcttcggcaacagagttgtagaccaaaccgaaaccaacagatttaccaccaccaaattgggttctgaaaccgaaaacggagacagcgtccttttcagccttgtagacttcagctaatttttcacgtaattcatccttggagacattagctctgtttgggtgcaagacgtcaacaacgaattgctttctggccaacaatgggttggagataacctttctggtacgaatagtgacagcgtcagactataaaaaataaaatgaatggaagcaaagctcaccagtcatttttagcagaatacgttagtaatctaaacagaacaattaatcagaaaaataatccagaaacattacagcagtacttttttttttattctttccaaccctgggaatttgttctcgctgatcttacgttactgaggaatacacagaataaatattagcattattgcaattcttgtgttttagccgtaaagtcctttaaccaatttgtattttaaacttgtggcaccaaacgtatcactagatcttttttgttggaaatttctcccgtgattgtattgtatttatacagccacccataatgctataaccggaatagagcttacttgcagtctgtttcaatttctgctggttcagtacaagttcgacataccatttttattgatcttctgtaggtaccttagcgtttgcagtgagcttcgaataagatggcttaagaaaaacaactagcttacgccattgtctcatcactacaactgtttagctactaacttgcttgacatccaaagagcaggccaatcactagagaatgtctgggatcactcagatgggtacacacaaggcagtggatgtggttgttaccgccacgactagggtcactctctaccgtgaatttcgaaatttcgcgaactgagtgcgccagctagccattgctaccaagctaacaaaaggatcaggctgcccaaacggacgtagactcactgggctccgtctagagaatgacacgaaacctcactcgttgtttccttccgagtgattaactagacgggaatactgcctggaaattttttcggaagagaaagtttcgaattttagttattcagtttcccgaaaaaggaataaaatatgtacagatgtagttgatcaaaaaaaagtctatggacatcattcctactgaaggcacagctagtaccttatttattgctgatgctttagcagatttaatcaactgtcaacagcagtgatattcataagattgttaaataataacaatacacgaatgaagggaaaactatactatgttatatgtaatcagtgaactttttttttttcttgtatatcgttattgcttttcgaattctaatacaaaccgcctcatcaaagtaggttcgcgatccacaccgttggcctccatgttacggcggtattcatgtaacatttccgtagcctgttgtacgatcttctttctttctgagctactcacatctttcctacacttcaatattcctaccagtaaatctatgcgcgagtcccagtatacttcaagatacttttgccaaatatctaatatgctatctatcggctcacagcttaggtccatgaagaactccattacagtaaaattttgtgtaattagcgtatccttgctttcattaccatccagcaccttgacaaagagctgataaaaaatttcaaaatccctcttcatcgcctctaaaaacttattgtttttgtttttgaatgaatgctcgaacgataaagcagtcaaaaattttataattgtctcaccaataacattgtctatgaagttcacgaacagcacagaattcatctgaggtttgatatccaaaagatattcatctagtgtgtccgcaatttgctgcgcttggctccccatataccatgtcttgctaaaaatctcttggtagggttttctcagatcatcgaacatcaatgtgattaggcctaaagaactgcactgagcaacttcagcaaaaccatctaaagtgccctccaagtgatttgtaatttgcttctcataaactttagaaaccagtttaccatacttggatgaaatggcaacggcatagtccgcagctttcatttggtcgtttgatacagcaattaagtattccaccaaacctcctggacactcatcttcaggagttatactctctggatctatatcatacttgtgattgtaattgatttgctttttgatttcttcacttattttagaaatccagtttttttgcctctttgttagtagatcactgaacctttcaaccacacccacaagtattttggcctgattagtacctgcagccacttccacttgctgtgtaaacatttgaaaacaagtcttagtaccatcaagaaaaagcaatccatctgaatcagaatgtggcggggtacttctttccaagaatacatcaaattctgctttttctaaattacctatccactcggtcattttaaccactatcaaattcaaatagtctttaaatagtgtttccttttctttatcgccgatgacagatttgacttcgcttttggtaaatccaaaatcttgcttaagtgtatcttgaaacgtcttatcgaatgcaagaatatcaagaataataatggtctcgggttcggactccacgagatccgtaattaatgaatgcaattccttatagtattggtcaaagtatacttcaaatatgttccaatgtggtggacagcagttggcaatatgttcctttacaataatcaattcgttgaaaatccaatccatgttatcaagaacatcaaatttttgatcaccaacgtatttttctctcatttcaccaaacatttcagaaatggaattatttataccatttattagaaaatgcttgtaacctcgaggtgctgttcttgttgagatggtaccgctcattatttcttggtataatcccttgtttgtcggatattctataactttgggtgtctcatcttgtaaccttgcggtgtttttgctatttggaagttttttaattgaggatttttctatttcaatttctttcttcttgattatatttctgatagcttcaattctcaaatcttccctttcttctaggtcataaattttaaaaagtcgaattgctaaagatatttgctcagctctggccatttctacaatatcgtaagttaagccgtccagcaatttatcaaattttgatattattccggataatcttgaaaacaatttcatgactgtacgttgtgcatcttcagttgcttctttagccataacaacaacctgctcttgaaagtcgcgtgctgaagttaataggaaatgaatttccaaaagatggggacaaccagtttccagggcatcttccgctaattccgccactaatagtctttctatatgctccattagtgcaacaaagttatatattcgatcataaatcgatgatgtcgtattgaccgtttcataaagttttgtggctcggaaaagtatatcataacgattaattgcaaatcgattatcattacccaatttattaacttcattgatttgttgtttgattgaagtgaccgaatttttggacagattcagtagtttgagggattcttcgacttcgccatagtatttgtctgattctttattcaattggtattctacaacggatttttcttttagcaactgttccttaatatctcgtaccctttcaagtgatagatctccctttattaaatcacaaacttgctgcaagggatctgaagacatcttagtaactagatacttgataatatctctgctctcggcccaattttacttcttttcctgcttccctacgggtgttcttaaggtgcactagttgctagagtttacagtatgttttcttattttccgatccccaaagctcggcaagattaagaaaaaaaggctagctgtacataagattaataacatcgtattaatgaatctatcacttccaggcccattctatgtatagtatgtaaatatgtatttagattatgatacgcctggttcaggcttttgccacattccgttcggccactgtaaaactcctgcattcgtatagtcacctctattcgttggagaccgtacagaggcacgagccactcttaaatacaagtctattgtcccgttagaggcatcaagagcatcgtccatcatttgagcaagtgctggattctccatccgaagaacatcgatactcacagtctcattcttgcctacgtacacttccacatcgttcaaaagtaatgaaaaaccgtcgatgtttcctatttgatcaattactggatcagttgcatttagatgccacgacagagaatggttttgatcgtcgttaaaatccagtataggtggcttcaaagaagcacctgcttctcctcttaacaaggccgtatctgtctcaactatgcttgcaaaatcccatcttgctacaccagacagaattaacccgactaaaattccttggaacagatatgcagatgatcctctcgtggcacagcctggaaccagtatagaacctaagatgtagtgatgtatcctcaagttcagtcccggcaaagatcccaaagctattaatccgccaatgaaacaaatgtatattttaaaatactttttgaatcttcctgatttccagagtgaataagcctgtataactgcgcatgtaagaatagtggctgcaatagatcccacagcagtcagtgctccagcctgctctttcaaatccgtcgtcgtaagtctatcaacaggtaatcggtcaaatgtgacattatttgagattcccaaccaaaatgtggggtaccaaagtattacttttgctatgggcgatccattttctagtgttcttttcaccgcactcttccaaacgacgtataaaacaaagcataaaggtaaaagtctttgaaatcccacactgaaaagctcatacacgctagctgggtcatgtgcatccgttagtaatggagggtctagagataatacaagagtccaatagcccactatcgtgtttatccagtacccgtaaatactgtcatacaaataaaatattggcagtccaaaaagcatattcaatgcgaccacagctgctcgaggatcataacagcccgacaggataccgccttgtatatctctgaatgaatatgaaccgggaaaaaatgaattgaatgctactgaaaacccagtgttatacattcctttttttgatggaaaagaattttgggccccttgcatagaaactttggtacagccaccgtaaaatggtgagataacacctgcatgtactgcagaggcgcatggaaacgagtcacttctataagggtaggacacgaccatcgggtcttcttcgctaaacagggcacctccgccaatttcataccctgtatatttgactctcctattccctacggcaatggcggagtatgtccatccacctctatcacacagtgctggacatctgatcatgtattctttattatcaagtggaccgcagtttttagcatttaaaccacattcgttattggtaccctcccagttcaagtaggaattgcaacttaaagacaatataggaatcttttctgagccatcatttggatggaagtatggcggcttgataagataggggtatatgagagaataaaaaatgcgcatccaaaagcagcagtacacaatcagtagcaacagtcgtatcaacttacttggtattttagttttgaatgtagtctgcggaaaatcatctatcttcttcagccatccccaacgtttaggaaagctaggcggttcgtcacttggctcaacagggccattccaaactctttcaataaacttttgtataggatgtttcctttttaatagtaaccattttgacttactgttttctctcccttcttcatcaagcatactttccatgtctgtattggaaaagttctgcagttgtatagactcagtcacacggtgctgtccatcgcaatcacttgaaacgccagggtctgtggcttcccacgttgtgttagcattatcatcaaaatgcacacccattcaattcaatgctaaatggtctatctctcacaagtctaatactggttgaattgtgccttagttatttatataattgaatgtattttgcgattttacactctttacggtatttagctgttttcttctacaccccagagtaatttttttgcgacggtaaatctggaaaataatcatagaatacaatgagaaagaatgtaaaagaaataattttattagcgtacatgattgtgtatatgttttgtttaaaaaagtttatttaaaaaaggtcttaatacatactaacgaaaagaaaccgctccaagttagataaggaaagggaaaaatgccaccagaaagaatcaaccggaacatgactcacaagcttctggagtaggagcagtacaagcaatcaccttttcattgtaaatgtcacatttcttctcgtcggaatcttcttttattgtttccgttggaactgctggggcaacactatcttccaatttcacatttgacatggcactcgacaccgatgattgttcggatggaactggagatgcatccttctcattatctgagctttcggtaagcgcagatgccgccttttgttcagagaattttgtaccctttggaacataaactggacgatccaattctgagacggaagcaatatgtgtagcggcttgatcggcaacctcttgatcaatggtaaattgaatagcagcggaggcggcttgcgttcttaagtagtacataccagtttttaaacccttcttccaaccgtagaaatgcatactagtaatcttacccattgatggtgcttgcaagaaaagattcaaggaatgagactgatcgatgtagatggcacgatcagcagccatattgataatggtcttttgagagatttcccagacggttttgtataattccttcaattcttgtggcacatttggtaagccttgaatagaaccattttgtgtaattagatattgtttcatactatcatcccaaatacccaggtcgactaaatcacgtagtaaatatggattaacaacttggaattcaccagacaggacacgacgagagtacatgtttgaggtcactggttcgaagcattcattataaccaagaatttgggaagttgaggcggttggcattggtgccatagtcaaagagtttcttaacccatgtttaacaatgtcctttcttaaggtttcccaatcccacatgccaaatggtttagcgttccacatatcgaattgtaaaatacccttagaagctggagaaccttcaaaagtagaatatttaccttctttttgggccaattcacaggaggcttcaagagtagcatggtaaatagtttcgaagatttgtttgtttagagtttgagcttcttccgattcaaagggtagacgcaacatcatataagtatcggccaaaccctggacaccaagagcaataggtctatgcttcatatttgaatttctagcctcgggaactggatagtaattacggtcgataactctgttcaagttgtgagtaatgactttagcaatctcgtgtaatctctcgaaattatagcttgcagttttaccatcttctgaaacctcaacgaatgctggtagggcaatagaagctaaattacaaactgcagtttcatccggggaggaatattcgacgatttcacaacataaattagatgatttgatagtacctaagttctgttggtttgtcttcctgttacatgcgtccttataaaccatgaaaggtgtacctgtttctgtctgtgcttgcaaaatggcataccacaacttttgggctttaattgttttaccacgaccttctctttcgtaacgagtatatagttcttcaaattcatcaccccacacatcatctaaacctggggcagcactgggcgaaaacaaagtccaaggcccatcctcttgaacacgtttcatgaaaagatcagggatccatagagcagggaacaaatctcttgcacgaatttcttccttaccatgtgtttttctgatatcgacaaagtcgaagatatctgcatgccatggctccaagaaaagggcgaaagcaccaggtctcttgttaccaccctggtccacataacgggcagtattattgaaaacacgaatcataggaatcaacccgtttgaagtaccgttggtaccagcgatataagaacctgtggaacggatgttgttgatatgaagaccaacaccacctgcagttttggaaatcatagcacattctttcaaagtatcataaataccttcgatagagtcatccttcatggcaattaagaaacatgaagacatttgaggatgtggcgtaccagcgttgaataaagttggggaagcgtgagtgaagtatcttaacgacatcaaattataagtcttcagcacagattcgatatcgctaccatggatacctagcgccacacgcattaccaaatgctgaggacgttctgccacttcaccgttcagtcttagcaagtacgaacgctccagtgtcttgaatccgaaatacgtatactggaaatccctatcgtacacgatggccgagttcaaagtatctttgttttccatgacaatgttgtaaatttcgtccgaaatcataggagcatgctttccagtagctgggttaatccagtcgtgtaaatcctcaataactttggagaattgctttgtggtttgcttatgtaagttagagatggcgattctagcggctagagtggcataatcagggtgcacagtggtcatgtatgcacatgtttcagctgcaagattgtccagctcaacggtagtaacaccggagtacacaccagaaataatacgttgggttaccttaacagcatcaatacggtttgggtctaaaccgtatgacaaacgggtgatacgggaggtaattttatcgaattgaacgggctctttgcggccgtctcttttaataacgtacatttgtgtgggagtatttgatttattgctgctgctattcttgcttgtcatatttatttcaacttggatatgagatgagagaaaggcaaggaagaaggcaaaagaaggcaaaatagcagtgcgtttatatacgttttgcagcagaacacgaaacaatataaagaacgctgacacgaaaaacgaaacgcgtcagcatctcacaatacagtattacgatttaacaatagactattgtttttttcccatcttgtcgtttggtcctcgccatggcaaccgggtttttgcccctttgagcagcgcctaggtgtcgttgctgcgacaaccacgaaaaaaaaaaaaaaaaaaaaacaaaagaacaacggcacgcaatgttgctgtgacaaccgtaggcagataacttggctttttttactactttaggaaaattagcagccaagaacgagggcttgctctgctacctagttcaaactgaaacaagccttcactttcttttcttttctttttttttttatctaacaactgaagattaaatgataaatgtttacgcgtgcgtgcgattcattcttatgtatgtacgtatgtgctgattttttatgtgcttgttaccttctcttgtttcttaagaagaaactagccacggccacagcgccggctagtacgcctccagcgacgacaacacccttgagtgtttccttctggatcttatcctctaccatactcttcaaagcgcccacctgcttgttattacgctcatgctcaaataaagtgtctacatatctcttcgccatagagtattcaccgagtttgtagcaacctatggtcagataatataggcattctcgtctacgggactcggcctctttgtaaatgtctgtgaggattttcacaccaagcctttcgtcattcacgtcagtggatttgatcagcccccatgcgtagttaaaccttgactgtatggtagcggtgggccccccctcggagacgacttgctggcgcagaatctccagctgctgcggatagagtggttcgtatgcgtccttaagagttggccaaaaatctactttggtcatacttatgttgtatggctgtgctctgatctgtgcttctatgtgccgtttttacgcaaggtatatgataacttctgtgcagaatagtggcaatggcagctttgctttgaaaggggtccagcctagcccgcttgcggtgttccggcataaatgcgcaaaaagattggttcatgaaaagaagtgaaaaaaaatcgatgagctcagctcttaagaacggtattatggaacgaactcaacccgaaaaggtagtacagatgcagggcacggcagatttgagcacttcgaaacttggtacgaaaaaatactgggatgaactgtatgccctggagctggagaatttcaggcggaatccgcaggataccggggactgttggtttagcgatagcgatgctgaacaaaagatgattgattttctggtagataacattggtgcgtacagaatttctgagaatgcttctgttgtagacctcggtacaggtaatggacacatgttatttgaactgcatcaaacggaattccaagggaaactggtcgggatagactattctgaggaaagcgtcaaactcgctagtaatatagccgaggccaccggtgttgacaatttcatcagtttccagcaagcagacatctttagtggtgactggaagccgggaaagtatgacattgtgttggataaagggaccctagatgccatttcattgagtggcatgaagatcaacggtaaacttgatgtagtcgatgtatacgccggagtagtggaaaggattttgaaaaaagacggtattttcttgatcacttcttgtaatttcacacaagatgaactagtaaagatcatagagactgataatttgaaaatgtggaaaacaataaaataccctgttttccaatttggcggggtccagggtgcgaccatatgtagtgtagcatttgttaaacaaaactgatttgtttttatctttgatttatttttaacgttatttctctttacttatttaggaacggatttaactataatgttatacaattcatccgtggtttccttcttaccagtctttatggcgtactgtgcaggatcaccgttatcatctactgctagtaatcttatgaatttttcgctttgcaaagaacctgtaaatcctttttgcacagtgaaccccttgaccagttggatgtttaaaatgacttttaagataccacgagacctcataacaatacgcgtcttctcgacgtcgtccttacttttattgattttgatgataccaacacctctttccttccagccttcttttatgttggaaagttggtacagcttcgcattgacttgatatatgcactcctcagactcttcaccagacttgacttcctgtttctgcaatttgaggggttttggtttgtcttttgtatcttctgaggcattcgctagttgttcagatccactatggactttatctttgtcaacatcagtagctttcttttcactttcagagttattttctgttttgtttttcagtatgttgaagccgctgccaaatgataaacctgaaccaaatgcaaatggcttctttgttttgctgtcagaggctggtaaactttcagtactggtagttgcatctccatctttcgtgtcctttttggcaacaccaaacccagttccaaatttagatgcggcaccaaacacgaatttatcctcctttttgtcatcttccacaataccagattctacggtctttccgtcgtcaaccttgatcttcttatgcgatggttcttggtcttttttaccttcctcctttttctcctcatcatttttattgggtgcttctgatttgtcactcgtttcttccgcttgttcatcctgatctttttccctcggtctcttaggagttccatctagtttatcgataggattttcaactgcagtttgtttcacctcagaattttccctggctgcattgccaccattggtctcactcatgctctcaaagtttatgcgtacttgttttgtgcaaattgatttgttgacattttggtttgagtagcaactgagctttttaaaatccaggcatttatatcttcaacctcgccaaacaatgtcaatttttttaaaaaaaaactcaatacctacatcaccgcgaaatgcctgaagtaaaagcatataacaaacgcgacccttaaaattacgtatatatatgtatatttctttatactaagttttactgggcagagtatcatacagttcttctatccgatatataatgaacgataggtgtgacaccactgacttgagtaattctttccagccacgcaagcaagacacccccttgtttctggccctgaggtacggacattcctttgtagagatactttaccagcacgtccctctgagaatcactcaaatttttgattacattaccaatatcggcttgcctgacttgtgtcaatgcttcaaggacgctcttaaaatattgctcctttgttggagcatctgcactgtatggaggatcggttgtgagtaattgaacggctcccaaagagtcaccacttgtggcaagcgagcgcaattgattcattcgaggttgtaattcttgtaatgtgacagtagtttcgtatggtggtaccagatcggcagcggttagtctgccactctctggatcaaatgcatcgatgtcaattctcctccaatcggcttccattgcttgatcgttcgcgtgtgttgtgttgagtcttctctggtctcctttgctatagtatcttgtgttaaatgcgggctgtttttctcttattttgttataggggcaaagtctgagaaagggaaaaaagtatccaaattaactgatgtgcgggtaatcatagacaacaagtagcagagtttaagtattacttatattcaatagtcgggcgcttctttgggagctggttgagactctcgagtccgtgagtttctagatttatatacagaagtaacagcagcagtaggagtggcggcggagagcaatggcctgtttccacggtacctcgcgtccaatgtggaactgccgtatctatcagcgctatatgcggaggaagaagtttccctgcgtggcagcctgggagcataatttctttcggcgggatttgatgtacttgcgcttgcaaaccttcctggaagcctgctgtctctgttggaatagcctctgcctcctaggccgccgcccaatcttcttggcttgaaatatttaacggttctgcctctttctatgtcgactatgcagattctgtctttgatttggatacctctgtgtactccaatctccttgaatgccattttactacttattgggtctttgaaaactatgaaggcgtagcctttactcttctgggttatcttgtccttgactatcctaattttttcgatctcgccaaacttaacaaaatacttttgcagttcaatttcgtcaagatcgtatggtagcctcccaataaatatcgttctgtagggatctgtgtccttgatatgagggtcaacgttaggattccaattttgtagtctccggtctaacaattgagcatttttgatcttggaaagtttgatgtcttcgtatctttggagatggttgtttggagatccttcaggaaactcctccatatagtgcttcaaagaggttgatagtaagtttgcaacgccagtgatatttggatttgtttgtctcttcgcatatgggtaatcggttggtcttttgtaagataaaggtggccttggcttgaaaagtctcgacacgtcgtctggatacttggatagattataattcatcaaggttgaggtgccgattacttttttaaggtttcctttcgacagtcgatgaccgtgctgtgtgtcattatcttgcagttctttttttcttcagatgcgttaatttcctacgaagggcgcatacaatggtgctgatgggatttatgagcaaaacaagtaggcgagcaagacatgaacgaaattgtaatgaagcgtacttccttttccctacaaccttaaaaaggtctcactgatatatccattcgcaataatgacaagatttttgcatgggacttctttttttcttttgaataagtcgcgttataaggacaaaacattaaaaaaaaatatgtattgattcactgatttatatatacagaagtaagtaccggggtacctaaatatacgcataaaagtctctttcttttttttttttttttttttagcttcctacatttcgttaataatattatatagattatatttatatttaagaaaagtaatatcagcatattatgaatagacaaaaaagtctaaggtcaagatttattaaatgttagattattaagattacaattaacaacatttgttgttacttcataaaatttcgttacttcataaaagaactacagtcccccacttctaaatgagtggttgtaggggttcatatacctcccatactgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtacattctacatacctaatattattgccttattaaaaatggaatcccaacaattatctcaaaattcaccaactcttcacatacatacctgcggtagcaagataggtacactttttctacgtttcacgaaggtagcgataggtacctcactcattgtaggtgcgggggtagcgatggaggtttctgtaccattaccaccacagccactatactcacgtagtgaagtccctagcgtggaattgtgtggtatcgttgctatctgtcgttcgccaccctcggtatatccaacgtgcaggccaatatcactctctaagaaaatcgtatcaggattggtacggacaaactcttcatagcctacgtcgaaatcaaattctgctaaagctgtgactgtagttaaacctaaaaccgcgattattgcttgaaaaactgtggagaaattcatgatggacggtcacgttcagggtctgagaaaaccactcattcctatgtcccatgtggttggttgcaatttgctgctatatatacgacttggctgtagagagatctacgtaggatgtgtccactatcaaggggggtttaccaacgttatcttctattttaagtgctcaaatgaaggttgcattatatccctggcagttttcccggcaattttgccggccgcttataatagtcatggtgaaaggattgttgcttgttgtggttgcaacatgacagttgcctactaactaaataataatcaaagtcagtttctcaacaatggaaaacctgttgtgaccttatcgaagtaacaacatcgtataataattaatctggaaaaaataccatagttactgccgatacaggtctacgtgacttactgacaaacagactgagtgactacgagtccagaaatttagtataccatattgtcgcttcttcttatagcccagctccaggtctggatacggttctgtataactcgttaaggtttaagtgtccggcaatttttttgaagtttcatttcttcactcgatgaccaagccgtgtgccatcttttcgttttcttttttttcaatgtgtttaattatctacaaagagggcacacacaatagagctgatgagaacccatgagcgaaacaagtagaaaagcaagacgtaaacggaatcatggtggtgtgtacatttctctttttttattacaccaagaaagcttaattggtacgtattgttcgtgatagtagcatgaatctagcgtggaattcttttatttaaggtcgcgttgtgacgacaaaacattaaaaaaaccacatgtgttgatttgtagacttgtatacactccagtaagaaggtgcacaccaaaatacatgcgcatataaattattttatatagcatgctatatttcgtaaattcataaaatttcgttaattcataaaaacagctccccaaacttagatgagtggctgcaagggttctgtcttgtaatcaacatctaccattgcgccatcgtgtttacatacaacttcgacagacaccttgaatttcttggcgttcaactccgtttcttcgccataattccaaacaatccggtcaaaggattcctgctttttcttatcgtggaatttcaattctggcttgttgatagcggttttgatgtcctttagcaggtgcttctcaacatgctggtgtaaatggcgaacaaacttcttagagtgcgaattggcagtctctttgatcttttccggatcatcatgcgcatcatgcaggacaaagggtggatagtacttcagttggcaatggacatggtcgaactcttgatcttccgtctcaccctttaaatatgtttcaaaatcatgcaaatcctcaaaaacctttaaggactcaccactttttgtagtgatggtggacatcttaggaccctttgctttcttatcctttttcgtcattcttattatttaaaatactttgttatatactgtacgttgtttcgtttgcacttaatcgtgtttcgacagataggtgaatcaagatctacctttacgcgaaagatacgaagaattgagaaggaggtgcaagggaaaagggcaatagaggattgggacagccgatgcttatatacggacgattgccaaccgccgaaaaggttcaagccaagaacaaaaagtagagagaataccccaacaatagcatttgatggctaaacggcagtgcccgttaatactattcaaattataccccgcattaataattcctgtccctttagtctcgtccttcagccgtatagccgcaaaacttcgttcaatgatttcatgccatcattacaccgcgagtcgtgggtgcattgtagtttattacgaaaagtatctacaatacttgcttaaataacctacattgttttaggcactatggccgagtggttaaggcgacagacttgaaatctgttgggctctgcccgcgctggttcaaatcctgctggtgtcgttatttttttatttttattttttttttatcgcttactgattatcagatatcttcgacagcctcacacagattggtgatcacgcacccataatcatttcttcgggcatgctcctattagccacggttcgcagaataatctgcgcgatgttattcaccaagaccgtggagtctccttttcggtgggatccgcttatatccgtatgcgtcggttgctttctcggggaaaggaaaaggagaaagcccggataacacgacacaagagtcattcgttatgcacggacacagggaatcgtgcggagccggggataagaggccgtgctaatttccgcggaacatcggaatgcagtggacaagtgccctgagaacaagcggcgggcgggtagctgccacggaataggcgccacgtttccgtgggtgactatgacttttgatcgattccatgttgttttgccctgaattctgcgcccctcggagaagtttcttttcttttttatctctttttcatctctgaccttcgtttcctttcatatagactacgcagcagaatcatggcaggagctattagctgagtgggcagattacgtttgcgcactgtgcattgtgacagattatatttgcttcgcttctccctcttacttcttcagcataagtgtaagccatatgttccctgaaatctttctaccgtcgtcttctctttttttttttttttactataaatcaatgtgctctcttccatgattcttgccttttggatcttcggtacttgtgtgggtgagaatggtgttattgagtcaattcaggtcagcttggttcagttctaatctagccctttccctactatacaaatactactagcctttttttttctctctctttctctataccactacctcttcctcttccttttttttctcttctttttctattgtccccatcgcatcttagcataaacgcatccgcattcccttcctacatttttcttttctactagttatagctttaaaaccttctttattctctttctacctattcttcttcgttgcttatatcctatacacatatgaacggtcctccaacattcactcaatatagaataaataagttttctgggaatggagcaactcataagattagagaattactcaattttaatgatgaaaagaaatggaaacagttttcgagcagaaggctggagctgatagacaaattccaactaagtcaatataaggcaagcgaacaagatcaaaacataaagcagattgctacaatattaagaacggagtttggataccctgtaagctgctctaaggaattcgaaaagttagtcactgctgctgtgcaatcagtgagaaggaatagaaaacgatcaaaaaaacgctacgctctcagcatagccaatggcagtggcggcaatgtcaacaacagcatctcgtcaaattctacttctgacgacgagatctctccgtcgatctaccagcgctccaattcggacttcctgcctagttctaattatgctgcagatttccagttttcaaacaagttccagcctctcatgagtcaccagagtcataacggaaccatttttccaaccgtgggcacccaaaatgactcatctccatcggttacttcgacccaacaaaagtataacgatatagtcaccatgctagtgcacgatcttgttacgaatgtcgtacccctatcagaacaagctctcaaggacccatatactgggccaaacctgtcacattttgctacgtcttcactcagccagcaacctaacattaccacaaacatcccgatagattctaccgtgccatttttcctgagggaaaagttactcctacaaatccaaagatcaagaacttgtcaggacatttcgcaggctgcaggatccattgatatatacgcaaatctggagattttgggtgaaatgtcaatccgaatgtctattgcattcgttatcgaacgatttttctccaacttggtctcttcttcaatgaagtatatcactgccaagacgtgctctcctgaaaatctggctttgttgtctcaaagactgttcggtgccgctacaagacataacttatctcatttccccgcggctcaggtacaactaaggctactgtatttggtcataggtggtattgtcaaggattttggcttcgaccccacgctttaccctttaagtgaaatcatacatcatattgtgatggttcagtatcctttggctagttcctgtgcgtcagaaccaccatcatcttcacctaacaagagggttaagagaagccctcctgtcgtttcaagtgacgttatgttgaataataataacactctatcgaatagagctacacttttaactacgctaccaatgaagcctcaatcggccaataaagatgttaatcgcagagtgatcattagatttaatgatcgcgagcaagcctttactttccaccagttgagcaatggaccacccacggtgtctgaagttttggaaaactgtaaaaatttatttaatattatcaacaagaacaagaattttggtattttccataacgataacctcttgaacgatgaaagtttggcaaagttatttgattccttttccacgagcgagattcatctcgtaattaaggacatttccaccattccactacaagatgcaaaaataccagtgcccattacgttgcccaaaatgtcatgcataggtgaaaacccctctatgccttctattccattggtaccacaagaaaaagatgatccaaaaaaatcaagcttaactgcctttgataacatccttaataggatctctaaatcgccaatgaatgaagaaaatagcaacactactttaaacactggcacctccacctccaacacaaataataatgaccacaacgagtctgtgccagcgccatacgttacaaagaacaaaaattcttttcaaaatggcaatttaccacagccggttttccagcctttactttgataaaaatacaaaacaaaattgtctacatacataactgcctaatacacattctacacaatatttttttctttttcaattcgcgtacatatttatgtaagataaaataataatatcctcttaatccatgcttagaactgctgccgttgattttcaaattcatcctcgtcaaatggtggcagttccattacatgaattttgtaccccagtgaatattcctggtcttgtaaggattcgaacgtcaaatcagacagctctttatcgtggaacccaacaatggcattatacacaattgtgctaactttaaagtatttcgccttgctatcaccttcggagtcagagacgtttccactttgtgcaaaagtagttggcaaatttctattaaactcctctaattcatcttccggtaattcaaacctcagtagagttgcttcttcatgatcttcataaacccctacatagaattcccttgtattattgatagatgttcgaggtccgccatttgtgtatgtgctattatttgcactcccgttggtgttctcattttctgatatctttagagcgtccatagattcattgagtaaagatgcttcgttttgttgctgtagaaactgtctttcctgtagtcttaatagcttggggcatttcagttttataaaatcttttagaactgtccatcttagccttccaaatttttccaattgtcctttctctttaatttcaataactgtgaacttctcttggttcattaactcattgaaatcagactctgataatttctccaagaattctataggtatatagggtgggaaatttatgatcttcagctgccacatacctctattcgtcatttgttttctaaagcttttctcgttaaagatatgctttaatcttttgtgatttatttgagtttgtgaaggtgtaattgttccaccattctttgcttggagggcacggtcatcaccattcgtacttgtagtgggaatattaccattattattggaatttgaggccatgttcaagttgtaaagggcagatatttcgttataagagggatttatcttattgttccttaaggagaggtgatgctgctgagaaagacgagggcctgtgccagtatctggattcctggggctattatgcatgtatttttgaaactggctttggttctggtgatagaaatgccgacgacggggatagtgtgtaggggaagcaagtggaccaccagcagtagcagcagctgttggtgaaggtagagtagtttgatagggcatctgcatattaggtaccgttcccggaggagcacccaacataggtagcatcgaagtcgaaaatggaccatgaggcgggggagcaagaggtggcacaccaacaggtacgggaacaggcgtgggcaatggcgttatgttctcattctttcgaaggctcacttcaggagaaaaactgaaaaattgagaaggtggggtagaagcggatggtggctgcggtgtcacagatgaaacatggcttgcatatcgaggagaaatagatcttttagtttcatcgggagcactccggacgtcattgttgctatcactgatttctggatatcgcagtgaaggagaatcattagtgtacggcaacaggtaaacgaacagatcatgataatcccattggtaggtgttcaaagtaagtagtaagttttccagggactcgttatctatcgagttcttcagaatgacaatgcaactctgaaaagtaataaaaggaggaaccatggaagtcattggaggcagcattttcacctgtaaaatattggtatggtatatgattccgcctatcaaatattttacctgggcccaagtcttgcccggagggagattatcaatccttatgggaataccatttgactgcgagtacgtctttttcctaggagcagcttttgtgcttgctgttgagctttcggtcgcagaacgggcaacaaaggcactggctgaagcagccgacttggcactatagtgtggttctagagtcattataaagcaagcgtattgtaaggagagacagcaaactctcgtgtatcagccaactgaactggaggccaagaccaatctaaaaaaaaaaaaaaatgaaagaaacaagtgtgggaggaagtcttgttaacttaacagttaagcaagcgtaaaaacctttaggaaagcgcacgaaagaaggccaacattacgactatggaataatacaatgcacacaaacaaaaggtaacatttgaaaaatggagtagagaatatattccattcccctaattttttgcgggtcttccagggctgcgaacccatcgctcaaaacaagcgcagtgtcaattaagacatcattgaactaaaacggaaaatttgcttgcgccacacaccctggtcaatcgtaccaagggatatcactctgtacgggtgggaggaaggcgcggcaattagaatgtgtgggtgcggaagctcgccgctcccatcaagagagtggaagacgtatggtctgggtgcgaagtaccaccacgtttctttttcatctcttaagtgggattcttacgaaacacgtcacagggtcaaaagaaagagaacaaaagcaatattgtaattgtctcagtccacggcaatgacatggcatggccccgaaggctttttttgtctgtcttccttgggtcttaccccgccacgcgttaatagtgagacaagcaggaaatccgtatcattttctcgcatacacgaacccgcgtgcgcctggtaaattgcaggattctcattgtccggttttctttatgggaataatcatcatcaccattatcactgttactcttgcgatcatcatcattaacataatttttttaacgctgtttgatgatggtatgtgcttttattgttccttactcaccttttcctttgtgtcttttaattttgaccattttgaccattttgacctttgatgatgtgtgagttcctcttttctttttttcttttcttttttcctttttttttcttttcttactctgttaatcactttctttcctttttgttcatattgtcgtcttgttcattttcgttcaattgataatgtatataaatctttcgtaagtatctcttgattgccatttttttctttccaagtttccttgttatgaaacgtttcaatgttttaaaatatatcagaacaacaaaagcaaatatacaaaccatcgcaatgcctttgaccacaaaacctttatctttgaaaatcaacgccgctctattcgatgttgacggtaccatcatcatctctcaaccagccattgctgctttctggagagatttcggtaaagacaagccttacttcgatgccgaacacgttattcacatctctcacggttggagaacttacgatgccattgccaagttcgctccagactttgctgatgaagaatacgttaacaagctagaaggtgaaatcccagaaaagtacggtgaacactccatcgaagttccaggtgctgtcaagttgtgtaatgctttgaacgccttgccaaaggaaaaatgggctgtcgccacctctggtacccgtgacatggccaagaaatggttcgacattttgaagatcaagagaccagaatacttcatcaccgccaatgatgtcaagcaaggtaagcctcacccagaaccatacttaaagggtagaaacggtttgggtttcccaattaatgaacaagacccatccaaatctaaggttgttgtctttgaagacgcaccagctggtattgctgctggtaaggctgctggctgtaaaatcgttggtattgctaccactttcgatttggacttcttgaaggaaaagggttgtgacatcattgtcaagaaccacgaatctatcagagtcggtgaatacaacgctgaaaccgatgaagtcgaattgatctttgatgactacttatacgctaaggatgacttgttgaaatggtaattttcttttatttttttgataaaactactacgctaaaaataaaataaaaatgtatgatttccctccatttccgaccaattgtataattttatatctgcatgacttaataatataatataatacttataaaatacgaatagaaaaatttaaaccgatgtaatgcatccttttctttgtcgtcttcggatgatctgccgtgacaggtggttcgcgcaaatcaagctggtttagagaatttaacacagaaataaaaaaggaagattcaatcttcgtttttgttttatatcttactataaaagtgtttttttttagtacgacgagaagttagagtaattataaaaggaatgcttatttaaatttatttcttagacttcttttcagacttcttagcagcctcagtttgttccttaacgaccttcttaacaatcttttgttcttcaatcaagaaagctctgacgattctttccttgacacagttggcacatctggaaccaccgtaagctctggaaacagtcttgtgggtcttggagacagtagcgtattgtcttggtctcaaagtggaaataccttgtagagcactaccacagtcaccacactttggtctagtagccaacttcttaacgtgttgggcacgcaagataccacctggggtcttaacaaccttgattttgttagaacgggtgttgtctgtacgtagtaaagagaaaattttcccattaatgttagtaatcacttctttattatcctatgatttaagaacttgagtgggattgctccatatgaaaagtatttcggcgttgctgaatgaatattatctcatttcaatctttcaacagcggagaaaaattcattttccatttgggtcgaccaaggtcttccacttagaaactgaagtcaacttattgctgtccacattactggatactgttcgttcatgctgtctaatgttttaatgtcatgccaatatatttgaaagttcttgcatagttgattcccctatcgatgatctggttcttcctatttctaagtggtacgcttctctaaatagcactcgttcgccttttaacctcattttcccacaatgaaagttcaaaataagttcataataagttcataataagttttcatgaaaactcaaaaaaatagttcagtaacatacatggatttcttcttctgaaagtaacacgttgagccatttttagggttgttcgttgctaatctattctcagtttcaatcaaagtaaattgaatcaaaagaatataacaagtgccaaatactatgtactacccgttatttactacttacaactaataagttcatcaacttttacgtagaatgctattgaaacattccaaacttacccaccagctgcgatgaaacggctcctgagagcccgttaccataccgtctgaacgggtgctggggccactgacaggaagaggaagagttagaattgttactggctcctcccccaggcgtcaattccatctcctcccagaaggacggtctctctgcccaaaggaatgaactttcatgggaagggacaaatgaagcggactattgtcggaagcgggacctccgaaagcaaatgaaagtaaaaattcaaaaattcaaaaaaaaaaaaagctgaaaggaaaacacccaaacaacacacggtatgtgacgacatctgtacaccgcaaagttgtgacgaaaacacagtcacagttttttagaatttatgattagagtgttcaagaaaataagttccaacacgtaataggtttctacccctgtcttgtaacattgatacaagtagagggaaactcccctcacattttctacaacggcaagaaactgattctgaaactccgtaaattcgtttcttttcttagttaaaatcttatatacgctaaagaatgctactaaaatgtttataaatgtacactcctcggtatcgcaagtggaaaaaaggcagtaaagaagtttcaatccttcaattcttttcaacagcgataacttccatttctaaatcaacattcaaaggtaaggaagcaacaccaacacaggatcttgcaggcttatgggtgtggaagtgtttggcgtatacagagttgaattcggcaaagtttttcatgtcagccaagaatacgttgactttgactatattgtctaaagaagaattactttctgctaagatattcttaacgttttgaaaaacttgttcggccttctcagagatagaaccttgaacaggcttgttatctggagtataagggatttgaccagacacgtacacaaaattgttggccttcatagcttgggagtaagaggcggcagcgggtggggccaacttggtgctgaccggggtcaatgttgttatacccctcctcaagactggagctgttctcaaaacggaatttcttaaaaacattattggtaatatatttgtgtgtatgtgttgtcctttttacctgtaaatctcacacaatttactagctaacctaattcttatgcatgtgtaagacccatttagtcatatgtatttatatatatcaggggatccatacggtgtgtttttcgctggatgagcgacagaggcggaatcgcatctccgcaaatgagagcgtacacaggagcaaagtgaataacgtccttcaatgatagagacttatccaataagcagcactggtcttctaagatcaccgcctgtgcacttttctacgggctcttttaattgtataacatggacagtgatcattgcattttgcatccataggcatactatggcttaaggtattactatctatcgcgcctaatctctgggagttttgaggccggtttcggaatctcggtatcttgcgatgggtccaaaacggtgtaaacaaagcaggggatagcagcgcaggcttcaacatctcaaacctttatatatacaaaaagtatatctatatattcatctacggttcttaaaatagtacaacaaaagttaacagacattaattactgtaatcagactaaagcaaaccgagctagaacgaacgactgcttacactagagaaaaatatggagctaagttcaccatcaaaaaaaaccacaacatcgccaataaatataccaggggggaatagagataacctaataatcggaccacattctcacagcttcaagaccgatccattttcaagtaacaatagtagtttgctgtccaaaatatctactaaccccagtttggaaagccctttctcttcgaaatctttactagattgttctcctgtacaagctgtaaagaagtctttagagtcggaagcaaaaacgcatagcctggacgaggagacaaatgaacagactgatgtaaagatcttaaacatagcagactttcccacagatgaactcatactaatgataagtgcgctactcaacagaattataacagcaaacgatgaaactacagatgtctcacaacaagtgtcggatgagaccgaagacgaactcttaactccaatccttgctttctatggaaagaatgttccagagatagctgttgttcagtacttagagagaattcaaaagtactgtcccaccacaaatgatatttttctttctctccttgtatatttcgatagaatctccaaaaattatgggcattcttctgagcgtaatggttgcgcaaagcaattattcgtcatggactccgggaacattcatagattgctcataacaggtgtcacaatttgcacgaagttcttgagtgattttttttacagtaactctcgatacgccaaggttggaggtatttctttgcaagagttaaaccatttagaattacaattcctgatactatgtgatttcaagttattggtttcagtcgaagaaatgcagaaatatgcaaacttgttatataaattctggaacgaccagtagaatgctgtcctgcatattattcatgcccttcccttaccgttactcgtattatacatatcaatttctgatttacgtaacgcgtacatatcggttatatttaaataatttaatattccttttaaatcagtggtttttcatattagtagcatttctcctgaaatgatagctattgcaatagaatgaaaaaaaaaactttttgcccaaataaatcataatctaccggtaaagagaaattcggtccttgttctattcagtattatgctttctcttttttttccaaaatgagaattaaggacgtttcgaaaaagtaaaaatataccaaatgtggaatataaataggtttatcggcggaccgatctggcttaaaacgtagaatctaccagtccaatgtactttgatgaagaacaattgctaaaatatactatatatgcctatagattatccttttttgtaggcatttgctcacttttcatagcaaaaagttgtctaccagaatttcttcaatatggtaaaacctaccggcccaaagagaattcaaagtactcaagcattttagaacgaatcaagaagttcacagttccaaaggcgtatttttcccatttttactatttggctacctttctatccttagtcaccttatatttctatcctaaattccccatcgtttggatcatatttggacactcattgcgccgactttatgaaacgctttatgtactacattatacaagcaattctaggatgaattggtcccattatctagtcggtatatggttctattccgtactcttgttaattcttaatatatcactgtacaagaactccattccaaatacgttaaacatgaatgctttcatcatattctgcatagcatcttgggatcagtacaaaaatcatgttattctggccaatctggttaaatattcgctgccaacaggaaggcttttcaggttggtatgctgtcctcattatctcgatgaaataatcatttattctactctgttgccctatgaacaagaattttacctaacactagtttgggtaatcacaagtttgactatatccgcattggaaacaaaaaattattacaggcacaaatttaaagacaatcacgtagccccctacgccataataccttttataatctagtaatgtgcacactagggcattcatatacatatatatatagacgcggtaaagaaccactttactttcactattatcactttaccactaattagacagcaaaggctcgtatacgtgtcattaaaaacgaaggtaaggccatacctttttgaggcagttggaaagagtaaatactggcacagtggctaagacctatcactgccaaacaaaaggttagacatcttgggaatttcggacacattcgttacttaaaacgaggaccaaaattactcaatacctattttttatttaatattttaggcattgtttcacctgaatttgctgctattagaagcctgatctacgcaataaaagatttcatctggatttttgaagcttatacagtactcaacaatcagcttattaacagcaatataccgttaagcaattgagaaaaagtaacaatcagagcacttgtgtggcataacgttaatctgaaaaagaaaggggtatcagtgtgcacggaaaacttcagagacaaatgcctaaccctccttcatttaagtcacataagcagaatttattcaactccaacaataatcaacacgcaaacagtgtagattcttttgacttacatctcgacgattcatttgacgctgctttagacagtttacaaattaataataacccagaaccacttagtaagcataacactgttggagatagggaaagttttgaaatgagaacagtagatgatttagacaatttttctaaccattcttcggattcgcatcgtaagtcttcaaacacagatacccatcctttgatgtatgataatcgcctctcgcaggatgataatttcaaatttactaatattgcttcgtcaccaccgtcgtcttcaaacaatattttttcaaaagccctctcatatttaaaagtatctaacacaaaaaactggtccaagtttggttcacccatagaactcagtgatcaacacatcgaaagagaaatacatccagacacgactcctgtgtacgataggaatagatacgtttcgaatgaactatctaatgccaaatataatgccgttacttttgtgccaaccctattatatgaacagttcaaattcttttacaatttatactttttagtagttgcattatcgcaggccgttcctgcactaagaatagggtatttatcatcgtatattgtacctttagcatttgtgctgacagtaaccatggcaaaggaagctatagatgatattcagagaaggagacgtgatagagagtcaaacaatgaactgtatcatgtaataacgagaaatcgttccataccaagcaaagacttaaaagttggagatctcataaaagtccataaaggtgatcgtattcccgctgatttggttcttttacaatcaagtgaaccatcaggcgagtcatttatcaaaactgaccaactagatggggagactgactggaaactacgtgttgcctgtcccttgacccaaaatctatctgaaaatgacttaattaacagaattagtataacagcctctgctcctgagaaatctattcataaatttttaggtaaagttacctataaggattccacttcaaaccctttgtctgtagataatactctatgggcgaatactgttctagcttccagtggattttgtattgcttgtgtcgtctacactggcagagatactaggcaagctatgaatacaactacagctaaggttaaaactggcttattagagctagaaattaacagtatttccaagattctttgtgcatgtgtttttgccctgtcaattcttttagttgcatttgccggtttccacaatgacgactggtacattgacattttgaggtatctgatattgttttctaccatcatccctgtctctttaagagttaatttagatttagccaaaagtgtttatgcacatcagatcgaacacgataaaaccattcctgaaacaattgttagaacgagtacaattccagaggatttaggccgtattgaataccttctaagcgacaaaacagggacgcttactcagaatgatatgcaattgaagaaaatacacttgggtactgtatcatacacgtcggaaacattagacattgtatccgactatgtacaatctctggtgagctctaaaaatgactctttgaacaattctaaagttgccttatcaacaacaagaaaggatatgtcttttcgtgtacgtgatatgattttaactctagcaatttgccataacgttactcccacttttgaggatgacgaacttacatatcaagcggcatcacctgatgaaattgctattgttaaatttaccgagtcggttggcttatctcttttcaaaagagatcgccattcaatttctttattacacgaacattctggtaagactttaaattacgaaattttacaagtattcccatttaattctgattctaagcgtatgggtatcattgttcgtgatgagcaattggatgaatattggtttatgcaaaaaggggccgatactgtcatgtcaaaaattgtggaaagcaatgattggctagaggaagaaacaggtaatatggctcgtgaaggtctacgtactttggttatcggtcgtaaaaaattaaacaagaaaatttacgagcaatttcaaaaagaatacaacgatgcctctttgtcaatgctaaatcgtgatcaacagatgagtcaagttatcaccaagtatttagagcatgatcttgaattattgggtctaactggtgtagaagataagttacagaaggatgtgaagtcctctatcgagttattaagaaacgcaggtatcaagatttggatgctgacaggtgataaagttgaaactgctcgttgtgtttccataagtgcaaaattaatatctcgtggccaatatgttcatacgataacaaaagtcacaagaccggaaggtgcattcaatcagctggagtatctaaaaatcaatagaaatgcttgtcttttaatagatggtgaatccctgggaatgtttttgaaacattacgaacaggaattttttgatgtcgtggttcatttacccactgttattgcttgccgttgtacacctcaacagaaggcagacgttgctttggtaattcgtaaaatgacgggcaaaagggtatgctgtattggtgatggaggtaacgatgttagtatgattcaatgtgcagatgttggcgtagggattgtgggtaaagaaggtaaacaagcttctttagctgctgatttttctataacgcaattttgtcacctcaccgaattactattatggcatggtaggaactcttacaaaagatctgctaaattggctcaatttgtcatgcatagaggtttaatcattgcaatttgccaagcggtatattccatctgttcgttgttcgaacctattgctctttatcaaggttggttaatggtcggttatgctacctgctatacaatggctccagtcttttcattaactcttgatcacgatatcgaagagtcattgactaaaatatacccagaattgtacaaagaattgactgaaggtaagagcttatcatataagacgttctttgtttgggttctattatcgctattccaaggttctgtaattcaattattttctcaggcctttacgagtttattagatactgatttcacaaggatggttgctatcagcttcactgctttggttgtaaatgaattaataatggttgccttagaaatctacacatggaataaaacaatgctcgtcactgaaattgctactttactattttacattgtatcggttccatttcttggcgattattttgatttaggttatatgactaccgtaaattactatgctggacttttagttatattactcatctcgatctttcctgtctggacggcaaaggcaatttatagaaggctacatcctccaagttatgcaaaagtgcaagagtttgccactccataattcaattggtttggatttttcttgttgcttcaacggattatcttaaaaaaatctatcatatttcaaaatataaattcttatttttacaaagaagatatagattatgcataatattattttgttacattttttttcttttactttttattttcttttctttgtacttcctcaaataagcatctttagcaggttaacaatagcaaatatcatgtccagcccaaatcacataatactttccacttcactttcactatctgtttcgggagacctatcatccacggtattgacagttggtctttggaaatcagttgcatgtgcccaaggaatggatctcgaaatgttctcaaacacggaggaccttcttctgaaagtcccacggtaagcgggcataggttcggcaaaactgtgaggattattgtcatgtgaaggcgtgataggtatgtcgttaagtgatgaaaaggcttttgaacccaaatcactactatccatagaatcatcaccgacctgcgcaattggataaggcagaggagcgtcaccggtaaccctgaataggtgaacattggcaacatgttcattttcgactctgaagatgatccaaacgaatcttcttaaaacctccaaaagggccaatataaacgacgtcacagcactctgctgaattgtttgaggagcaattgcgtatacaatccactcaaatctaatgaggatatcccaaatcatagcaaagtaataaactaacttcctactgaatgaataactgccgttttcccaattttttttaccagctaaatacaagtcgtctcttagcaaccaattgtaagaagtagtattgtgagcaaaggaccaatccataactaaatcccaggcggaagtaaggatcgaattcaacgtagcgcacacgataaaaggggttctcctttgttcagaacggtctgacaatctgtaagcacaaagtgtggcattatacgctatacccaaagtgtatttcgccgcgttcaaaagatgagggaaccaatcaccggaatcagcaaatcttcgtaaacattgcatgaatctccaataacttggtaaacatgataaaacacccattgctctggaatgtgaagagccacatagattgttgggcgtatgagagtaaacacagaagaacatggcaatatcggcaatagaatacgtcaacgaacaaataatatctcccaaaaagaaatcaccaaactcaacagggaaaaaaccagacatcatcagtctaataagagtaaccaccagccattttctagtgtgtacaactttgtcccaatatggaattagaccagagggacataaaaataagaaagacacaataccaatatataaaaagcctaagggtgtgagcttctccaaagcgaaacttaacatggaacagaccgcacaaggtactatgaagaatgtcaagaaatacaacttgagcggaattttactcgtggcaaaatcattgttgaaaaattgcgtaccattcttggattgaatctcacccagcataataaatctataattaatcccggttctatgccagataaaacaattaacaagaaagagaaacgcgatcaacaaaaccatgtaccaaccaccccacagtgggaacagaatcttgtgcgtaaatgacgtttcttcagagctaatgcccaaatacaaagtgtaagtgatcaaagtcattgacacacctatgcccagcccgacaaccagcatctgcacaatcgatctgttgtttctatgaaccatttgttcggagatagagtactgaatggtcaatttcttcaacttatgggtattgtgcttcctgtccttaggcgaattggtcaacgcagtggtgaaccactcggtgatctgcgtttccaaccaagtgatgggctctttgtctctttgggcggaagagagctccgaagtgggtgttggttgcgaactggttatttgttgcatcttctgtgccaccaactgcacgttggcatccgcgtgcttgaaaagggtgtagtgggtcctggcgtacgacatgaacgtggtcagctctcttgtgtgacacgttttgtcgaatttcttgaccattttacggaacccggtgacgttgatatcccggaacgatttgaccaattgcaagtacagatagtactcgattatagcgttgcttaacaagtttctagcctgggttgtcgtcatagtctccagaaaagaagcgccaaaagcaaacgtctcgcggcctcttgaggacgcatcctgtctcaagtcctgtagcagagaaaatccacgtttgggccacgatggcagcagcctattgtccttaagaactttctgacagtacgctagcagcgacaaacgcggcttcttggcctctttggtgcagggcattgacccatacataacagaccggctatcgctgtcgatgctattgaccctggagtcagaacgaccagcaagccctgccgcatatagactcgtggacatgtcaacattcgaactagaccggttcaagttgtcgcgctcataattcttctgcagcgagtaatagtgcagttgcgactgtaaaacctcaaacttcttgtcgcactcctttagcaaccaaaggtaaaactcgttacacttactcaactggaacgagatcaaccagtcttcaatgaagtcagcaacgaactccctctgcaaagcagaatagtccttcttgaacgcaggtccggagcgatagtctccgtcgctgcgacttttgccgggctctctctgctgaaatgcagtctggtataccgacacagagggcatccagctccggtaggagctggattgctcttcttcggcatccagcttctccttgtagcggcgaagcttcttcttgccgaccttataatcaatatatttgtccctccattccgggatggcagactcggttagatggtcagcaaacttcatctgatacggtgctatggtaaagcccttccattgctgccaactgaattaaaaaaaaaaaaaaaataactaccaaccatcaaatcaaacaaaacaaaacaaaaaagcaaaggagaaaacccatcttgtacatgtacagtcccaaactgttgcgaaaccgtgcgatgatgttcatggaacttgcgtcaaataaaaccgcatcccgtcccacgtgacaaacggcacccaaaatccgttctagaaatgcctcacacccacaccgatgatgggcttccgactcgatgactaccaacacatagccagccgcagcggctggcagcatgtgcatgataatgataagtgatgatgaatgatggtgataacgattttgaacaaatggctgcagcgatagcaactaaggggatggaaagacagatctgggagagataactgcagggtgtggcacggcaacacaaggctattgtattgcactaaacgggcaagaagccatgatgtgcgtctgtatcccaaaaaaaaaactaatggattggcgcgtgtactatatatattcatatgtcgtgtgtttgtatatgtgtgggagtgattgtgcgtgtatatgtgtgttggcgtgtgtggtacaatgtgtgtgttttaatgtagaaatgaggttgtagcacgtgatcgggaagccacagtttgcgcggagatattttattttttttcatcagcgtaagaagaaagcaaccttgcagtctgtatcgtaagagaagactgcagttaaagaagtttagagaagaggcttgagtatcggtaaaggggtgtgtgtttggtgatttataaaggagaagggcatgaggagagagaggcaaaggatgatgagtttcgaggacaaggacaaggacgaccttgacaatagtaatagtaataacagcagtgaaatgacagatacggcgatgatgccaccattaaagagattgcttattacgggcagtagcgatgatttggcacaaggatcatcgggtaagaagaagatgacgatggcgacgaggtcgccatcgtcatcacccgatttggcgacaaacgacagcggcactagggtacagccattgccagaatataacttcaccaagttctgctatcggcataacccggacattcagttctcaccaactcatacagcgtgctacaagcaggatttgaaacgaacgcaagagattaatgctaatatcgcgaagctacccctgcaggagcaatccgacatccaccacattatctcgaagtacagcaattccaatgacaagatacggaagctgattctggatgggatcctatcgacgagttgcttcccacagctttcctacatttcgtcactcgttacacacatgatcaagatcgacttcatcagcattctgccgcaggagctgtcgctgaagatcttgagttatctggattgccaatctctttgcaacgccacgagagtgtgccgcaagtggcagaagctcgcggatgacgacagggtatggtaccacatgtgcgagcagcacatagacaggaaatgtcccaactgtggctgggggctgcctcttttgcacatgaaacgtgcgcggatacaacagaatagtacaggatctagcagcaacgcagatatccagacgcaaactacgcgaccttggaaagtcatctacagagaacggttcaaagtggagtcaaactggagaaagggccactgcaggattcaggaattcaagggccacatggatggtgtgttaacgctccagtttaactacaggcttttgttcacaggctcgtacgactccaccataggtatatgggacttattcacggggaagctaatacgaaggctcagcggccattcggacggcgtcaagacattatattttgacgatagaaagctgattacgggctcgctcgacaagacgatccgtgtttggaactacataaccggtgaatgcatttccacgtatcgaggccactcggatagcgttctgagcgtagattcataccagaaggttatcgtttccggcagtgctgacaagacggtcaaggtatggcacgtggagtccaggacatgctacaccttgagaggccacacggaatgggttaattgcgtcaaattgcatccgaaaagcttttcatgttttagttgcagtgacgataccacaatccgaatgtgggatatcaggaccaattcatgcctaaaagtgttcaggggtcatgtagggcaggtgcaaaagatcataccgcttaccattaaggatgtagagaatctagccaccgacaacacttctgatggcagctctccgcaggatgacccaacaatgactgatggtgcagacgaatcagacacaccgtcgaacgagcaagaaactgtcttagatgaaaacataccttatccaacacatctactatcttgcggactggataacacaatcaaactatgggacgtcaaaaccggtaaatgcataagaacacagtttgggcacgtggaaggtgtttgggacatcgccgctgacaacttcagaattataagtggttctcacgacggaagcattaaggtctgggacttgcaaagcgggaagtgtatgcacacgttcaacggtcgaagactacaaagagaaactcagcacacacaaacacaatccttgggtgataaagtcgcccctatcgcttgtgtttgtattggagattcagaatgctttagtggtgatgaatttgggtgcgtaaaaatgtacaaattcgatctcaatgattaggacctgtgtgtggtcttttcttggtcaaaaacatccgtagtacctcgaatatatatgcttacatatataatgaaaaatacataatagcattttacatttattttatttccaggaaaaaaataaatcgctagcgtatcactagccttttccatcttcagtttttttccttcctctttttcgtctcgataaaactcttgaccattagatgctattactcccccacggagcccttcccacgctaagggggatgtcaagggggggactgaagataaagcttattatattgacggcgatgatgaagagggcgtacgcataaaatgtcgtacaagatccataatctgcaatattgttccctcaacagtactaataaatccaaagggcgaaggtactttattatataaacgcgcacggccattgtatataaaggcgattacataatagaatacttatcgattccgtaatccttgaaatatagaatatacataaaatagacaagaacccaacagttgaggcgccagctttggtaatagcttaataataaataaaaaaagataatatagctagctagtattattgcttttatccgtatggccaccaccacgcaaccacaaaatatactgatggatgaacctttaaatcttcctaataacagtgcccacaacaataactatggaaacataaatgcgaatataagaacttttgctggtatgagcatgcacatgcaccctgccaggctgaactctctggagtttttgcacaagcccaggagactatctaatgtaaaactgcacagattacctcaggacgagcttcaaagaaatacggacatgaataagggaatgtattttaatgggaaacaagttcatgcccatcacccgtttataaattctggagcgaactttaacgcacatcatcaagacgtcagtaaattaggcgaggaggaagacgaaatctctcctctatcacatgataatttccagtatgaatccgaggaaaatggtaatccttcacctcccatttacaagaaatctggagaactggttaagagttcattaaaaagaagatccaagtccctacccattactcccaaatctatattcaacaaaactggctctaagagtaaacatgtcaatttagatcatgtagatactaggctattgcaaagaagtaaaagtgtccatttcgatcgtgttttaccaataaagctgttcaatgaaaatgagaaacccatagatgttggcaaacaaatggttcaacaagatgttctgaatttcaagcataagcctttgacgagactaagtgcccttaatggcggtagtgatagcgtacctatagaagatttactatctgaaaacaaccaaaacgaatatggagatacatggctacaaaacccgaagggtgtattcctatttggtacaaattctaataatcgtagaaataaaaaaaagaagtttaaactaagtgacgatgacagtgatattgaaaatgacaatgatagtgacgacgctataaaccgtttagtaaggcaacaagacaaagaccaagctcatcttgcgcacgggttgaagaatttgttaataaacgatgacgacgattatttagaaacaagaacaaattctgctaaatcaggagccaacttgtttattggaaactctaaaagaattgttggtctttacaacaagaactttccaatattaagtgacaggaaccgtaagagtttaaaacttaacatatttctgaatctttcccgtggaaggcccgtttttttgcaagaaattacgctactaactggcttccacaacatggttataattggcaaagtctttgtgaaaaacatatactttgataagaagattatcgtaagatatacatgggatgcatggagaacttttcatgaatcagaatgcgtgtatttttctaatgccaatggcatcttaccaggaagcaatatggatatttttaagttctccattgatgatatacacaatccaaatgataaagatagcaatatatcacaattggagttttgtattcaatacttaacttggggcgttgatcgttctaggaaggaatattgggacaataatgattcggcaaactataaaattgacgtggtaacgaatgaaacgaggacagggcccacaacagacgtcaatgataactacgagatgaaacatagtcttttcagaaacccattccattaaagaaaaaaacaaaaactaatagtattgttttacatatacaaaagaaaaaaaaaagataagaatacgtactttctatttttatttgaaggtcattttctttatataaaataatatactggaatgatgttctttttgttgctttctatatttgctttctttttttactttttattcaactccagacgttcttaaataactcgttatcatccaatgaaatgttagaactggaatttgaattcatactattattatttgtagcggtaattccagtgttcacgaatggtgacggagtattacaaggctgaggtgtcgtggaagtgaaaaatgagttctggctttgagtctgggcagaaggttttgagtataaagataaaatggattttttcaaatcgttcctttgcccaaattcaccgactctgttgccagtcttggtattagcagcacctatgcttgttgcagaactagttacacttgtattagatgtagtcttagaaagcgatgaaacctgtaggtttaataagctcgtattactccttgaggtgcttaataagtgggaaggtggttgtgtttgcgtcttttgtaatgaatttgagctctggtccaatcttgcattcgaagcaggcaacgaatgattcgcagacggcttatgcagaactggttcagtagaatcatttaacccttcaatactggagaggtcaccaatccacttcttatattcatatttattcttgatgaaattttgtaaactgctcgtatcagtgattttcctctgtttcaattcatcagccaaagtagcttcgtagtatgagttagctcttaaattgtttttgaactgtatcagtttcaccaaatgttcttccttccatgtatccagatcaacagatttcactttcgaaatgtgcgttcccaatgatctatgtataccagcacatttaatgcaaatgaaaacaccaagtgaccaggaagcccagcgtggatgtagttgcgccttacagtcggcacaatgactgtttcctggatcgcgtaaaagagcacttaatgccttcttgactgggactgacgtcgacatcgcttgtaaattgccccacgttctatgctcctttgtacagttgaagcaagtattacctttacttttgttactattagtaccgatcttatacgtattatcgagtcgaaaatcgtccagcacgaaatatggaaacggtgcgtttaggtgactaaactaaatagcgtatatattatatatgttccaatctatatatatatatatggcactctgttacagttccttatcttaaaacacaaacacctggtcttccatcttggaaagcggtttggaacgtctgaaccccaagtccacggtacttcttctaactgaggcaaccatggctggaggaccacagatcaaaatttgaacgttgtccattgtagcagcgggcaagtgttccttgatgacatccttggtaatgtatcctacaccaccagtccagtcttcacggtcaggagagtctaagtagtaaactatcttaaattgggaaggcttcatggccaccaacgcttccagttccttcttcaacagaatatcctcctcatggacgttcccaaagactagagagaccttggtagtgtcgtgagggtccatggcaatagctttcatgatctgatacatgggcgcaataccagtaccaccagcaatcatccctagatgggaacggcagtttctctcataatgatagttcccacgagggcccttgatctggatcgagtcacctatcttcaactctccaatcatcttagaaacgttacctgtggggtaagacttcactagtaattcaaagtttccctttgtatctccatccaacgatgtgggcgtatacgatctggtaatatccttaccattgatattggccttaattacgatatgctgaccaattggtaaaccgagtacgtcgtcagcatgaggtagcccgaacttgtacatcgaagtattatgcgttaagatggttttttcaaccagcggaaatgattggaagtcattccttttgggatccagcacaggcttggtcttcggtccgataatgaacttgaagagcaaaggcacgaccacgatcacgatgaccaccacaagcttttgagcatcaatagccatcttcgattgcttaattgattgagtctcttgttgaagagccagttgaatgcatactttcaacacttttttttctcgttcattttttcgccttatataataagaatatttatacatatgtagataatttaaagaagtagaaagagcccttaatggtaccgctttacgaggaaatttagcactgttactttttggagagtagtgcagtcttagaagggcctttgagcttgatgtacacgtccgtgccccagccaagtaaactttgaacgtcaatcttgcccccaaacagttctaggtacgtcttgcacattggtagaccaaagcccatgccggagacgttgttgatttgctcgccgggcagatctgtagactcagagtcagctgattgttgggtatgtgtagagtaagagtagttgaacatgagggcctctacctcgggcgtgatcccaccaccatggtcccgtatccgtaagtacagctcgtcatcgtctggctttaaaagattgatctctatgggcatatgttcctttccaagagctatctgagcttcaaaagcgttcttgaatacctctgtcataatatactccagaatgggcggaatgcacgtgaatgtgatgtcttgtgatggcgggtgaattaggaccggggtccgctgagtgttgaacttcacaaagcatatatcattgacataatcagaaacgtgcttgatcaattgtgctatggggaggtcccggtgcaagattccaatcatccttttgttcgtgtcacctttgttctgtgccatcaacgacaaatagtgcgtcacaagcagcttcatcgtgattctctccttcaggtggaagttcaagaactgcgaaatttgaaactttgggtaacacgattggatttcctgaagaccttttgccaataccacaatggcgtcctcgtggtcgtccagcagttctgtgaacttggcctgtatcttgggaggattgtgcaactcgtacgggtatgcgattgatagcaacgtttgcaagcttttcaaatacaaagagttggttctctcaatatgagggttgattaccgcattatacggtagcctctgaatggcattaagccgtttacacgtcaatgaaagcaacaggttgattgtcttgatcgtcagcatgtactcctccttcttggtcagcggcggcctgtattgcaggaaatactcgtagtttaggggcgcaattggtttactagcgtagtcctgtatcagcagctcaatgttcgacctaatcttgtaatgctggtcgaacgacagttgcgacagcagctcgtgtgagggtcgctggcgatgtgcccagcgcattcccccacatttccatgaacgcataatcttccacatactaccgtgaaggcgtcttgataccacgtcttccagttatggtcttgactcaccaatgttctcagtttaatgttgtttgcttcatactggcagacattttcccttattaccgtgagaagcgagcggtggattaatcgggatgtcaaaaacaagaaaattgcaaccttcttcacctataacctatatgatttgtaggcagaggagtggaataagcaacaaatcatagtcatcaatgtcgtttaatgccttcgccagctctttgagcaagaaattacaggaaatatccacaagtgtttccgaaaaaacccaggaattgcccagtttggcgcaatccacccaaagaatggtccaggaacgtttgggccaggtgacggacatctcccaattgccaagagagtacacagagctggaagataaggttgacaccatcaaactgatttacaaccacttcttgggtgtaactgctatctacgaaaacggatcgtacgattaccctaaatacatcaacgaatccgtcaacgagttttcaagaagcgtggcttccaagttgacagagttgactcatgctacatctgcgtctgaggcacaaaacatcttagttgctccaggccccatcaaagaacccaagacgttgaactacgccctcagtaaagtggctttgaactccagtgaatgtttgaacaagatgttccccaccgaggaacaacccttggcttcggcactcttgcaattcagtgatgtgcaggctaagattgctcaagctagaattcaacaagataccttgattcaaaccaaattcaataaaaatttgagggaaaggctctcttttgagatcggtaaggccgataagtgccgcaaggatgtccattccatgagattaagatatgacgtggcaagaactaacttggcaaacaacaagaagccagaaaaggaagcttccttgagagtccaaatggagactttggaagaccagtttgctcaagtcactgaagacgctactgtgtgcttgcaggaggttatttctcacgctaacttcagtgaagatttgaaggaattggccaaggctcaagctgagtattttgaaacctcggctggcctaatgaaagagttcctatccaactcatttgcggaagagccggaagcaaagcctgaggttgcagaagaagaaaagccacagacagctatctctatgaatgacgaagacgacgcttaatagccgccctgttcttgtctttctctctccttctctatatatatatatttacttaatacaatatcatattctctagtgtcgtacgaatattatcatttatttgctggcttttgtagtgagtatattttttgtagagaaaatataattactggaagagaaaaagctactgaaaaaaatttcgtaacagtcaccaaagggcaaagtgagcaacccaaaaatggacgctactcaaccgcaatacgaactatccgtagtaacacaatgcctaaagtctgccattgacgtcatccaatggttgattcctactattactaagttcagccaatcacacccgttagttttccaactattgtttattttcttcacattttatgtcttttacaagttgttgatgaacttcattactctggtcaaaagattcctgtatttgacgttggtagtaacatgtatcggtatttatatgcgtggttcgcagcagtttttgactgtggacctgttgaatttctacaatttcgtcatgtcaaatagatactacgcatttaaaatttatactctgtttattaatgccctggaaagagaaatcaacactgtttatcatttggcgcagatgaaaatggaacagttgcttaaatagagcgaaacgcctctgcttactcggaacatcttaaagtaattacatatcttaatttctaaatattcatatagataaagaacgttttttttgctagattcctcccctagtcactatcaaatattgagctatttttggtgacttgtgttttccaaattattcattacaattgtgacttgatttctgaagttttaagaaaaattgcaaactaagttattacaagcgatttatccggtcgcgattgaagaactgaaaacaacagcagcagcattgtaccaagaatcccaagatgctcaggtgtgcggtcaagaagtttgcatattttgccaccttcctcactatcgtcgctaatatttacatctatacttatccatctttccatccagaacagtgttcatggaactgctctaacaagaacgcaccactacagaaagatttgacttttgtggacaaagtgaagaattacttcagtgatgttcgagagcaatggcatggtagccatgcctctgcaggtaacgatgaggatattcatattttggccttcggtgatcctcagattaaaggcatctggccaaagacgccatatgtgtcccgattagatacatacggtaatgactactatcttggtcacatctatgatatgatgcagcagagactgaagcctcaggtggtgactgttatgggtgatcttttctccagtcaatggatcggtgattccgaattccataatagaacgaaaaggtatattagcagaattttcaaaagagacccaacttctattgaaaatatcaaacaacagaacctcgatgagaaaggtcaatataaggcgaattggcctgaatggggagaccgttttaatgagattttagacaatgtcaaggaaaacgaggctgataatcaagaactttcttttgggtttggttatgaaaatatccactcatggaatccagacttggaagactttttaatcatcaacatcacaggtaatcatgatgtaggttactcaggcgacgcgacttatcaacatatgacaaggttccacgaccttttcggtaaggacaactattggattgaatacgaaaccaacactacccatccttggagaattgtagtgttgaatgatcttttactagaaggtcccgctttacaaccagaatttgttgaagctacttggatctttttaaaccaactaaatgaacgtaaattcaatggtagtactgttttgttgacgcatgttccattttacaagcgtgaagggttatgcgttgatggcccagacactaggtattatccagatgcccatgccccagaatcatataaatctgggcttttgagatcccaaaatcatttgagtgaatccgtttcaaatcaagttttgaatatgatatttgaaaatgggaagccaggtatcatattaactggtcatgaccatgagggctgtgaaacagtttataataaaaaatctacatctacttgggaagcgactaaaaatatcgaaagtgacgttttcgttaaagaaatcacagttaagtctatgatgggtgaatttaatgggaatactggtttggttacaggacacttcaacacagattcaatgacttgggagtggactttcagtttatgcccattcgctattcaacatgtttggtggttcgctaaagtgtccctgctcgtcaccatattcacttggtcctcgctactatttgtctaaacaaaaaagagtaaagaagataaaactcctgtatagagatttatattaaatgtatgtatatatatgcatatactgctcttcaaattgcttatgttttataaacattgacatcggggttccacacatcaagataatcattataataccttagattgtaaaatgtttacttactactttaaaataactataaataaaattaaaaatcaaattaaaaatcaaattatactgccattagcactgatttttgttgtttttgttttaaagggatgcacattttttttttttatgttattatcatacactaatttttccctgtttcaattgtttcaagagctgcttgccgtgagaaatttcttgtttttgttgttctaaagttacattactctgatcattaacattgttattgtcaacactcacatcacggacctcagacgctgtatctaccggtggctgcaaaaatgaataatccagtctgaagttaattttatcaattactgtccaatcgtccagtttaaaaattttgtaatcaccaacttcgcaaatttcattaaaaaacttgacctcaccttgtcttaaaaaccacattgtaccatcctttgaaactttccaatccctctcatttagaatcttgtatgcaatctccctttctaaaggagtaatagcaaaataatagttataaaataacgaaaacatttctaaagttctgaaattttctagaattttggcataaattgacgatgaatcttctttcagcctttcggagcctataataatatcacgcaacgaacaacgcataacgtcccactgttgagtagatctgaatgcatccaagggagatggtggattaactccttgcggtacttcgaccagcctggaaatttcacacatatcacgagaccttttgtacgttattttcgattcaatttgactattatagagttcagaactcattatgaattcttgcacaccacttggtagaagtaaagtttcaaaatcacttacaaattcttttttgatttcatttgtcttagcttctctttgttccaagcttaaatatttcggtgtgcttggttgttcttcttcctctggctccgtctctgaatccctatccgattcaaaatcgtcatcgaatactccaaaagttggcacttgcaatttatttctttcttctggtgactcttcctccttctgctccataaccttcttagttgtgttctcaggcccattttggtttaccgtagttgcaacttcatgttcagactttggatttgtcgccaaggaaactaaaggatgatgtgaggagctcatatttctatagaaggcctgattgttttgatgcacagcagccgccccagcagccaaaacagcagcggccgttgctgctgaagatgatgcgccggtattgtcaggttgtaaagacaaagatgaagtagataacttaggtgtattcaacgcactaccaatcctgctgttagcgttggatgatgttgtagtagcagcagcagttgttggagtctttgttgaggtattggatatggtggacgatgcagaagtgacttttctatccttttctaccgcttgtgatgcagcaacggcccattttaattcaccagcaggttttgctggaagagtagcaggtttcaatgtagtggcaccagtaataccgtttggagtttgatgaatatgtgtatgtacatttgttggagtttctggtgtagctgaacttggtgatttttgcaatgacggaagcaaattatcagcactgctcctgggactctttatagaagttttaacagcctcttcaggctttgttgcattatggataggggaagatgaaggacttctttccgtttcttttgaagcatcagcaacgggaatgacaggtgacggcgtagaagagggaccagcaacgggtatagctgcacctgttgcattttttgccgcaagtttagcagcctttttggcttctctttccaattttctttgctcctttttagaaagttttgatatgtcctgcagagattcattagcatccgatgtattgttatcttcagcattttgtgaagcaaaatactgggccacctcatgagcaatggcttcgttactctgtaaattcaaaccgtcataaatagtttcatcctctacgaaatctggatcctgatttgactccacgaagtaatttatatcgtcctgcacgtttttaacatcttgggggtccaattcctcattggctaacaatctcaaggctaactccatctgctgttgatgccacctatacctcgcttgaaaacgcttatattgttcctttttttcatcatttgtcgtagatgacgttttcttctttttattaagaagtaaaagcttgtcaatttccacttgtagggaatcgtattgcctttccagctcatcgatcatttgggaaaggtactcagatatatctctcctttccctttcttgcgggtctaaagtctctgattttttcaggctaatattagagtatgctttttctttggacgccttctctacagccttatacttttccatcgctatttctacagaccttctgtaatctagaagagaatctttatctttaatatcgggtgagctttgccatgattttatctgttcccttagcctttgcagctttttgacttctctttttaaatccgactctagcttgtccttttgggaaggattgtttgtgcatgattcatgtctttcgtaatagctattgaagatttctaaaccttcgttaatttttttaaagaccctatcgacctcctgctgtaattttctatgagccatgtcgatcgactaaacatacaatgaatcttcaaaaatctaaatttgaaaatgaataaataaatgtgctgtagataatagcttttgattttttgtcttgacacaatgagacttctcgttaaagtcaaaccaaaaggagatgaacaaaagaaagttcgaaatatcaacaaaatgctttaaaaaatgtagaagcaaagttattaataactttacaagcgccttagtcagtttattgatctgtaggtcagtaggttttagagattacgcacagatgaaagtgaattaagctactattacataaaatcaaggtatctttcacaagtttttcactcagcgaaaattgcgagaccgctcgtggaaggtgacgataatacgatacttacaactttaatattataaatataagcatgtggtggaacaatatagtcaggcaaactgctaaaagtccccacttataaacagtgtgtaaaaagtacgtttgtttttgctccttatcctttatttggcgttttgacagtgaagacaatgccgctaccgatgcgttggttatattaattcctcgattaattataccatatttttgaatgtccagtgcaaatgaagaatttgtattcgtaacttcgtatgtcggtaggaaatactgacccaggaactcattaattgaatcgctgcctaacagaggctcaacctgcaggtctatcccctgccaattttgagaactctcattaagatatttttcaaactgagtgtttgtgtcgttaacccaaagatttaggatgtccgttgattgcactttcaaattggggtcagtttgaaggcttaaatttgctgtaatgaacttttcattcacttccatttggaaattttcacacaataatgatacgctgtcattaatgaaaccctctatcgtagttgttatatttccatctgtccaaacttcccttttgtatagcgaaggtcccgctcttttgtggaatgtaggcaaactgggtacttcaaagtttgttaatcgcgtcactatctgccaatgaattaataacatcaaaaaaccaaacagccacaggtgagccccatttgagattatccaccagttacagtaaaatagttttgattttttgacttttttgtcatcgattttttctggttctcttttaaatattttttgattgataagctttgttaattggtagggaattggataaagtgtactgagattcagagtagtaattaagcttttcaaaactttgttgtatttagtaaaattggtttgtcctgtcaggccattaatttgggacataaccaggtttacttgctgattttccagctgaaacagaattctttcgattgccatgagcaaaatcacaaatgcaaagtacatgactgtgaaaattattgtcattctcttacatttacggaaaacgtgattttttactgcacttagtacactgttttcctcgctatttgttttcagagaccgtttaattattgaagtagacgatgtaacctcggtactccccccagataaaatggaaatttcattctgtaagtttgcagtaaagttccttttcaactgaagccagtcagtggaatttcgtagaaaattcaaacttaaggtactagaggtatctaattgagtagaaaagtcagtgatagtgccattgaagttctgcaatgatttcaatttccttgagtagttcccaaaaatactgtcaaacatggagtaatttaacagtaggtttgatgccatttgtgaaatggaatccttatcaatggtcattgcgtcttctgatatttcattccatgtgtcatttatcagctgtgatttagtgagtagttcgttaaaaattgtattgtttacctcaagaacttccttaatcaattcagtttccaaacttatttggtcgttgataagtttttgtttattatccagtatgtcgtctgtgtatgacttgaatttttcttgcatatccgtacctaccgtagattcaatactccgtagtttgctttcgaaatactgatcaattgtattatcaatgaatgttttatttaaagagtaactgttggcagaatatatggcatgctgtgttgtgactgctgtcattgtggccgttgttgtggccgttgttgtggctgtcgctgtagcagttgaaatagatgcaaaggttgagacggtatcatttcgtttgacctgtgcgtgagacatttttgccattgtaatgtcaatgactgaaaaggaaccccaaatagttaaaataacagaagtaaagaatatcagtaatagaggatggaaaatacaactaaaaaacctctgtggaagtgataaaggtttaattatgtgtacattgttcatctttgccgtactcttagttttatcgaaaagtggtgtagattttcagctacttaagccatgttagtgttctagttttttgctttacatgttatataaagggccaagatagcatatgtaaatgttttattactgggctgaaacatttttaaaacatttttcaataatgtgctgttataaccgtacaaggacggttataattctgaattaaaatgctgcaccgaatgaaaataccaatgttcttccaaacctattggcgaaaattaagataagctgtcgcctctataatcaagaataatctcaactattataaatattattcccagaagttgaaattgtgacacatttgagtaatatcaccttacacggaacatagttgcccccttctccgaaattgctgacaatgataatcggggattcaatgacaatgacaatgaaggcaaaagattttcatattgtactcttgttttttgagttatcactttcaagtaccttcttgttaacagaaatagaaccgctatagaggttatcgtgtatacgtatctgttggtgtttctaaatcaaaaactcgcttttaaagcagtctttcaattggaagattcaaaaggatctaaaaagatctaaagtagtaaagaaaaaagtataagcccacacctttttggtaggataatgtttactggtcaggagtatcattccgtagactctaattccaacaagcaaaaagacaacaataaacgtggtattgatgacacatcaaagatcttgaataataagataccgcactctgttagtgatacttctgccgccgccaccaccacttctactatgaacaattctgctttaagtagatccttagatcctactgacataaactatagcacaaatatggctggtgtggttgaccaaatacatgattatactacttccaatagaaattctttaaccccacaatattctattgcagctggaaacgtcaattcgcatgatcgggttgttaaacccagcgccaattcaaactatcagcaggctgcataccttcgacaacagcaacagcaggatcagcgacaacagtcaccctctatgaaaactgaagaggaatcccaactctacggtgatattctgatgaattctggtgtcgtacaggatatgcatcagaatctggccactcatacaaatctgagccaactgtcgtctacccgtaagtccgctccgaatgattctactacagccccgactaatgcgtccaacatcgccaatacggcttctgtgaacaagcagatgtatttcatgaacatgaatatgaataacaacccacatgccttgaacgatccatccatcctggaaacattgtcgccattttttcaaccttttggtgttgatgtagcacatttacctatgacgaatccaccaattttccaaagttctttgcctggatgcgatgagccaattagaagaagaagaatatcaatctctaacggtcaaataagccagctaggcgaagatattgaaactttggaaaacctgcacaacacacagccgcccccgatgcccaattttcacaattataatggtctgagccaaactaggaatgtatcaaacaagccggtcttcaaccaagcagtgccggttagtagtattccacaatacaatgcaaaaaaagttattaatcccacgaaggactccgcattgggtgatcagagcgttatttactcgaaaagtcagcagcgaaattttgtaaacgcgccatcaaagaatactccagcggagagtataagtgatttggaaggcatgacgacgtttgcgccaactactggaggtgaaaataggggcaaatctgcacttagggaatctcactctaatcctagcttcactccaaaatctcaaggatctcatttaaatttagcggcgaacacacagggaaatccaatccctggtactacggcatggaagagagcaagattgttagaaagaaatcgaattgcagcttcgaaatgtagacaaaggaaaaaggttgcgcagctgcagctccaaaaggaatttaacgaaattaaagacgagaatagaattttactgaaaaagttaaattactatgaaaaactaatctctaaattcaagaaattctccaaaattcatttacgtgaacatgaaaaactaaataaagactcagataataatgttaatggcactaatagtagcaacaaaaatgaaagcatgactgtggattcattaaagatcattgaagaacttttaatgatcgattcagacgttacagaagtggataaagatactggtaagatcatagccatcaagcacgagccatactctcaacgtttcggaagcgatactgacgatgacgatatagatctcaagcccgtagaaggtggtaaggatccagacaaccaatcattacccaattctgaaaagataaaataacaaagttttggtgagcacaacggtgtttcattcaagaatgataaggacaactatatatgtaatatacgtgtataaatactcgagctgcatcctttcttttctgccgttattatttcgtttagttactacatttatggtataaattacctttaagacattattattttgcatgtatgaaatttgctcgtgtcaaccccttagtcctccttgcctctgttgtatggaggaagccctttaaacctgtatttagttttttaaatctattagaattaagtacaattgtacagatggtaaaaaaaagtaatcgttatatcgtttgtcagtgatttttttttttttatttcattcattatttatttcttatttttcaatttgttcccttattggggcaaaccacgggtgtcccatcgcttccttagcagttaatctttcttgatgatcatatctcaaaagattgtcaataaggtcaataatttcatcgttgccgcttaaatgtttattaccatcattgatgaatctatgccaaggctttctgatgtattggtccatatcgtaaaattctctcggtaaggtaatttcatacttcaacaggtatttctcaaaatcgcttgtaccaagtactttgacgatcttgacaagctggtctgtgttactcgttccatggaaaaatggctctcttttaaagatcatagaagccaacattgtcccaaacgaccacaagtctaaagaataatcatacattctgtagtcaactagtagttcaggacccttaaaaaacctcgacgcaacacgaacattgtattccatattaacatgataaaattcagcaagcccccaatctatcaatcgcaattttttattcttatgatcaatcattacgttatgaggtttaacatctctatgcattattcccattgaatgacaatagtctaaggcctttaataactcaaacatataaaacctaatttcgagatcggttaatttagggtaaagaatacggaagtccacattatctacgtattcgaagaccaaagccggagtttttgagatgggatcctttattatatcaaatagatgaattatgtttgcatgaccattgtgtggctgatcaaagatatagggcctgatgaattttaaaacgtcctccttttgatttgtgtaatattgatctttttgaaatggcaaagtcgttggaggcactttttcgttagacaaatccgttaagattttgatttctctcttgatcttcttctttttaactggtttcaacatcttaataacaattttaactttagagtctaatttgacaccttggaaaacctcggagtattttcctcgcccaactttattttcaatttcatagtcctttgtatttgtggaccaatcaattacagtattttcataatcccaatattcctcggttctttgtttattgatattcgtataaacacgagcctctgaccataccctgcatttcatagttcgaatcaaatattccttctacaaccccctatttttgtctgtatatttgacttcttaagtccctattcagaaaactcctagtaggtaattgcaatacaccgagtatcaacagtatatgaagtcccttaatccgttttactacaggactgcgaggttcgtctaattgctactgaaattttccaagcgttggtcatatttttgatttttcgctttttcttcagtgttcgttccgagtgatttttgatagcgcttttctaccacttagtgctgctgtatgtatttatatgatataccagcgatacatgtaaatatttctataaagactgtaaacctctgattacctctgcctgtgcgtctttattcgcttcctcagcagaggaagcaatggctgcgttctttgtttggtggaagatatctcttgtcttttcgaaataaacagtttccaatagatttctcatctgagactcaatgtcctcaattaaggaacccaaattagcgacatgtgatgtgaaaataacatctaatggacgggacatatcaatagcgatgtccttttcggtctgtcttgtcaggttcccggataacatcatatgagaattctggtcagtttttgttttgtccaagtgcagaatgattgtagtggtgactctatagttgaaactgtcgggagaagaaggagatgttgtaacttcaaaaacatggatactgtcccaattactgtgatctgattggttttttttgaaaagcactacccctgcaaaatcgtgcccattgaaatcttcttcattgaggtcccagaggtacacgctggagataccgccttcataatagagatctctgtaaacgtcgaaagagtcattggctaagatctccaattttcttaaaggggctgagggaaaggggctgtcttgtagatcctttggggatagttctgggtaataagtgttcgaccaaggcgatctgaacgaatcaatatcacgattatagtcgcagcataagtactcccggtttgaatcggcggaatctttctgtgtggataggggaacgtctactgaagatagtaaatcttgtgccaaatttggttgtaattcgatcaagttgtttagattctcctgtaacgtggtaggatttagcctcctaagaagatctaaagcagcatcgaattgagcatcagacattacggtggtgattgtagagttggagagagtttttgtatgtcacttgattgaacagttctcctttatttgttacaaatgctctcatttttacgttttccgtggtgaaaaaaaaaaaaaaaaatgaacatatatacatgtagtaacagcagtagtagatgaagaatttagagtttaaacaggtaacataacgctataagggaaaggaaagtggagatgttatacattatatttacgtagacgttgaaggaagaagaaagaaaaagggaacagaagaagaagaaaaagagaaaggaaattcatgtggatttaagatcgcttcccctttttacttaatgtcttgtaggatcattgagctttaatacgtctactgcaggacccagtaaacgttgaaaaccacttttccccaatgtggcaactttggttctctttgtagcagtcacagtggcctgtctgggcaaatcgtttagcaaggccacttcaccgaaataatcatggtctttcagtttatttatgacaccttggcccttcttagagacgtccacagctccgtactcaattaaataaaagttctccccttgatcaccctcgcgaatgattgtttcacccggctggtagatcttggtatccagtgcatcggcaagtttggcacggtcgtacgtagtcaaactcttcaaaactggcatgctcttcaaaagatcgtcatacatgagtctcttcttgaaagagctgcccaaaagtatttttctgaaggtgagcctgtctagagcccacaacaaacagtcggaggttgctacaacggtggcagcacgagggctgttgtacataagagcaagttccccgaaactggagcctggcccggaagagttgaccttgttgtcgttgacgtagaagtcaacagtacccttttcgacgacatagaagtagtccccttggtcaccttgcttgattatcgtagcacctttggggacggacttctcctccagacaatttatgaccagcctttttgagtcggaatccagcttgttgaacagaaagttattacggatcgatttttccagtctttgcaattgctgctcggacttttccttatagtgatctggagtccaatcgtcaaaattgtttggttgtaaggtctcaccactaacagaagtacgcctttgggcgttgaagtgcattgggagtggaggagttgatgtcttttctctagtatgctgttgttcttcctgtgcttgctggtgagtgtcctgttcgtgcgggtctaaattaaacccacttttaaacacgttggagtgtgggtcctcgttcacaaagggggatttgaacataacactcgatctggatcttgattgagattgagctgattgaggtctggaaaatgactcctctggttccggaaatagaacaatgttctttgccttaaattcaggctccctggccttgaggaacgctctctgttgttccagccttttattgaaatagttggcggagaactgaagaaagtcggacggattagcggcgttgatttcgttctggaacagttgcaattcggcttgcgattccttgggcaaagaagataccatcgtttattcttactgttgtcttttgaaaataatctgcttgttgtaaatgatcttcctatttatgtatgcgtgaaatgcgtgtaatggatgtgatgatagcgatcgcttgacttagtcgaggaaagcgtaaagtgtccctttttctctttcccttttccctgtttgttcaaattttctcttttctaccttcctcttcgttttgctccttgccagcaaaacgaggaaggacaagaattttggagagcggcggcgcggcgccataataaatgcacttgagcaaatgcaataagttcagcttatggcttctgcaacaaagaagaggtcggaatccgagcacagtataatcaatatattatcaggcagaacaaaagtggcgggtataacacgaagaaagaaggaagggtggtgattgggtgctttgtttttttccgctcgtcgtggtggcatgcgctttttttttcttgggtgaagattagccgccgaagtcgtatgctcctcttttgagcgttttgaaagatagaaaaaagctgagtaagtaaaatcgtcggcggctaatctgaaaagtatataaagtcctttatattttccactcgtattcttttccctcctcctttttttttttactttctcacgtatggcttgtttcatttattatcagatcagtaatcacgtgccgtgtcgttagaaatgacatttggttctttgccttctttgtcctttttctatcttcctactaagagaaactattatacaatacaataagagaacatcgtgaaacaacataaaagatatcacgtcatcagagagagataaaacatcacaaccaattacattacagtgtattcgtttcttcttagagagagaaataaagagcgggataaaaggacactacacagtataccccatacccaggtgcaataatacacgtatatctatgtttattgcacatcaaaccccacatatatgtctgccagaaaacgcaagtttaatagtctcaaaccgctagacaccttgaacagctctcgtgccagctctccaaggtcctctgcttctctaccgcccaaaagatataacacttttcgtaaggatccgaaaatcgttgatcatctaaacaatgcttctacaaaggatttcttaccagttttgagtatgaacagcgagagtaagaggcagatcgaattgtcggataatgatgttgataataatgatgaaggtgaaggcgtcaacagtggctgttcagatcaagattttgaacctttgcaaagctctcctttgaaaagacactcatcactcaaaagcacttccaatggtcttttgttccaaatgtctaataatctggggaatggttcaccggaaccggcagtagcgagcacttctccaaatggctcaattatttccactaaactaaatttgaacggccaattttcttgcgttgattcgaaaacattgcgaatttatcggcataaagcaccatgcataatgacttttgtctcagatcataatcatccgaaattttcattgtattttcaacaatcggtgatctacaattcacaagttaatctgcttgatgatgttgaattgataattttagataagaagaactcttttatggctataattttaaaagatctgaaaaaggtcaagatgatactagacgtgaataactcttcaatcaacattaacacgaacatcttgatatggtccactgcaagctccgcttcaaataaaaaaataaagtctattaaaagattcctgttgatgtcatattcttcgtcgataaaagtcgaaattttagatcataaagagcagattttggaaagactaaaacatctgattcatcctatttcttcgtcatcaccttcattgaacatggaaagggcaataaactccactaaaaatgcattcgactctttaagacttaaaaaaactaaactttctactaatgatgatgaaagtccgcaaattcatactcatttcttatcaaacaaacctcatggtttgcaatccttaacaaaaaggactcgtattgccagccttgggaaaaaagagcattcaatatctgttccaaaatcgaatatttcaccctcagatttctacaacactaacgggacagaaactttacaatcccacgcagtttcacaactaagacgttcaaatagatttaaagatgtttcggatccagcaaactcaaattcaaattcagaatttgatgatgcaactacggaatttgaaacaccagaactgtttaaacctagcctctgttacaaattcaacgatggttcaagctatactataacaaatcaagatttcaagtgtcttttcaataaggattgggttaatgatagcattttggatttttttacaaaattttacattgaatcatctattgaaaagtcaattatcaaaagagagcaagttcacttaatgtcctcttttttttacacgaaactaattagtaatccagcagattattattctaatgtaaaaaagtgggttaacaatactgatttgttttctaaaaagtacgttgttataccaattaacataagttatcattggtttagttgcattataacaaacttggatgcgatcttggattttcatcaaaacaaagataaaaacgatgccatcaactccgatgagatttctataaataatcctctggttaatattttgactttcgactcgttgaggcaaactcattcaagagaaattgatccaataaaagaatttctcatatcctatgcacttgataaatattcaattcaactggataaaacacaaatcaaaatgaaaacgtgtccagttccacaacaacctaatatgagcgattgtggtgttcatgttattttgaatattagaaaattttttgaaaatccggtggaaacaattgatgtatggaagaattctaagattaaaagtaagcacttcaccgcaaaaatgattaataaatattttgataaaaatgaaagaaatagtgcgagaaagaatttaaggcatactctaaaactcttacaactcaattacatcagctatctgaaaaaagaaaatttatatgaagaagttatgcaaatggaggagaaaaaaagcaccaatatcaacaataatgaaaattacgacgatgacgatgaagaaattcaaatcattgaaaatatagatcaaagcagtaaagataataacgcgcagttaacctcggaacctccctgctcacgatcatccagtatttcaacaacagaaagagagccgacagagttgcataattccgtagtacgacagcccaccggtgaaataataactgataatgaagatcccgttcgcgctgcttctccagaaacagcatccgtttctcctcccatacgtcacaatattttaaagagttcatctcctttcatatcagaaagtgcgaatgaaactgaacaagaagaatttacgtcaccatactttggaaggccgtctttaaagacgagggctaagcagtttgaaggcgtttcgtcaccaataaaaaacgatcaagccctgtcatccacccatgatattatgatgccgtcgcctaaacctaaaaggatttacccaagcaaaaaaatcccacaactttcctcgcatgttcaatctctatcgactgattctatggaacgccaatctagtcccaataataccaacattgtaatttcagatacagaacaagattcgaggttaggagtgaattctgaaagtaaaaatactagtggtattgttaacagggatgactcggacgtcaatttaattggtagttcactacctaatgtagcggaaaaaaatcatgacaacactcaggaaagtaatggtaataatgacagtcttggtaaaatacttcaaaatgttgacaaagaactgaacgaaaagttggttgatattgatgatgtggcatttagtagtccaactaggggtattccaagaaccagcgcgacaagcaagggatcaaatgcacaacttctctctaattatggagatgaaaataaccagtctcaagattctgtttgggatgagggcagagataatcctatactcttggaagatgaagacccttgaaagcactcgcacgcatagttttatattttttattcttttcctctttatttttatttttttaacattctcgcataataatagtaacagcaataaaataactagtaatatacatactcacataaataggcatattttttattttgttctttcgtattcagaatggtaaatttttctaatgaaatgttttacaaaaattttttttctataattctaacaataagaaataaaacagtggaaaaacatataacttaatgtagatatatatatgtaaatatgctagcattcattttaaatgtaaggaagaaaacgcctttaactttcatctggtaaattttctaaagctctacccttagtgtaaacctcgtcttttacattctgtacagtacttttgaaccattgaatgaacagcacagttgcttggaaaaagaacgtaaatgactctaatgctatcagtagtccgaaataaatatcttgcatccttgtccatgttgggaatgattcgttaagcgataaagtgaaactcctggatccatggctaatatcgataatctgctttgtagaaacatcacgtaaaaatactaaggataaaataataatcggcaagacgtaaattaccatgtgcaggaaaccttgtttaaacagttccaaagccattgttttcaagaagttcaatttactagtatttctgtttctgaaaaatagtttcaatgacttatatccggttccgaaattgaccattgacgaaatgatccaaacgacgaataacaaactctcgtcatatttaaaccatttggaattaccaatagtgtatgaagaattgccaaacactctgatggtgagataattgtaacaggctagtataccatcggttaagacgacccacgaaaccatagttctaataaccgcaatcatgatagctataaacaccatcaggttatacttcaccaacatactatcaaatatactgttaaagatggccatgaaaattccttgaccctcttccacattattgatattattaacaggggcattgttgatatctctctctggtatatcgtgttccacttcctctacttcgttttcgtcaacggcatgttcatcgagagtgttttggccttctgtaaaatgaagaatatccttagcaatcttggataaacaaacagatccgacacagacataataaatgttcaaataggagtagctaatgtcagagagttccttccatgcaacatagaccttatttctttcacctaacaatagctttacgactggaagaaagccgaaactacaaacaaagtttattaaagcttgactaataaatgtaacaccaagcattaaaatggaagcaaataaccaaaccaggccaagcaatgtcatatagcgtaaacggaaatctggagggacgtaaacgatataatattgatcatattccgtgttttgttcgtctaaataaccaaattcaccagcagcacgtttgtttctctctttaattctttccaaatctaatggtttcaacagcttatcatcctttgtaacggggacaaacattgtttgtacataatttctggatactatatcagaagaaggaacacgcattaaaacgccatcggggacaaaataagcatgaacgtcacgaacttgcccaaacaattcttctgcttgttctagagtctttggtttagtgaaaagttcttggtttgaccattctgcattcttggcagcaatgtacttgtaaaacaaattgcggtaaacaatatggcctctctctgttggggtatctttacctaagataaaggatgataaacgtaattttcttgaacataacttaaaaattgttttccaatacctttccaataagggtttaacgtaagagctagactccaggatcctcttcgtaaaatataaagttagcaaaattgtattgaacttccatgaaataattgatgttggtttataagcttcaggaacggataataagttcgatttgagcatgaatgggaaaaaaattctagtatggaagccaaaacctaagacaataaaaatcgcataaataaacatggataagcaaagccttgataattgaatactcatcggatgaattaaactatcatgcaagatcttaatattaggatcttctggagatctgataaagaatagaacacctggtctaatgatatttttcctaatcattccgatatatttggcaaaccaatacatgtagagagtaccaatcgtccagtatacgaaaagggaaaatggaggccatattgcgcatattgaaggaacccaaagcatccgactattggatgccaggattgggcaaaataatgagaaatctagcattacaccagctagaatggggaatccagccaattcgatgaaaaataaagtgaacaccttgaaagtgcatttgagtgcaaataaaatctggaaaatcagccttctagtagggttgctcattccgttctcacggccataacccctcgagacaagattggatgaagcacaaacgatactgactgaggttagatacgtcgttaaagcaggtaaagctctgatgaaaattgagtgcttcatggtgttttcagtgtagccgttgtaaagataaatgatgtcatgaattaagtggtctgaaatccaactcatcgcgacatctactttagggaccagtttcgtcagcccattgtaagctatatgagcgccagacaagtagtaaagatggcacaacccacgcaaaataaccttaaatataccaaaataaattttcaacaaaccgaacccaataaaagttggaaacaaataggaaattgccaggtatattgcggtgaaaactacggcaattatgaaataagcaatgacattcaacaatttcaatttgagatttatcactagagggccttgtccttgatcgtctgggttagcctgtgctggtggcacaccaacagctgcgccaaagtcttgttcgtcttgatcgacatttccagctctgttttgggcaggtggtgggatgaaaaccggagcgttgggcctgtttattgcgttctgttgagcagcgattaggtcatcaaattcattttgcgcacgacgatttgcccacatgtcaatcggattgggctctatatgatcacggtaatctgcctcttcttctggttgctgctgttgctgttgcccctctgcttcttcatcttcttcgttgtcacttgaagaccccggtaaaattcgtgacgaatcatcacctgatggtaaactattgtcagagtcgttgttctcgtgctcttccgtagcctcatcatgatctaattcgtctacgtggcgaaggttttcaaaattccgatggtcattaggatcctgaggtggaacgttatcgtttctgggattaataacattattattattatctgctgctgcggctggcatgttcagtctatcatgaccttgctcttgacgattttcgtcatgagctctcatttccctcgctaaatattcaaccattctatcatccatcatggggaatctttccttcaaacgtgatttcaagtccttgggagataatcttggacctatcttgtggaaaaccattttactgaaaacatcctctcttactatcatatcgtattgaaagtacaatgctatatgtagtatcactatcataataaattgtaaagacgtaaacgaatggttttgtaaaagttggtaaaaaattgctctcgtggttaattctggagttgctgactgatcataaccataaatcaaactctttaggaaatcaccaggataaggggatgatccatctagcatcatggtgtataattttccaaacatgttccataccaaaggaacaccgataatatatagtacagcggccaaaccaatcgttaaagccaaacgagctttttcgaaaaatgtcaagatgctcttggatagtagtaaagaaaaaggtatcttttcgggcatgttttccgcatatatcgttttgaattgaatgggatagtgacagatgtcacatttaacatccgcgcctggttttgaaatgtctatattttttgaagctacccattccaacagacaggattcatgcatgtatttaattgagcccctgcatttacaaggatggaaaagaggattgtcctcagtagcttctccacgacaaatacggcaggtggcgccggatggcgcatcatcattgaaagtggcggtatctgtttcctcgtttgccaccttatgcagttcatctcttaacctggagacattaacgtcagaatcaacatccatgactttcacacttctagtctctttgattcaattagtggtactcttggctaaaaaaacagtttttgaaatcagtaacaaagaactattcttaacgtaatcttatggcttcatagatcggtcataatcatcttttcaatgtcctcaatcgatgcgttttcaaccagttttccgtctctaatgatttaatttttctattgaattgaaaatggtaaaaagatagccctgtaggggctcgaacccctaaccttatgattaagagtcatacgcgctaccgattgcgccaacaaggctatttcgttggaaaaactacttattttaggaagtaatagcacatttaagatgcttgttggaatgaaactttaaaatatcatctgtttagtactattcatgttactaattaagatatgggtgaattttgagataattgttgggggttccattgttgataaaggcttataatattatgtatacggaatatactagaagttctcctcgaggatctaggaatcctcataatggaatctatatttctatatactaatattacgattattcctcattccgttttatatgtttcattctcctattacattatcaatttttgtatttcagcttcctctaacctcgatgacagcttctcataatttacgccatcctcttacaccgcatgtgatgctattactactaaatagataacattagaatttcattccaacagctttagtctgttttaataaacgcaacagcaccataatgttattaattttaataaagccaaattatggcctgctgatttcttttcattggtaaaagttctatcacccgttccccattagtatgataaccgataaataaactctattacctggtttcttcgttccaggaacgtttataccctgactacacatttcttttgaaaaataggccaattgaacaattaagttagaagcggttagaaaaaggtataataggaaaaaatgcatccaatttttacagttgaaccacttgggggattttattctcgtattgtagcgggagcattttatcttcgtacatcttggaagctgtagattaatcttattcctatatgctccttcaatccacacagcaaacccccaaatggaaacgatcactgagtatgttataaaccagcttacgcttatactattatcaaaattcaaaagattgaacggggaaaatggtagaaatgaatattgaagcattttcgcaatgaaaattaaccgcattgtttttatagtaattctgatggctaacggcggtaatacagcatccttacgaagagcgggaatagttcatttgccctctttgatggtttgcataactgcgttgttgattgtcttaggaatggaaatatttaacaaatatacctataatgaaaaaagggtccttctttttaattattattggcagcgaaaaagttgtcccagcttctactttttttcccgttaaaaaaggaagcggcggaagctgatctactctctaataatagactactcactcgcatcttggtaacgagtccctttaagatcttggtacataaagtttgctgcagcaaaaagggcttatttgcgcattcatgatattaaacaacaccctgtttagcgtgttaatgatccttgttttatgccagtatattctgtataccttataatagagtcaacagttaaatcctaatcattacctcaggacttacctatttctgaatatcatggtccaccattctacctcagtgaattgattgaaccgcaccattggaattgtcatggtgagccagcgtgctacaacttcatgattttacgagctgaaaaaacacgcccttaggcataaaaactcaatggaaatctgtaaaacaaaataaatttcgctttttaacttggcctaatgggaatactttaacaattgaacctgtcactaaatcagaggaagtacatgcctaattactcaaagctgtatttaactaatttacctatactatcgccaggcattcaaggatgaagacatgcgtcaatgcaaatagtgacggctgctgcattaaagaggtgctgcgtggtgtagaaaaggcaataacatggacgatgcaaggttattcagacgcgttgtttgtatgccatttccaatgataatgttggttgcgttatatagaaatgtgttaggaagagattctacagttgattgcagctttgacgttatacttacaccttggataatggccagtatgttttccaaacgtatggtgaattggtctaatccacgtcaagctgttttaaaagtatgcagcgcagccgtgacctcccggatagttgccaattggttgtttacgatgaacatattatataccagtggtgaaaagggtttttactcgctagcaacagctgtggtaattaaaacggtcactgatgggtttacggtgatacgggttttctctattcacctgaacgagtcagtatatagcaagccattaccataacattgggtaacgtcgcacgcaacacagctgcgggtgtgtgtggtgattggttagtcaattggtcatttgggctggtaatagggcatgttccccttacagcttgtactgtctcattggggtttgctcttattgctggaataataaatggaaaggttaacgacgacacaaatggttttcgacgaccaaaacaaattagcaaatggcaaccttttgtattagggctaattaatgtaagcgatgttaccattttgtctatttctggcggtggactggtagcttcttcatgtggaggtgcaataggctatgctactgtcattaaaactgttgctaccacaaatgcacgtttcgcgattactgaggtgatcaaggaaatagttattcgttattcatcacaattaaatgcagaaaaagtttgtgaagaataaaaaactcgagccgggtggtaaattgttttagtacggttagcatcggtttagtacctgtaccaatatgtgtcacttttgttatttctgcaggcgataatacttataataaacgcatacatgatatcataactgcctttatacggcaccttacaactagcatgggcgttcaagtggtggagaactattacctgttcctgaaataacagaatgaatcatcaataagggcttgtctgtacctcaggatgatttgaacaagttccacttacgctaacatgaggatgaatatcgtacttatactatgtaaactggaatagaaatattccgaacggttatccattagagtgttagccctcaaaccgagactctcgataatattgaatagaagattttaccactaaatttagtgtgtatttatgtatcttaataacaaactatccaacgaagacgcaaaagatactatccgccccgtaatccttttgaaaccactcaagcttatggttcacgttatagaacacaggagacgcttgcattattggtgattctaatatagctttctattcctctatgaaaggcgtctgtgttggtgtaaatagaagaggtgcctggtcacctgacgccttattttgtgcagttacgatgttcgagtagattcgctatcgaatttatgctcaaaatctagctaatcctcttattagatcttgatatgtatatatgtatgaaattataagttctagctctagttttcagtatcttatttatttttctttttttacagtgttagaggcccattccctgcaaatttttctcttcatatgaacgtcaacaaagcttggagtaaatatgatctcaccattagggttacttcctatcaagttatccacgttggtggctttatttaatgcgatttcttttagatagtttccttgggatattatcttcccatcgttactctcaattggtaaatattgtaatttctcgaacgaagtgaacactgcaagaacaaagagtatcaatcctgcatacgtttcatacatgatatctttaggtaacttgctgattgcaccttgtgcattattaagcgagttaagttttaataagtgatgaaactcatagcttgagaaaccagaatgaaataacaccaatgcagagactgtatagagaagcttggaaacaaacgacatctcttgataattgcttttttgtatctcggtagggcttaattacgatcgctttttagatgctacaattaacatgcataacaactatctgagttgactttattttatattcaaaagtagatttttctgcgctgcgtttacatcgcgagttttcgaagaagcaaagggcgctttgatgacgattgaatgggcttggaaaatacatagccgaatatcatccagcgagtatagtctaatgcgaagggatatttgaagtatttatgattaatcaaaaactgctaacgaagctatgtatgttcaaaagaaagatgtgatatatattatagatcttattgttttacaaaagagcaataagtctgacgtatatcttttcccttaatcttgtgtgatttcgtcgctgttgtctatagcatctaccacggttgggtgttcctcaattggtgctaactctgaattattttgcgaactttcttcaataggttctagatcgattgtcatgggaatatctggatcattattttcagtatttgcatggtcggtttctcgttcactgttgggttgtaaaggcgctttttccctctgtgtttgatttgattttgctttctgtatgttctttttattaggttctggattttccattatggtatcatctacgatttttttgaacagcgggccaagcttttctttgtttagtgccacacgggaagcaaatcgttcatctaaaatattcagtttcattagtcccttcaatttaactgtgaataaaaggaattcagtttcaatattctcgaaaaacccggtttccggcaaatcatttaggttggcgtcttcatctgctaccctttctaattggacgtcaacttgcttagcgaaaagactctccaaatataaaaatattttcaaaagcactttggaagcattatcgtgaaggtaaaatggaaattgttcactcatactatatctccatgttgtagcgtctgcaggcaatttgagctcaaatatttttattgcaacgattatatccattaatgaagtgcaagctgaccattttaagtaaaacaagctgtttatgttttcaaatgtttcgtttgtagccgccaatgaaataacgagtgtgtttagacgacctattatagcggcaattggtttccaaactgatctaagatcttttgaaatagaattctcgtaatcccttactttctctattatttctctccatttttccagattccatgtggctaataacactagcattttaaagtttatttcttgagcggtactatcatcaaaatcttgaaacattatagggatacgggaaacaaaattgttcaaaaacagttgcaacaactcttcatcaacctcgattgggtaatccctgccaagaattgtcagtttattgatgtagagctcgtacaaagaacaagttaaatctttgtagtcgtccctagaattatttggatccattttttcctgtagaaatttttttaaatgaattttcaatgtagctatctggtttaaaaatttttcctgcagttcctttttttcaaaatgatggatatggtgaatgaatttagcaaatatatcgtacttcatgtcaacttttgaattcccgattgtagaatccataaatgctttaatagttttgtcggtaattttttttaattcagtttcatatccaatagatatccaatcatccagagaaaatgtgataaagctctctaggagaggacacagaatatcagcagattcgatggatgcggcattcaacaaatcgtagaataaaggcaaaactatttccttaacgctgtccttagtttggattttggggttgttggcacctgcacacagaccgtggaatacgttcagatataaaatagtgctatttctgtcaatgggaaacaatggagtgatgtccaattcctcatcgtcaacatcctcgtcatcgctgttattattggccgagttttgtaacttttggatcagttcatttgattcagtgtcagagatcagcagattgcaaatagttttcaagtgagtggaaatgtaaggagacaaaaactctgctgcttgtgttagcatacggatctttgtccttgaatcaacttcagcgcaatccttcaagtgataaattaaagagtcattcagaatcttgataaatataccgacttgaacaacgggtccaacttctaacccgtcgacttctttgggcaagtcttcatgcgtcttgatgaattcgtcaaatttctcttttattactcttgctaagaatttggccaccgtggatagaaatttggatcttttattgaatgaggatgttttaaatgggtcgaactcttcatcgaacattaaactagaaatgataagaatctcagaatcatctaaatagcccaatgatgacgcctccgttagaacttggatactatggatccttacatcaagattaacgtcacggattgccacttccaggatcttagttttgaagcgttcaaatacttggcgtatagcggaattatcagtggatttactgttatgattttggattattaaatgcggtaaaatcttcgtaacttgtaatctgactgatacagagttatcgctcagcagccagccaaaatattttaaaaatgtaaccttgaggaaatattcgggatagtttttaatccagatggatagatgcaacatggattctgaacgaatcaaatcagacacgtccttatacctatgcacaaaacatagtttgacgatgttatcgataatgctatcaataacgactttgctgccttgagtttcggcgatagtgctctctagcttttctaaagtcttgttattgggcctttttttcttctcttctagtgataactgcttggataacttcgccaaataattcttttctaaattaacagcctgttgggtcaaatagtcctggaaaagatatagcgttagcgtagaaatgtatctgaagcatctgattttgcaaactgaaaaagaagacagccaagtcaacaaatccaacacaagattaccagtaactatttgggtatcatcttcgtccgattccacgtatagtaattgtaagtcatttgccacttccaacaatttagtcatgaattccgcgaaattttgataaaggggacccattttaaagttttttctctttttgttttccttgctaatcaagaggtaaaattcgtgcagtttctgtctttgaaatagcaactgaatttcaccaatcgtttcgttagaagattcattgctgtgaacgtcgtggtcttcgacgcgagcgacggagccacaacaattcaatagcaaattgataaattcttgtaaaaatttatctctattttcagaataggtttctaaccattctcgcaatagttcttcaatagaaacatcttctgaagtggataatatatcaaacaattctgtaggttggaaatccttcgcaatttctaagtattgatcctgatcttttttagagcggtgataagcaggcgcatgagataccgccgacttctgggcagaagtaggttttttcttctgccttttactactggtatttgatgctgatttgggctttctctttctagactttctctttgccgtagcggtatctacgtagtcatcatcatcctggtcttcatagtcatcctcactactactttcttcactttcaccagtatcttgctcttcttcttcttcatgttgcgttttggcagtgatcttatcagattctacgtgttgtgcgctggtgttttgctcgtcatcgtaatcttcctcaataacttgagatttagtccttattctagttgagcgacgcacagcagtcatgttaccttcgtccgagctcttgttctcaggtcaatcgcctttctttattatttttgtttacttgaagctttgttctctttaatcaatatagaggaaaggaaacaaaagaatcatcttatcttacgcgtcacgcgtcgcgttgccgtcagagatgagagtaatagaataagttctaggcaggataagtacgagctttacttcatgctgtgctggataaagcacaactatctaacttgtgtgctaatcgtctagctgaccttaatttactctcctatcggtagcaggctgctttttttttcgttacgaaactttgctttgatgaggatagacaataaatgcttaaaaacagagcttcgtaggatgagtcgattagacgtttagttgcttgcaatgtaccaatacgcaaaccccttccttttccttttttaaattgatcttcctcttttacataagcagtaataatgccagatcttttgccgttgtctgttggagcctgtgtacctcggcggctaacagcgatgattattccacgaaatgagatgctcaccttgtgatataagtgaaaaggaataaatctattaaaaatatgtatatctaaaccatagctagatagaaaagagaaaattgaaatatatatatttgtcataaaagaaacatgtttgaaaaagttgtctatttgttccagtacgtcttgactttcttggcaatgcacattagcccatttagagactctttcctgctattgaacgcctgatggaaatcacactggatggttgcatccatgttttcgtcctccatatcagaattccagcacactatctcctctgtgctgcttaggtcactatgtgacgacaagttgacataatcatttaaagagtcgtcttccggtttcccttttgcggtgttggaccgtgtatgtggtgatagaggtatatccatgagttgactggcctcattgtccttaaagtggagaatattgttggtgtaacctgacttgtctgtgacagtgtcgaagtagttgagagtgacccattttttgtcgtttatcaccactttgaacatggtgctacgttggccctttcttctgggaatttgcaccctgtagttctgtgtgctgccgtcatactgcagaacataatcggaatgtctccagttatcgaattctcctgtaacaactagtttatctgccttggagcagcccttgatcacgtcttcagggatcacaagtaaaaaattggacatctttaaaacagttgtgcacgcctttaaaccgatcaatactgttcttgtttgtgtttcttttttgtattaggtcagagataaatgtttgatctgatctgattatcgcctgtttttgccttaattgaaatccggggaagcgtcggtaccatataaggcaacaaggatatttactataaaggtacgtatattgcacgccaagtaatacaaagctgaatcaatgctcatccatgagcgccataacggcaaatcctacaaaaatgaagactagctgcaaggcccacttcttaaactctcgaagcttgctatcgggtgcggagctatgtaagatctgcggtacaacgctagtagtggctatgtatatgaggccgcccgccgtgaacggcagcataagttcagatgcgttcgcggatgaagacgttgctttatggctgttgttcccgatttcgttcatccagcagccaatggacgttccaacgacggcgccgaaagctgtcaccgcttgggctcttatcgcttgtgggaacgtaaacccactggaaagcagaatggcgaagtcacctagctcatgagggatctcatggaaagtgacagctatgctggtcattatgccaacttgtgtggaactatagaatgacgtagccagcgctatgccatccgtgatgtgatgagcaatgccggatatgacattcagatacgcagacatgttaaagcccgctttcttctctgcagtttgttgtggagtatgactatgagaatgagaatgtatgctgccgtcatcgttggacgtccctgacagaatacgcatcgttttatccagagtcaagaagcttataaaccccagaaatatggctcctccaaccattgtgacatcagttacgccgctgagactttcaggtatcacgtgtaataaaatatcacccaggagtgttcctagagaaaaggaaactagtaaggacagtgtcaagctggcacgatcgttcttgcgcagtccaggaacaaacagtacgaaaagacacggcataagttgtatgattaggatagccacaatcgcattgtaacggggtcccaggacaaagaggtggttctgcagaaagcaaactagagagtaaaaaatggattcttgcttcaaaatcaagaaactttgcttggactcatggtttgcctcgtggccatgatctcgattatgatgtactccatgggacaccactaggggtgcaatgcttagcaaataagagcaaatgtgcgacgccttcatgctttttctgcttctgttctccttctatttcattcttattttcttctttccttttccacctttttcctaagacgtttttttttttcagtttactgttctatggaaagggaatgaataataatccggaaaactatatattggaagaactggcacagtttggttctccgcagaaattctactaaattacgtataaattgtgtattagaagaaattcagaaacgaaatatctgaacagacctactttagtatttttatatgataactttttgagttgtatccttttcttcatttatttttagaaactttctttttttggccataacataaaatttaaataacgacgctgaaacaaaaagaaaagaacaccacgactaataaaacaaaattagaacattatgattaggtacttcttcagtacgcttttcaagctacttcttacgataagtaaacttctcacctgtaaatactagtaacggtagcaaccatacggaaaaccatgttcagttacccggccgggtgtttttttctctttctttttcgcccactggagagcctcagtcatatatgtcaaagaagactggttgagtagcatgggcttcggaaccaggtttgaaagtaccaagtataataagcccgcaagtaagcaaaagttgggataagagggcaggaccgagcttatagtgtttcgtttttttattcctgaatttttcactaccgcagcaattgctatttcagttcatgcacagatccacttttatcaggacgtccggcacgagctctaggacactaaccgcaaggtacagatcgcagtacacaggattactcgttgcccgagtattattctccacctctacgacccgtgcgcaaggtggaaaccctcgatcaccactccagattttccgcgatacattcaagaaggaatgggagaagtctcaggaactgcaggagaacataaagacgctgcaagatgcttcgggaaagttaggcgagtctgaggcctacaaaaaggctagggaagcatatttgaaagctcagagaggctccacaattgtgggtaaaactctgaaaaagaccggtgagaccatggaacatatagccactaaggcctgggagtccgaactcggtaagaacacaagaaaggcggctgccgccacggcgaagaagctggatgagagttttgagccagtgagacagacgaagatttacaaggaagtctcagaagtcattgacgatggggagagttcccgatacggtgggtttatcacgaaagagcaaaggagacttaaacgtgagagagacctggcctctgggaaaagacacagggcagtaaagagcaatgaagatgcaggaacagcagtggttgcgacaaatatcgagtctaaagaatcgtttggtaagaaagtggaggatttcaaggagaaaaccgtggttggccgttctatacaatctttaaagaacaaattgtgggatgaaagtgaaaaccccttaattgttgtcatgaggaaaataaccaacaaagtgggcggtttctttgcagaaacagaatcctcccgtgtttacagtcaatttaagctaatggacccaaccttttcgaacgaaagcttcaccagacacttaagagaatacattgttcccgagattctcgaagcgtatgtgaaaggcgatgtcaaagttctcaaaaaatggttcagcgaggcgccattcaatgtttacgccgcccaacagaaaatcttcaaagaacaggatgtttacgccgatggccgtatcctagatatcaggggcgttgaaatagtgagtgcaaagttattggctccccaagacatcccagtcttggtggtcgggtgtagagcacaagaaatcaacctttacaggaaaaagaaaactggcgagattgcggctggtgacgaagctaatatcttgatgagctcttatgccatggttttcaccagagacccagagcaaatcgacgatgacgaaacagaagggtggaagatcttggagtttgtgcgcgggggttctagacaattcacctgattggtttcgatgtactcttttgttttcttttccttttccttcctattccgcttgtaaataactccgttatgtctcaccttcgatccccactttttcttttggaatactgcatcaaataggaagagagaaaaaaggaaatcatatcccaatatatttgaacatacgacacgatataccttatatagtatcatctgtactaatagtactataactaatacttcttgacggacaagcttcgcaactcgttcgcaatgaccaagtttggctttcgggaagcaaagtggaaaaaaatgaaaaataaactaattgaagtggtaaaaaataagctgtgtgtgtgcatatacatcgtaagtgcgttggctgttctgtggaaaagggagacactttttatatcaggtgcaaaggcttcgtaccagcgttgaaaaactaaaacaatattgaaaaatgagtgaagaaggtcctcaagttaaaataagagaagctagtaaagataacgtcgactttatactatccaatgtggatttggctatggccaattctctccgtagagtcatgatagcagagattcccactttagccattgattcagtcgaagtcgaaacaaatactacggttttggccgatgaatttattgcacacagattaggtttaatacctctacaaagtatggatatcgaacaactagaatacagtcgtgattgtttttgtgaggaccactgtgataagtgttcagtggtgttaacattgcaagcgttcggcgaaagcgaaagtactacaaacgtctacagcaaggacttggtaattgtgtctaatctcatgggccgtaatattgggcatcctattatacaagataaagaaggtaacggtgttcttatttgtaaattgagaaaaggtcaagaattgaaactgacatgcgttgcgaaaaagggtatagccaaagagcacgccaagtggggtccagcagcagccatagagttcgagtatgatccttggaataagctcaaacataccgattactggtatgaacaggattctgccaaagaatggcctcagtctaaaaattgtgaatacgaagatcctccaaacgaaggtgaccccttcgattataaggctcaggcagatacattttatatgaatgtagaatctgtggggtctattcccgttgatcaagttgtcgtcagaggtatcgatacattacagaaaaaggttgcctcaatattgttagctctgacacagatggatcaagacaaagttaattttgcatcgggtgataacaacaccgcttcaaatatgctgggaagtaacgaagacgtaatgatgacgggcgctgagcaagatccttactccaatgcatctcaaatgggtaatactggatcaggagggtatgataatgcttggtagttctcaagtgggcgtaatagaggaaaaaaaacaagtgaacgaaccgaaaataataagagaaaaaaagctttatatgcatgtatgtatcattatgattagtattataagtattataatctaaagtacgaagcaaacaaaaaagaaaaaagaaaatgaaaaaatgaaaggaagggctaaccttgcttttcattccatctacagcagtcttcaaacttaactaggttaccaccaaatatatctaaggaactaccgaatgtcaaatctacttttccgtgacttagttcgtctactaatttcaaatcatcaacacttttggccccaccagcataaacgattttcaaatcatcgtaatctttggtccattcgaaaagcttagaaaccaataattcatcgataccaccacacaaaccttcaacgtctgcagcgtgaattagaaactcatttgtatatttcctcaattctctgaaagtgtcagcattaagctcaagatcagttagagtttgccatttgttcatggccacaatccaacgaccgtcctgggtttttctacagcttaagtctacaacaatgcggtctttcccacatagttctgtcagtctttctaacctttttaattgaaaatgaccctcttttgtaaatagccaactcgtaacaattactttactggcccattttaaccattccaaacagttcgtatcattaattcctccgcccacttgtagaaattgtggtgactcctggagtgcctcgcgtgcagcgtcgtcattgttaggtcccaacttaataacatgacatccttggacatctctgtctttgtaaagtttagcgtaatatgaagaaggatgttgtgatacaaagttagtttttggaacgtcctcctttttgctcgttaacgttccacctacaatctgtttaacctctccattatgcaggtctatacaaccaataaacttcgtcatttttttctagtatatacccccagccttcttatgcgcagtttcgaagatattgtgaatttgcaggcgaggattctcaaattattccgtatgactctgcacactagacatggctcaatcttggcaatggaccctgtgctgaattttcgtcattcgtctcatgcgaccgttccgttcctagaaaaattttgagcgatgagatgagtatacattaacgatggcaggaacagttataacaatattgagagtacaaatgacccaaaagccataaaaagatgacccttgatgatgacgactatataaaacaaatggagcttcaaagaaaagcttttgaaagtcagttcggatctttagagtccatggggttcgaagataaaacaaaaaatatacgaactgaagtagataccagagacagttcaggtgatgaaattgacaattccgatcatggtagtgatttcaaggatggtactatagaaagttctaattcttctgatgaagatagcggtaacgaaaccgcggaagaaaataatcaagattccaaaccgaaaactcaaccaaaggtcattagattcaacgggcctagtgacgtttatgttcctccaagtaagaagacacagaaacttttgagaagcggcaaaactttaactcaaataaacaaaaaattggagagtactgaagccaaggaagaaaaagaagatgagactttggaggcggaaaatttacaaaacgacctggagttgcagcaatttctgagagagtctcacttattgagcgctttcaataacggtggaagtggttctacaaacagtggtgtatcgttgactctacagagtatgggtggtggaaatgatgatggcatagtataccaggatgatcaagttattgggaaggccagatcgcgtacactcgaaatgagactgaatagactctcaagggtgaatggtcatcaggacaaaataaataagctggaaaaagtacccatgcatattagaagaggaatgatcgacaagcacgtcaagagaatcaaaaaatacgaacaagaagctgcagaaggtggaattgttctatccaaagtgaaaaagggacaattcagaaaaattgaatctacatacaagaaagatatcgagaggcgtatcgggggaagcattaaggccagggataaagaaaaagctaccaaaagggaacgtggtttgaagatcagtagtgtaggcagatcgacgaggaatggactgattgtatccaaaagagatattgctcgtatcagtggaggcgagaggagtggtaaatttaatggcaaaaagaaatcccgtcgctagatcaattgtgattccatgaactcacaaacaactcgcctaagaaactgtctaaatttttatgcactaaatagaccacaaatgagaacgtaaagagaagcttttatcattttatttctcttctccttaggaggaaatacaaatatcttttctacatttaattcaatctgacagtcaaagttatacatatacattataccgattaccaagttttcagactagaacccatacattattttacaaacccagacagtacactatacaaaaacccaagcaattgcaatcaatttttttgcacgaaaattttattcgaaatcgccaacccgctagggagaaaaagaaggaattctcaaaggagaggctggacagagaggtcgtcccagtctaccgcctacgagtaatgttggatactaagcagttcccagcctgaacgctctgctggatgggtggagatttccctccaggcgggaacactcctggtggattctgctctggaaactatgctgtgcatgctacaggtttcaataatctttcatacttgacaaaagtagatatacatattttaaaagattgagttactattgataaatctactatttgtcataaactcaccaagaaaccacaaagttattgaacaatgggtatgtttttattatatcgcataattatggcaaatgttatgaaggattcctctatgacttagatgttttgaatcggtacattttattttcagtatccttctgcatattacaaggcaacatagcagcggacaagaaagcttttttgatgttcgtcttcgaaacgattactatcagggtcttttaaatgctatatcgggacttattgaaattgacatattacacttatgaatgacgttggctatcaaagtatgagaataagcctttcctactattttgtatcatgacaacagggttctgtcgctttgaatgcggccttttactttgccatattttgataatgaaaaaactttcgagaaatatttactaacaggatcgagaatttttttcctcatttaaacaggtagagttattcgtaaccaaagaaagggtgctggttctatcttcacctctcacaccagattaagacaaggtgctgccaagttgagaactttggactatgctgaacgtcatggttacatccgtggtatcgttaagcaaattgtccacgactccggtagaggtgctccattggccaaggttgttttccgtgacccatacaagtacagattacgtgaagaaatcttcattgctaacgaaggtgttcacactggtcaattcatttacgctggtaaaaaggcttctttgaacgtcggtaacgtcttgccattgggttctgtcccagaaggtaccattgtctccaacgttgaagaaaagccaggtgacagaggtgccctagccagagcttctggtaactacgttatcatcattggtcacaacccagatgaaaacaaaaccagagtcagattaccatccggtgccaagaaggttatctcttctgacgccagaggtgtcatcggtgtcattgccggtggtggtagagttgacaaaccattgttgaaggctggtcgtgctttccacaagtacagattgaagagaaactcttggccaaagacccgtggtgttgccatgaatccagttgatcaccctcacggtggtggtaaccatcaacatattggtaaggcttctactatctctagaggtgccgtttctggtcaaaaggctggtttgattgctgccagaagaaccggtttactacgtggttctcaaaagacccaagattaatctttttaattttggtttcttccttctgtcatattattttatcaattttcttaaatattatataatttaatccgaaacgttccttataaagtgatatttctatgcatacttttttttctttgacatgagaataaattcagccagctacttcctatcacagaaattttagttaaacgtaagcttgcagttatggattcttctgcgaaaatactatttaaaaaactatagcataaattaattgtaggaaatactacgagttctgtgcattcatttaactttcaaaagcaggtccatgtgatatagtaacgttctggccttttccctgacagataatgattcgtctgtaatattttttctaaccagatcgtataatcctacctccacgagttttctacatctttccaccgtggcacgtgttacttgtacatttgatgtactaccttttgcagccggggtgcgaacgaactcatcgccttcatcatcaccctcatcattatcgtcatcttcatcatcattcgcattgctactgctatcatcgccatctggctcatcgtagtatttccccctagaatatccaccagccactgattcattatacccgattgtcaccgtagattgagggttttctgaatcacttggtgaatgccctggttccagaccattttcaattgcatattgggtataatgtgaaactgatgaattccaaagtaagttattgagtacccagaggcatgccaatttcagattgctgtcattaccattacttgaactatcagtcgttgtttctaccaatatttcactcataatgttcaatatttcgtcttgttcgatgactagctgctttttattctcattgactgccgctagattcacgataatatataggatgccttccattgctttcttttgttgagtgtctaatggatttaaaagcctcatcttctttgcaagaaattcgaaaagatacgttgagccgatgctaattttattacctgtttgaggatcgatcttgtattctacatctttaaatttttccaaaagaatatttacaattttccttgaattacaagtcaaatttctgagcaactgaaaacattgggcttgtactgcccaacatggatcattaataaaatccaaaattaaattcatcgggattttggccaaaagctgaaacttctcttcattctggcaattgtacattagatgccttagtacccataaagagtttgccttcacttcatgcacaggtatgccttgcaatgcaatccttctttcatcttcattatcgtcccaggctttttttgagttaaacaatggatctgttaacatcttttcaattatatcgattataccgtttctcagcataaatgactgtaaattagagaactccaccacgaagttacaaatactacccagagtaatgcccataatcataatttccggtttcataaaatcttgtccagcaaaatagcattccttggtcaacgtatatgttttacttagtatctgtaaaagcagctgtgcaattttatttctcttcaacgtcgtcctaagcgctgaaacacttctcgagaatgatttcaacaatagtaaccaagctgccacgaaatcgtgatcatatattgggggtaaacacatagaatgactttccgtagttgtttcctttatctcatctttcaaagatataaaatcctgtatcaaagtaatgtgggattccaacccgtattctaaatgattcaacaacaatgtgtcattcaacagtaaaagacggtatttttcgtccgatgctgcaaatgacgcacatattttaatgaattttgtagttgttttcaaagtagcttcattgtgttgtggtagagaaagacactgcgcaaaacgggatagaatgcaaaatataacgtttgtatgagctagcgtggtgagcacaggattattcattggagtaatttcattatacaacacaatcaatgaatccagcatatcgaatggatcaaaccaccaaggcaacgggtcataattaaatgacttaactaaatagggtagtattttctcgagtgtacgcgtatcttcccatttcttatcctctgtaaagtacggttgtaacaaaaacttcagggccacgcacctaatgttaacgtcattactcttcaaaagacccagaacgaacatcttgaacgtcgcatcattccgcagtttcctatcacccggtatcatataatgatatcttagatatagaaggagtgccaatgagagtaaactagaatcatacatgtttgagatattgatttttttaggtatggcacgggtgcagtcgacccctttattgtcaaacggatcgttcttgacgctggatggtgacgctggcctggatacttttagcctcactatatacttgaggcttatttggtccaagtacttcgatgatattttaactattatgtgttcaagggattctgccattttaaaatcttggtagtgtgaagtttctgtcacttctctctcttcctccataaacttgctcttgttgaagtcgctgcaatttttctcgtccacaagtaaaaacaacttcaataattcaataatcgtgaccacctcatcaattttacatttgctcctcaaaaatttatggttgactaactggatgaacccgttctggaggtattgcaagtctgggaatccgcaatttggataaactcctgcacacaaatttagaagctttatgtacttatagtttgtcgaagaattatttttagtaaaactgcttgccaaactcatggacttatagattgcggacacaatatcaaagtaatatgtgcctactatatccctttgttgcggttctagatgtaaaagggtatatagcagatctaatttcgcattttttaactctacaccgtcactttgctcaatggacaacaaacattgaaaaatctggcactttggagccaaaaagtaatctaccttagccaactggtctcccaccagggaattactaatctttttgagattctctagggaataagccaccgtcatagtgtaactgtaatatatcaccaatctaacacgagggcaatgatacaggaaaactgcaagtttccgccatgaagatcatcctcttaggccgcagtttgtagtgatatccctataaaacgtattataatctaattagtttagttcgcgccccttcagtctaatcacttataacggatgacgaatataaggtcaaaagcttcatacacaagcaaaaccatttatgctacctgcaattcaatcggcaagcatgctttttcaagagcgcatatggacttgaaggagagccatagctagaggggtttttaaatggaagacttgtgctcatctaattcaatttgcctttactatcatttggtcgatattgaaaaaaaatatcgcgaactgacataaccagtagaaaaaaagatggaatcagctctgtagtgctggtttcaatcctgtttgttggtgaaaaaatagcaccagaagggcaattgtacgtttccgtaatgtcgcacaacgcaatggaacattggaagagcaagctgagcaaaacaagtacctcgacgtacgtcctcttggccgtgattgctgttgtatttttggttacaatcagaagacccaatggcagcaagggaaaaagcagtaaaaagagggcttctaaaaagaacaagaaaggtaagaatcagtttgaaaaagcgccggttcctctgactctagaagaacaaattgacaatgtgtcgttgagatacggcaacgagttggaaggtcgtagcaaggatctaataaacagatttgatgtggaagatgaaaaggacatctacgagcgtaactattgcaacgaaatgcttttgaagttgctgattgagttagacagtatcgatttgattaacgtggatgagtccttaagaaggccgttgaaggaaaaaaggaaaggcgtcataaaggaaattcaggctatgttaaaaagtttggactctcttaaataagtttgtatttttagtttatagataacggctcttgccgaattcataggctgcactcattccggtacggtacacatttgttgcatttattatattagagatgcgttgtccctgtttttctacctccgacatcatgctgaaacatggcatgtaattaccgtaaaaggaaattacatggcgagtgtcacataatagcgacaataacatgtatacacagccagctattctgaaacacaccacattatagttattgaatgtgtgtgttttttgataacagtataaaagtgaagagaaagcacgtcgagccttgtcatgatgaattctttaatgatcttcgcgtgatttaattctagtggttcgtatcgcctaaaatcataccaaaataaaaagagtgtctagaagggtcatataatgtctgcaattaatcatctttgtttgaaacttattttggcgagtttcgcgattattaacaccattactgctttaacaaacgatggcactggtcacttagaattccttttacaacacgaagaggagatgtattacgcaacaaccttagatataggtacaccgtcccaaagtctgacagtgttgtttgataccggatctgccgatttttgggttatggattctagcaatcccttctgcttaccaaattcaaatacgtcatcctattcaaacgcaacttataatggcgaagaagttaagccttcaattgattgcaggtctatgagtacttataatgagcatagatcttccacctaccaatatctggaaaatggtaggttttacatcacatatgctgacggaacatttgctgacggtagttgggggacggaaactgtatcaattaatggaattgacatccccaatatccagttcggagttgccaagtatgctacgacacccgttagtggtgttcttggaattgggtttcctagaagagagtccgttaagggctatgaaggtgctcctaatgaatattatcctaattttcctcagattttaaaaagtgaaaaaataatcgatgtggtcgcgtattcgctgttcttaaactcacctgattcaggtactggttcgattgtttttggtgccattgatgaatcaaagttttctggtgatttgttcactttccctatggtaaatgaatatcccacaatagtcgacgctcctgcaactttagcaatgactatacaaggattaggtgcccaaaacaaaagtagttgtgaacatgaaacgtttacgacgaccaagtatccagttttgttggactcaggaacctcgctattgaatgcgcccaaggtcatagcagataaaatggcttcttttgtaaatgcgtcctatagtgaagaggaaggtatatatatattagactgtccagtatctgtaggtgacgtggaatacaattttgatttcggcgatttgcaaataagtgttccactgtctagtttgattttaagtcccgagacagaaggcagctattgtgggtttgcggtccagccaacaaacgattcgatggttctgggtgatgtgttcctgtcctctgcatacgtcgtattcgatctcgataattataagatatctttagcacaggcaaattggaacgcaagcgaagtttcgaaaaagctagtaaatattcaaacagatgggtctatttcaggtgccaaaattgctacagctgaaccctggtccaccaatgaaccatttacagtcacctctgacatttattcatctacaggctgcaagagtaggccttttcttcaatcatcgacagcctcttcgcttattgcagaaaccaacgtacaaagtcgcaactgctctacgaagatgccaggcactagatcaactactgtcttaagtaagcctactcaaaatagtgctatgcatcaaagtacaggcgctgtcacacaaacctcaaatgaaactaaattagaattatcctcgactatggcaaattcgggcagtgtctcgcttcccacttcgaattcaatagacaaagagttcgaacattcgaaatctcaaactaccagcgatccaagtgtagcagagcattctacgtttaaccaaacgtttgtacatgaaactaaatatcggcctactcataagacagtcataacagaaactgtcacgaagtattctacagtcttaataaatgtctgtaaaccaacatattaagaaatctggagtacaatttctttatagcatataaatatcaaatatatagtcatttttaatacatggaaagcataataaaaaaacaaggggagttttactgatatcattgggatatataaaacaaaatagtaatattatgcagccatcacaattttgaacaagtagcacattattcattgaataaatgctaaaaaaatctccgcgacggggaattgaaccccgatctggcacgcgacaagcgcccattctgaccattaaactatcacggaatattagatgtgatattgttgtatctcaaaatgcgatacgtcaatatgacaatacgtcatcctaaacgtccgtaaaacacatatgaaacaaccttataacaaaacgaacaacatgagataaaacccggcctcccctagctgaactaaccaaacgtataaatgcctgaacaattagtttagatccaagattccgcgctttcaccatttagtatgattcatattctatacaatatataagataagtaacatcccgtgaattaagctgataatccgttttgacagctcgttacttccctaagactgttaataataataagattgtcaagacaccccggtattactcgagcccgtaatacaacaattttttcatttcacttatcctttgtattttatgtacagtaaaatctgtcatctgaaataaggaccttgttgaagaaagactttgttgtgtcggaatgttggaataaaaatccactattttctatcaactaatagttatactatcaatatattatcatatacgttgttaagatgatgacataacttatgagaagctgtcatcgaggttagaggaagctgaaatacaaaaattgataatgtaataggataacgaaacatataaaacggaatgaggaacaatcgtaatattagtatgtaaaaatataaattccactttgaggattcctatgtcctcgaggagaactttcagtatattctgtatacataatattataagcatttatcaacaatggaacccccaacaattatctcaaaattcacccatttctcaaatattatatagcctttactaacaacggaattccaacaattatctaattattcattaaatggccaggaaagtcctggcagaggggtactttcatcagtaaaggaataattgtcccagtactcccccgcatcataaacccactgggttgcattctccaaagttggcactagatgagttgctattaattcctccgtgcagccatttatagcggacacatttaaaacatagtcacctaacattgggttagttgtataagatagatagctaatatcaggcgtggcattcccccaaataatcaataagtttgctgattcattactcatcaaagtagttatactgggatagttcatgtcaatgtccatttcttttcagaaaaacagactgttaaataaaacaggccttaaacttcaatttttgaacttttttctactttctgcctttagctctgttgtctcattaaaatagtacataatttgtgcatagctacttgtaagaagcagtcgagtaaatgtttggaagctgtttgcaaccacattttaaatgatatcctttatgcgataatctcatctaccgtaaaatacgagcttctatggccaagttggtaaggcgccacactagtaatgtggagatcatcggttcaaatccgattggaagcaattttttttctttgaaagagaatctttttcaaatacggaagaatgaagaagtatcgacaatgcaaattaccttaatgatctcgtctaaaaaaattttgaagaggaattattctgatttacacgcaaaaagtggcaataatctactctttaatttggtatcattgtttgtcttagtacttaaattgtgcctctggaactgatcaaattcctttctccatcacatgagtacgaggaggggtgttaaggaattaaagacagtctactaaaactatttccctaagcatgcttaaatcattaaaatccagaagactaatcttaaaacgattagtaacactgctgctctctttattcttttcttatctcattttctctgccagtcggaatgttacatcatccaataaattaaacaaccatgcaagcgagaggacagctgttgaatcatctgcattcaattggattgaaaaacgacaacaccaagtgagatccgaaaacttaatgaacagattatctgcctactttttgccctttttgagtagaagttctcacaaagaacgtgtattgttgaggcaattaggaaataatgaaatagcgaagagtgacaagtgccgttacatttttgaagtactatacaagattgatcccgactgggacaatgcgcaaactgcaaaattttataatgttgatggtgtagataacacgttggcctcattgttaggggaaagattaagatcttatgattattgctttttatctggtcaattagatcctactgcaatatttgcaaattcaaccgtaaatcctcatgatttgcaaaacagaatgtttccatttctgaagaaaattaacgaggaatccaaaactgtaatgtggcctattatcacagacatgacaactggagaggcagttccggcacccgaggttgatatggaatcatcaaactttaatggtaacttttggtccaactggaataggttgagcaaaggaagaggttttgttttaactattgctgaaaaggatgttcctttatttttgaaacagttgaaagtgatggaattttcaaaaaacgaattaccattccaaatagtatccacgggaaatgaactatcagcagagtctattgctaaaatttctgagaccgctaaagaaacggaacaaagggtctacttagtagactgctcgacagtgcttgacactaattttgctaatacatacatttctttttttcagaataaatgggtcgccactttgttcaacacatttgaagaatacattttgttggatgcagacgtagtaccgtttgtagggtctgattactttttcgactctccttcttacagggagagcgggatacttttgttcaaggatagggttatggaaaacgagcaaactttccaatactgcatcgaaatgttaaatgaagtggaaccctctgcacaagaacgcagatttattggaagtaggttagtttttgattcgtcattaccgttttcttccgaaacctcagaagaagcatctgtgtattacaattttttcaaaaaattacgactccatcatgttgatagtggtttggttgtagtcaataaacttgagaaattaaatggattgttgatgtcttttatgttaaatttggatggaaaattgcagaggtgtgtgtatggtgacaaggaaatattctggttggggcaattatatgctggccaggattattctatcaatcccgttgatggcagtattattggacctgttaatgaagagcctgaaaatgatgacggacataaaagcgggatgtactacatttgttctacgcagattgcacacagtgactccaaaaatcgattactatgggtaaacggtggactgaagacttgtaaaatttcgaacagtgctgaagatgactttggaagagagccagagtattttaagagtagatatggggacatttcaaaattaaaaaggatatatgatgcttcgttgaacgtagagggactaatcgttcctgacgtttctgttcatccatggatgcaaatcaaggaatgttctaattatatgtattgtgcatatgctacgggtgacggacacacaaactctgaacttgacgaaggtcgtctaatcacgtttactgaaaaggaattacgatatatcaatgatatttctcgaacctggaatgctaattgagaaaaaaaaaagtgaaaaggaaatgagagtattaatatttattaagtatggagcatatataatccgaaaaatgattatagattaatttagaatatgatttgggaataaattaacaattagtttaaagcagaaggcagccggatgaggaacaagaactgttgaatagtattaggtaattttgaatgttttctaacggaacgctattcactgattatacgctttgttcgtttggattatgagatgttttggaccgcctcattgatgggatacacttctttataccatcaatcacagaaggccaaatttttttgatgtaggttaggtagaagcccacaaacatggcggcaatgttaaagcaaacgaaaacccattcaaaaccaaaatttctccatctgtgatgataactcatattttcttgagcaaggaagtcatccccaacagtgtacatgcagtaggcgcagacggtgtatgtgttattgatgtgcagtttcccaccaaattcatcaataaagggtttcataaactgaccgcaggtttgacccattacaggttggcttggtaccatttcacttgtcgagcagtttacttctctgtcatggagaagtaagcttacgaaagtttcaatgaaatacgtgtatggtgaaaccctgtacatgaatgtccaaaatcttgggaataacgagtatggttgcataacgccacagaatgaagctgtgaaactatagaggaaggcaacaaagacagcggcagtttgtaaatcgggggcagaatatagaagccacaacccaaatgacaaataatacatggaaaataaaatataattcaagtaaaagacaccagctacacgggcagaggtttcgaaaccgcaacagaagtagcaacacaggaaaaataaggtagaactggaaatggctaatggtaattcaacaatagtttgagcaatcaaaagaacggtccaatgataagtattagatctcgcttccctggcgatatatacttctttagattgcaaagccttatcttgaacctgattgatcaaaggggaggaaacacaaagcatcatgaagcacaagaaaatagcatcttgcagaccgttgatattatgctttgtcctccaaaatgaaaatccaatgaatagtccagcgccagcattcaaagcatatttagcgaaaacataggtcatgtctctcttggtacaaatgtactgtctctttgtgattaactttatttgttccatatacgaaggcggactccatacggacgtagtgaaatcaacaccagatttccgggcttcttcttctaataaaagcaaatcatcagcaacccgcactttttctggagaggattgccagagttctgcccagttaattgaatcagattgcttatggtaagatactggctcatcaattttgcttgaggttggcttctctgcatcatccattggaatatttgtacttccgctaccaacaacgtcaataacgaaatcagccggattatccatttctctgtcaaatgttaggcgtctatcgtgagctacaaaatagtcacaggcattaggtaatgaaccaaaatagacacactcaccacctctttttagtaaatagatgttatcaaaatagctgatgacacttttgctaggctgatgaatagtacataagatagcctgaccttgcatcgaaagctttttcagaaattgcacgatggttaaagctgcttcggcgtctagccctgaagtaggttcatctaggaataacaacagagaaggcttagtgaccaattcaacaccaatagataataattttctttgagttggagataaatcagcaaccagtttttccgaaggcaatcttaataggttgctaacaactcctaaatagtctctatccccatcacctcttaggacgcaggaaatttccaaagactctctcacagttaagagctctaaatgaacatcttgctgttgaacgaaccctatacttcttctgaatgcatcaatattcgttaagggctgtccatcgattaataattcaccggtaacaaccccgctttcggtcctttgagacaagacattcaacaaagttgtcttaccagcaccagattcacccattagggcagttaatccggaacttatatatccagaagcgtcgttgatcaattttttgtctccaatggtataattgatatttttccaggagatgacgtgcttttgcgtttccatagctacggattccttagtatgattgttaacagtttcatctggatgtttaatattgtaatcagtatcgtattgatgcgagactgatggaacagaagaggatgaagtggaaaaattggctatcggggtcttgggagtacatacgccatcgttgttggtaatagcgcttttattattctttttttggctattcagaaagggacagtatcttttgagatagttattccagcgcaataaattttctctagtaaacagaggcgtgatatattccgctgctagtaaagagcaaaataggaagaaacacagaaacccaatgataataccgaaatttctccacacgtgatggtaagtgtatttcaatccactttttaaataatcacggcctctgacgtaatcgttacctagggtagcgccttgccaggcacaagctttatgactgaatgaaatattgtcataatattcacctctgggaataatactttcatgacagtctagtttcaggttaaacaattcgttactcaaaatggcttccatggcaaacatagcaggattcaaatatgcaatccatatgaaccatggatgcatatctttcatataaataacataggacgcgtacatggcaatggctaacagtaagataccggccaataggtttgccattgatagagttggagcgatcaaagcagttaatgcaaatagtgacaccatgcaaaaattatagacggaaaggaaaagcaaaaagatgaaaaacctagctgcattgtactgtaaatgggccaaaaagtaaagtatgattgtaaaaataaccaccagtataaatttagagcagcaatcgaaaaaatttgttgctaaagtttccacccaattataataaaaatggagctggacatgtttacgaacgacgggttgcctttgaaaggaagcaggcatgtcggcgagagaaagaaatgtaaagaataggatggaaaagaaagttaaagatcctctagaaaacgaaccaattgttgtcaggggaatgttataaaaaagggacccaataaccaaagactgcaccacaacagaaacaaattgagaaatcaagtagtttctgtcaccaatgattctttcgaaagctcttacagtgcacgttttcagttgcgtctttagcggaatactaaaaatgggggagatatcatccggattaacatcttttctggtgcattcttgcactgtttttgaagtgatggccttccagtgtttatagtatggagactgaatccataatgtatgcaaatctgtttcattattgatgtttaaagcttgattttcttcagaaacaacagatggagtgtcaagaccaacaatggaattagacgtttccttgaacttaaaatttaagattgatgttaaatattcaataatacaatcgttagggtttttttttatctgtaaggtgtcatgaaaatgggttaaacactcctccatggttccgtaaaacacctggaaggaatcacctaacataagaatcttgtcaaacttgctgacaattttgtcgcttgcttgagaaattttaacaaaattcaccgatcttgtagcttttgccatcttttgggtaatggaaagaaattctagggcggtggcagagtccaaacccttcgtcgagttgtcccataagtaaacagacccattggcaataaacgtttctataatggagatacgtttcctttcacctccagaaacaccacgaacgtagtcattacccacatacgtcttctttacgtgcgacagtccgaactcttttaataactcgtctctcatttcaatacgctcttgcttgggaatgtgaaacttacaactcaacgcaaaatcaatggtttgctccaccgtcagatacgggaagtgaatatcttgttcgttattataaatgatctgatgggggcatttggaagcaaactgtttgtactcattgtctttgaatctaatagacccttcaggcgagtatttcagatgcttgtgaccatggaatagacctttgaagagcgctgatgttgggtttcccagtactaagacgacttcaccttcattagcacgaaaagtgatatcactaatttctaaatggcctacgtttttgaattccgatgcggactcttcatcgttctgaacagcaccgagggattcttccaattgaacggtagccccatcaaaggtgactgaagcgtcaggaattggattaaaatatttggaaagagacatccgcgaggcgttgcttctctaattttactctatcgtgtttagttgtgaatttttttgctacagtatgcaagttctttttaccaacccgtttacgaactaatgagaaaagggtttaagtgtgtgataatactattaatagctaaaagagcagagagctttacgatgttgtatgttgttttatataggtgagagcaggatctgcggaaaatacttcgtaccgtagtatccattttgcctatggaggaaagcttgtttccaaaccaggagatccgcagacaggaaaagttcgaggccaaacaaaaaccgcagcacaatggagtaaaagtcgaaggcacgggccccaaacgatagagtggaagttgtaggaaacaaaagtggccgtctatgtggcgcttctctgcggtgaattctgtgcgaagtgcctaaacgaaaacggacggagaaggctgcggggggatatcccttgcataaaggatgcccggcactgtcctagacggtgccttcccttagagactaggagagacttgagtaggagaaactgagcaggaaaattcgagagataaagtacatgtgcctaggtaagctgtacttcgaacagctaatattagtaagatgcataaaggggcgtcaaagtggaaatataacgacaggagaatctcggtgtgtaagttggaatgtgtattgcaccacttccatgattgggcttttttcctggcgcaaaatgttgctttttcaacatttttcttatacgcagagagagaatcgtcagataggtggtaaaacttggagcctaattagctcattatttcatttgaacgagacattggcttctgccctacatcacccatacgagacattggccttatacgaggcgtacttcgcttgcgggaaaaaaaatttcttttgtaagcgaggttactcagaaactgtgactgaaggcagaggttggaaacgtgtgtagactccaaatggaacgataggaacgtgtaccctaccgcttctgcacacgtttcttagatatgcgtgccttaaggcgacccattgttcctgtttaccatgatttctgtaggcttttttttagaaggccctagaatggattgcagatttccgtctgagaaggcagtatacgtacatatgaatatatatatacatatattctttggtggagagtataagcgtttcgtctcctcttcctttctctactgcagattttcttgctggttgtttgattttttctttttagtgttccccagatccaattgttcaaccgcccacacacaacaatgtctttcactaaaatcgctgccttattagctgttgccgctgcctccactcaattggtttctgctgaagttggacaatatgaaatcgtcgaatttgacgctattttggctgatgtcaaggccaatttggaacaatatatgtccttggcaatgaataatccagactttaccctaccatctggtgttttggatgtttaccaacatatgaccactgctactgatgattcctacaccagttatttcaccgaaatggactttgctcaaatcaccactgccatggttcaagtgccttggtactcttctagactggaacctgaaatcatcgctgctttacaaagcgcgggtatcagtattacctccttaggtcaaaccgtttccgaatctggttccgaatctgccactgcttcctcagacgcttcttctgcttctgaatcctcttcagctgcttcttcttctgcttctgaatcctcttcagctgcctcctcttctgcttctgaatcctcttcagctgcttcttcctctgcttcagaatcttcttctgctgcctcctcttctgcttctgaagctgctaagtcttctagctctgccaagtcttctggctcttctgctgcttcatctgctgcttcatctgcttcttccaaggcctcttctgcagcttcctcttctgcaaaggcctcctcttctgcagaaaaatctactaatagctcctcctctgctacctccaagaacgctggtgcagctatggacatgggcttcttctccgctggtgttggtgccgctattgccggtgccgctgctatgctcttatgattgtcacttattaatgataaattataaaatgttatatgtaaaaaaacaaatatacactttttgaatattagtatcctattttaatatactgtctcctagataatacaaacttaatttgctttctcttcacacttttttctttactcttgtaatgtacacttggctgtacattaaaaaaaggaatgttcgagcaagagcatgaaatccacagacggctgtgccatgtagcagccgtcgagaaaaaaaagatatagaaaagggaagagaaatatcattgttattacatccactggatgaagtaatactacgagctttatacaggtaatattaaagttccttaatagaatgggtgaagcactacgtagatcaaccaggattgcaatatccaaaagaatgttggaagaggaagagtccaaactggcccctatttcgacaccggaagtgcctaagaagaaaatcaagacgggtcctaaacataacgctaatcaagcagtagttcaagaggcaaataggtcatctgatgttaacgaattagagataggcgatcctattcctgatttgagtcttttaaatgaagataatgactctatctccttgaagaaaatcaccgaaaataacagagttgtggtgttttttgtgtatcccagggcaagcacgcctggttgtactagacaggcctgtggatttcgtgacaattaccaggaactcaagaaatatgctgctgtctttggactgagtgcagattctgtgacatcccagaaaaagtttcagagtaaacaaaatttgccatatcatttactaagcgatccaaagagagagtttattgggttgctaggagccaaaaaaacgccactttctggttctattagatcgcatttcatttttgttgatgggaagttaaaattcaaaagagttaagatatcaccagaagttagtgtaaatgacgccaaaaaggaggttttagaagtcgctgaaaagtttaaagaagaatgaagtttaataaccccctttttgtttctctagaggagtacttatcggtaaaatattccaaacccttccctttatatatgtagataaacgaagatattctaactctctcacacttataaaatatcgagcctgcagaaggtcataaatatttatatacaaatgggaaagtacttaacgatccgacttgatcaatatcaaatatcgtggcctggtttacattgagaacgggcactatttctttggacgaaatgttgcttaggcaaattttgaagtgagacattgctcgagaatttgttacgtagactaagtcagcatcgccaatgatcattaagcaattggtcgtctcagatgtgatcctgcaattatgagtcctttcaaaattagatacacactcttgggaaaactcaactaagtatttggtgtgaggaatctcttatcgatgcgtataccttgtagtcgcaaacgttataaaattttgtaattttggcgaaatggcacggattggttaaaattgtcgggctcatatgcggtagcgctaagtcctgcttggtcaagctaggaattacatggccagagggatgatattgatcatgctccgagttgtcttcaattaatgcctttatccatggttgtagaaaaactgagtctgttggctttgaatgagactccagaattactttcggcattgtttacttgttatcccgatttgtacccaggatttacagcttttaattcattatctatggtcaacttttgctgtctagtttcatatttactcgctaccgtttcaccaactgtagtcatcagttatggtaaaaaaatctccgcgacggggaattgaaccccgatctggcacgcgacaagcgcccattctgaccattaaactatcacggatttgtttctatgaaaatttcgtttatttgtatagtatatgtttttttaaaatataatgagaatctggtagaaaagtgttgataactagcagtttaaaacgtatcatttgttgaaataagtaccaactatcatccgtcgactagtactcacacaactattgagaaattcgtaagttttgtaaaactgttggataccgttgctgttgaaggctatagtaataggcatacaaaattagcggaagtttaccttggaaatatatccacaaaagggaaacgatatttcctcataataatattgtaatttctttttctttttatatgtttcattatcctatacattaccaatacttgcatttgagcattcattaaatctgatgggtacatctcaatctttctgtcatctttttatagcatatatggtaacatgctagtagtatgaatactagtcgatatacgtaaataaattttcattttaaaatggatatgcctaatctgatagattctattagctgatttttctactacttttcatgttcgtttttcaataatttgcaagttatatatctttgcctccgctataccgtgatgaaggttaatgcgtaagttgcaggcgaggcatgatatggaccacaacccagttcgaacataaagaactgaaaaaccatgagctgtttgattaattcaaaacagctgctcacaatttggcccaagttcaaacctttgtctttgaagcatggaacgtgccgttattttcatgctagtgtaatttttgcctgtttcatccctcccatcaaaaaattcatcacgaagtgctaaaggaaaacaaaaaaaatatcaaagagaggagacggcttaaaagcccttattcaattgaagaaatcccctgacctctgcaaaaaatctatcgtttattttatttctttgtcttacgtaacaaatttattttctgggatgatgtcaattctatttggcacgcgagtcatcgtctatataaggaggtaacgaggtccttgtatatttgatgatcctcactatcaacacgtcgagggacggttggtgacgaactcaacttatgttatagttttggaccactcttttccttgaaaaattacaggcattatacgcagtcctggggcaggagcgcttcgatcattagcataacaggatcacggttatcacctgttttgttataattcatggcctttaggtcatgacgtaaaataatcggagtgaaaaaatgaaatcaaaggctatcatttttaggggaactaaagcacaaggatttgaaggcgtagtgaaataatgaataatagataatctatggaccgaacacagacgtatttaaagacaatacaaggccattaattcccttcggagggctcccgatgggaggattcttagcatgctctttctagccaacagtatcactttcatcagaaaacggaagcctccaaaaagctacgctaaacgcttttttgttttggattatcgcagaaaattggtgacattcttgattaagaataaacggtgactagcaagaaaaggacatgtcaggtaccagtaaagtccgatttaagatcaaatcagcgcctttaaagaatcttgagatcttagtaatcccgatggaaggaaagaggtaaacaaacgaataacttaacccttaagatgattctatacatagcatgatctatccaaggaacgaccgacgcccttaaaagggttctgctcagatttcgttaaatacccggaccatcgtagatgattgtttttactctcccctaacgatgtactatgccataataagcattttttttttctttcttcactgcagctctgctttgaaaacactacatctaaggcgctgacgccaacgcccagactaaatcatcatataatatcaaacgcccaacaaaatattagaaatagctcaacaatagagcgccaaaagtttaccggaacgaaccatcattgtttacaggcaagcacccatttggaagggtacgtaaactaaataaataagacaagaaattttttttatatctggaatttcctttgcattttagtgatcccaccattacagataactaaaccaggataaaaaacaaaaataatgacattaatgataccttaactaacgtatagcaagcgaagcaaccacccatcagatttttgtccccgtttggaaactggaatgctatgaccacttttatcactacagctaaccacttgtcggaatgaagatacgaaagagaaatctttattggaccactttttctttcgctagaggtcctacctagcgtattgcacccaagtgattattgcgacctctgagtgtcagaaacttacgaagtaaaattcatagttgtgcctttcgtcaagaatcggaaagcgtaaaaataggctacggtctttgtcaaggcgaaattttggagatttcagacgcatgataccagcagtttttggtaatatactttttcaggtaaaagctttctacggccactgaaagtaatgcagaagcttaaggctacagatgaaatggccgacccaaactaaccaagcacaacatcaattacagaaccgacaatcgaaaatcctaaaaaaaaagaacatcgagtgaacttttcgttatctcaaagctttaaagttaaaagtggcagaagccttggctattctgtttctctcttagattctcgcacgacagcatcgagcgaagttgcaaaaccatatatttcagttctctaaacgatctttccccgaactccaatcgaaatagacttaacccgcaacataactgacattcttcctctttttttttttttttttttttttttgctatttgctttctgcatgcataaaagcgagactagcgtattaacactttatcactttccctctcttcctgaagctgacatgagcatacatcaatgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttagagagaagcttattaccttccccttccatctatgcacggtgtctcgtacttccatagagcaccgattagtgaatactaaaactatgtgcgtgataaatggttctcttttacagatgcggtaaatcaattattgatatactacataacatacaaacatgtttcatttccgtaatacaaattacaattgtataattaaaaaatataaaaaacttcgtgatatgaaatcacattttgctattgagtttgccacatgagcggtatacgaactattcgttattttatgactttaaaagccataccgaaagtaggcttgagaagtatgactactgtaggagtgaccactactgttaaatgcagatagccgtcttatgctcttcccttgttcttctgaattgggaatgcatagcttgaaacatcaatcttaataaggtcttgtttgtttctgcttggctttcatagtagcaaatagtttcgaccttaatgtaagaaataaaagcaatcgttaatttgagtaaagataaccactcttcctcttctactatcaatataataagaataacgcttatggtttattttagcttttttgaaagctaaacattaaaaaagaataaaaatgcacggcatacctacatattttaaaaacatatattttatgattgactttagcaaaagttggcgctgggtactttgagactctttcctacaaaacgttaccaacacttgctagtctaatctaatctacttaatcaaggttttagtggcgtaccatgtgacggccatcaaatgccatcagttctacaagttcacatatatttatatataactattctcctaacttgtataatattataccgagacagaggatagattcaattgatttcacataccggattatgttccttcccaagttctcaatcttatttagacttttttttttaattacattgtcgcccacttcggcagaaaaaatataacgacaaagtaatggcatcgcatcgacctaatgaaatactactggcagacggtatggagagctcaaaaattcccaaagcagaaaacaatactgatttctgatactaaaacgagataggttaatagcaaaatcgggatggtaaacgtgaaagtggagtttctaggtggacttgatgctatttttggaaaacaaagagtacataaaattaagatggacaaagaagatcctgtcacagtgggcgatttgattgaccacattgtatctactatgatcaataaccctaatgacgttagtatcttcatcgaagatgattctataagacccggtatcatcacattaatcaacgacaccgattgggagctcgaaggcgaaaaagactacatattggaagacggtgacatcatctcttttacttcaacattacatggtggttaaaaatagcagcaaataatttttaagaagcagctacatatatatatataaagtgctgtacagcttgaatgaatcacaagttagataacgtaggtaatatgcagatagtataaaaagtaatagtaataactggattggttttttttagtacatgacgaagattatagctcttgtatcctacaacccaaaagacctctaccattccagtttctcgaaggtgttagcgatgtctttaggatttgcccttctctcaagagaaggacgggaagtggcctgtcttcatttttcattacaaccatctgaatgttttgaagtttagagtggtttgccgcatgcacattaccaatagaaatcagcttatcatcaacctttatgtctgctttatctgaagggctaccgggtactacctcactgataaatgcaaaagggatggtatactgaatagcttgatcgtcgttattccttcttgcatcttggtttgacttaacgttcatattatcaaagtgctggtttagtaagacgtgtgatctttgcaaaaggtgatttaaatcattcttcagcatattaacattctttctgatcatagtgacttgcaatacatcgacatccgaacgaggatacccgtctggcgtcaccaacgcagagtccatgccgatgccttgctgctcaagcacactgaaatacgcctctagttgtgtctcaatatctgtctttagaaccatcaattccgacagtttgaagctgtctatttgactaattcttgatgttaggctcggatctatcttaacattggccaacaatttacttaattcttcttcctccattgtagttcgttcttattctaattcttgctcctttttactctggtgataacttttctatctctcaatgctgaacattttttttccctttattatccaatattccaaccgttataaagtaagccttatcgaacacaatccacggcgcacgcaagggacagcaaatttcgagaattaatgaatagccagtagtaagatccgtattgataaaggtcatagatcccaacctttatgtgagccagcccgaagggccctttaaatgactctcataatatggtccaatagcaccaatttctaggggttacccaccggcctagtgcttaatcgaattctgaaaagaatctctactacagactgccaaccgtaatagtagtgagatcaacactgaaggcagcagtctttagcacaatgacacagactgataatcctgtccccaactgcggtttactgcccgagcagcagtattgctctgcagaccatgaagagccactgttgttgcatgaagaacaattgatattccctgatcattcctcccaactgtcctcagcagatatcatcgagcccatcaagatgaacagcagtactgagtcaattatagggacaacgctgcgaaagaaatgggtaccactatcctcaactcagatcacagctctttccggcgcatttgctggattcttatcaggtgtggcagtatgtcccctcgatgttgccaaaacgcgattgcaagcacaaggactacaaactaggttcgagaacccctactatagggggataatggggacattaagtactatagtaagagacgaaggcccgcggggcctctacaaagggctggtaccgattgtcctgggctacttcccaacctggatgatatacttctccgtgtatgaattcagcaaaaagttctttcacggcatcttcccacagtttgattttgttgctcagtcatgtgctgcaatcacggcaggcgctgcatctaccaccttgaccaacccaatctgggttgtgaagacaagacttatgctgcaatcaaacctcggtgagcaccccacacattacaaaggcactttcgatgcattcagaaagctattttatcaggaagggtttaaagcattatatgcggggctggtcccctcattattagggctatttcatgtggctatccatttccctatatacgaagatttgaaggtaagatttcactgctattctcgggagaacaacaccaactccatcaacttgcaacggttgatcatggcatcgtccgtctctaagatgattgcatcagcagtaacatatccgcacgaaattttacgaaccagaatgcaactgaaatcagatataccagattccattcaacgacgtctgttccccctcattaaagcaacttatgcacaagagggactaaagggattttattctggatttactactaacctagtacgaaccattccggcctcggcaatcactctagtgtcctttgagtatttcagaaaccgcctagaaaatattagcactatggtaatttaaagccttaaaattcacacacgccacacattgagtgtgctatgaatatgcctgcgctaatattttaggtattacagcttgtaaatataccaaataaggtaagcctctcttttcctaatactaaaaggatttgcatcgaacagcccaccaaatgctttgcgcacacattatatacacccacatgattctatagacaaaatatacttatacattttcatagtcttgacaatattctacattggccgttttcttggcactattttagcttatccttaccaaaatagtctcttttttaaatactatttttgaagcggaaataggtgcgaacaaatgaatggcttcaatttagtgcgataaagacgtaaagcataaaccagtgaagatcatagcactaagaaggcgcctgtactgttcctcgtgttgatactcatttccttatttattttcctcaagaaattctatccaggaaagaaaaatactatctataaaaactagctgtaaggcagcagccatgaaaatgaatctgaaaaggctcgtagttaccttcttctcatgcatcacctttctgctgaaattcactatagccgccgctgaaccaccagagggctttccagagcccttaaatccaacaaacttcaaagaagagctatctaaggggctgcatattattgacttctatagtccatactgtccgcactgcaaacatttagcacctgtttggatggaaacatgggaggagtttaaagaggagagcaaaacactgaacataacattttcacaggttaactgcatcgagagcgccgatttgtgtggagatgaaaatattgaatacttccctgaaattagactttataacccctcaggatacatcaaatcgttcactgaaacaccgaggaccaaagaatcattaattgcatttgcacgcagggagtctatggacccaaataacctcgatactgatctggattctgctaaaagtgagagccagtatctcgaaggctttgattttctcgagctgatcgctggtaaggcgactaggccacatttggtttccttctggccaacaaaagatatgaaaaatagcgatgattcactagaattcaaaaactgtgacaaatgccatgaattccaaaggacttggaagatcatttcaagacagttagccgtggatgatatcaacacgggccacgttaattgcgaatctaatccaacaatctgtgaagaactgggctttggcgacttggtgaaaataaccaaccacagagccgatagagaacccaaggtagcattagtcctacccaataaaacctcaaataatttgttcgactatcccaatggctactcagcgaagtcagatggctatgtagattttgccaggaggacttttacaaacagtaaatttcccaatataacagaaggggagctcgaaaaaaaagcaaacagagacattgattttctgcaagaaaggggacgagtaactaataatgatatccatttagttttttcatatgaccccgaaactgttgttattgaagattttgacattttggagtatttaatcgagcctttgtcaaaaattccaaacatatatttgcaccaaattgacaagaatctaataaatttgtcacgtaatctttttggaagaatgtatgaaaagatcaactacgacgccagccaaactcaaaaggtttttaacaaagaatactttactatgaatacggttacgcaactcccaacttttttcatgtttaaagatggtgatcccatatcctatgttttccccggatactccacaacagaaatgagaaatattgatgccattatggattgggtaaaaaagtattctaatcccttagttaccgaagttgactcttctaatttgaaaaaattaatttccttccaaaccaagagctacagtgatttagcaattcagttaataagtagcactgaccacaaacatatcaaaggaagcaacaagcttattaaaaacttgctcctcgcaagttgggagtatgaacatattcggatggaaaataacttcgaagaaattaatgagagaagggcaaggaaagcagacgggatcaagaaaataaaggaaaaaaaggctccggctaacaaaattgttgataaaatgcgtgaagagattccccatatggatcaaaaaaaattgttattaggatatttagatatttcaaaggagaagaatttttttagaaaatatggtattactggagaatataaaattggtgatgtgattatcattgataaatcaaataattactactacaataaagataattttggcaactccttgacttctaacaaccctcaattgctgagagaagcattcgtgtccttaaatattccatcaaaagctctatacagctctaagttgaaggggagattgataaattctccattccataatgtcctcagtttcctagacataatccacgggaacggcatgcccggttacttaattgttattgttttgtttatcgcaatactcaaaggtccatctatttacagaagatacaaagtaaggaaacactatagggcgaaaaggaacgctgtcggtatcctaggaaatatggagaaaaaaaaaaatcaagattaaacgcttaagtagttataaaaataaaagaatgctgatatcttatgatgctatcataactatcctttatttcacgtatcaatatctacaatcatctaacaaacgtcgctcttattttgtcacttaggtttaatgtacaatatgcaaatatttatgtaatccatacccaaaaaaatagcacgcctaccataaaaaatattattaaccatgtttttatactgatcccagatcttctggccatctccatcatgtttccaaaagtccttttgagttttacagaagtgttatggaaagtatcaccaagctggtcaatagtttgattgctgcctctaatctcatcacccatcttcaacgataatgacttgagtgcttttattctctgacccatagctcccatctgttcctcactttgagattcaagagatgccaaagtactttgggagtagtctaatttatctgtgctccctagcgctgatgatacattgtcatcgagactatttgatccatcagccggtccgaataactgtgttctaccagtatcacgttgataagcgtttccccctgcaaatctatatacacacgctatagttagtaaacgaagttcactcgtggtcaataactcccaatatcgaggtgttatggtagatgtttaacaaaaagcgctactctaactttagaatagtctaataatttctcataccttgaactcatctgtgtagcctagtgttgtgaggctcttcaatcacattttctaacacattcacagtctcaagtgaactactgtttgttttctaccattccttggcaaaaggcgcgagttgaaaaaactccatttttaacaactactggatactttcgcaatttaaaattaatggaagaaagagccgtgaacgttcctacgtagcttgcaacaacggtagagtagtatccgccaattagcatgcataaatttcatctgagatagtgcaacattataaaaaatcactaatactttccctgatatgtcgccccttcaaattttttgcacgccacatcgataagagtgaaacatatccctgaacagtaacctagaatgtacagaaataactggaaatacaattacaaagcgataattacgggatctttggttcctatcacagagtaaacaccatgggtttattagatattatttggaagaatcacattagacggctcatcgcgcaagtaatagcaaaatggaaagaaatcggaaggcttcattagtcatgaacgttttacaccatcaaaatgaaaactatacacatgcgtcgaggagcacccaaaactaatacgactattacaattaagcatggaggaacaggagataggcgttcctgcggcctctttggcaggaataaaacatatcatattgatcctttccggaaaaggtggtgtcggtaaaagttcggtaacgacacagactgcgctgactctttgcagtatgggcttcaaagttggagttttagatattgatttaacagggccatccttaccgaggatgtttggcctagagaacgaatctatatatcaaggtcctgaaggttggcaacctgtgaaagtggagacaaactctactggctctcttagtgtaatatcattggggtttctactaggtgatagagggaacagcgtgatatggaggggtcctaagaagacttctatgataaaacaattcatctctgacgtcgcctggggtgaactggattacttactgatcgatacccctccgggaacgtcggatgaacatatatcgattgcagaggagctgagatattccaaaccagatggtggtattgtagtaactaccccacagagtgttgcaacagctgatgtcaaaaaagaaatcaatttctgcaagaaggtcgatttaaagatcctcggtataattgaaaacatgtcagggtttgtatgcccgcattgtgctgagtgtacaaatatcttttccagtgggggtggtaaaagattatcggagcaattttctgtcccataccttggtaacgttcctatagatccaaaatttgtagaaatgattgagaatcaagtttcaagtaaaaaaacgcttgtagaaatgtacagagaatcatctctttgtcccatttttgaagaaataatgaagaaactgaggaaacaagacactacaacccctgttgtggataaacacgagcaaccccagatagaatctccaaaataagatcctctcctatgcatgtacgtatatatatatatatgtgtgtgtgtgtgtttatatacacttatattttgatccttgggcctagaaataaatttcgattcctatttcgattcctatatcgaaaggtggttagaagctaaccggcaactgcagcatgttcttcaagtggtgatacaaatttaaaaggccgggtaaatattgacaaagaaataatatttaatcacacaattttgagaaagagcaactgaatcaattactctagagaaatcgcagaacacttcactcgtcgtcaataatatgactcgtgatacacccgaagatgtcagtactgcaggcgcaaaggatattttagatgttttgaacctactaaaaggaggagaagagaaaatctcggaagtcgaacttaagttggatgaaatggaaaagaaaatggactctctgttagttcagttagaagatctacacagggacaacaatgatttggcaaaaagttccagccaaaaatagagagtacgctcacagccgcatagggaaggaacgctaaataaatatatttatatataatcttttcactaatgatcatttacttacctttctataaaaagtggctcatcttcgttctcaacgaatggattgggatctcttttaggattaatcatgtaaacggccgggtctacgtcaagaactactttaacttgcttcccacttccaatccaccatttttttaaatccgaactaggtggtggtaactttctacctcttttgggctcgggaattggtgtcggagaatgcgtagggccagctatcgaatcactgccctcaaaactttcgataacaaatgcatcatcactcaaaactgcaattttctcatcatcatccaatccctctagcctttccataatcttctcgtagatttgcgtacccaaagtagtctttttttgttcatccactacagtcactctagccctaaatatggcatatacgggccgatgatcggaaaatagtatatcttcacagcatttatattctaactgttctagtacttctcccctacttaaaatcctatcagtccatgctggtattctcattttttcgctcgtgtcgtagtttttagttcctgggtcgaatttataggtaggtgggaaatcaatcgccatttcatggaaatatggaaaagactcacctgcgatcatttgttgattaagttgatccttttcaaataggctggcatattctttagaaacaatttttcgtctaacatcttcgtttgacatcaatattctgtaattgaaatcgcccatccaaataattgcatcgtgatcctttattcgtaatcctttagaaaatcgtatgcttttcgcaatcgtcttataatcattatgcctttgttcaacattttctaagcctgccgctaaatgagatactagtacgcaaaatcttgtagctgagtatttaaaactaaccgcgacagctcctttattagaagccattcctccaaacccggtttttttaacatccccctcaatatgctttaccttggaatattccgtttcattcatgaataataatagtaaaataccacccaactgtgtactccataaacggatatatttttttttgcgtccgggcccatttaatagtgttaatatcttcttctcccaaaattgtcggacatatggatcggtagcaagcatatgacctggggtaagttctaccacttcttctaatccgataacataaagatcagccatttcatcctccttggacattgattttggaaatatccaatcttttatatcatcttttggaattttaccacttatattaaatgtacctgcaaaaattgagatgtctttctcaaacgtatattttgaccttaattgctttaaatactgagagatgtagatatggagcgggtcgtataatctaactcgggaaccaaataacttcgaataaacctttgtatatttaccagaattcttcgtgtgcttagtatacgttcgatcaagccagtaatagttttctgaccatagcttatcatgtgcgtccaagaatggggaagtcaattcaaatacatcaatttcatttgtggttaattcaagtacctccttgctcactaacctttcaactgtgttaggtttttcaattgaatcaaatgcgcttattcttaatacccccgtttgttttgcaaagtagatgcccctagagatatcataggcaaacgctccaaactcgtaaatatcctgttttaataaataaagtaatttgtggggagactttgtcagaacgcttgagctgtattctatatttgttatttttattccctttgattcagcacaatccttgtacgtcagtgctaacttttcttgtgattcgcttttaggttttatgatattaacgatactcacaacaccatactttgaggttaaattatcaaaatgcctgtcaaaagctccctgagcttcaatagaatcttttgttaccttaattttttttccatacaacagttgactttctacagattcccaaaaaagaggaatgcttccgttcacttgagtataagaaaaaataaacttttctgtggttactacaatttctgtctcaacaaatagcgacactctcccatcttcactaataccctccaattctagcgtatcctgcttgctctcagtcgaaattctggaaataatggttatagaggctgtatttgggccgtcttctattaatgctgtcttgcaataaccccgaattacaaatgttaagaaccctgcgttggcaaaaagttgtttctcctcatttgaaatcttgcttctccagttgattacctcacttgctaagttagcattccaaataaatgataaatcttgattatctacggtatattctaagttatgtgataaaccatggtttttcacgatattagagatgtcgaaatctctagaatagtagaatgttccatcactaaacagttttttcagggggccgcaaggatgctcatgaatcaatttatcatagttttgctctgatctctcgcagaggaggtagtcgaaaacatcattttctaagctgtaaaagtcaacatccaatactttataaatgctctccgaaggcctaacttgatgatctatcagtttccatcgaggaaacccaacattctgaacaccagatatgacggcaacatatatatcaccattaagacaaacgagccctaataatccattaaatatgcaacttttgacttcgagatagttactatcacttgaaagatctgtgtcagggtaggacttgattgttacgctaggagttttacttaattgacgctgctgagaactggcacctggtatgctgcgcaaacgctggaaggataaacagtagttgttggaagatattacaatcgaccgtgatcttctaccgatgaagagtctcattgtagtgaaatgtgcttcgaattcatacgattaacacaactttatcaatatttgctgacttaatcctagaatgaaatagaaaggctatttgatttgtgtagatatttgttccaactttccggtttacaaatgtttaacaaagggattcgtttagcaattaggcaatgctaaacaagaaggaaaacaggaaaccctgaaggagataaaacgacgtcaagaatagaagataaaaaaaaagggacattaacaggttatattgaaactcaattcctgcctaaccttctaaattgagaatttagaaacggtatcgcttattctgaattcctaaaacacccatcccttttaagtaaaataataatacgtggactacgtagatgtggacactcaatttacttactattctctatggtcatattgacaataaacaaaaatacaagaaaaaaaaaactacaggaaagatttgtcataaattgtacactaccacttgaaaacgacctttggcatatttatggcagataaattaatggacaaaaattttgaagaactgtgctattcatgccgcactggtgatatggacaatgttgatagattgatttccacgggagtaaatgtgaatagtgttgacaagtttgacaattcgccactttttctggctagcctttgcgggcatgaagcagtcgtgaaacttcttctacagagaggagccgtctgtgatagagacagatatgaaggagctcgatgtatttatggagcattgaccgatactatcagagatacccttttaagttatgatatatccaaggctgtagatgtcaagcaaccctttgctactcatatctcatcgatgtataatgacgaaggcttccttaaaagagatatcacattcagagtttcgaatggaaaactgttcacagcgcataagttcttattatgtgcaaggagcgaaattctagcagaaaaaatggtgaatgagtgggcaaagcatgaaattgtttctcttgaagtgcgcccagatatatttgacatatttttgaaatttctttacttaattccgatcctgcaccaaattgaaccgggacaatatgaagaacttatagagctatctagtaaatttgatattgagttattgcccgaatttttagacaaagcaaggcataccgccgatcctacggaaaagtcgaggttaatgtcagattaccaatataagtttaccgaggttgcaagaagtcaacttttaatatttgtgaacaattgtatctttagatctactgttgatcttgctaatagtgaacgacgagttttttccttgatgaactgtccagcttatccggatgttcaacttatggtaaaaaaccgaaatggagccattcgaatatacccttgtcacctggctgttttgagccgcgcagaatatttcaaggtgatgttcacaaacaacttcaaggagaaagttacatatatcaaagccaagcacgttacaggaaagtataatagtatcattccacagctgacattacccaattgtgagtttgaggttgccgaaattattctccgctacttatatgcagataatacagacattccttggatgtatgccgtcgatgttttgttacttgccgatatacttttagaagaccgcttaaaaactatcgcttctacaattataacacaatcaaaagagtttattcagcaatacaatgtttttgacgtactctatttatcatgggaaataggagtggaacgcttagaacaatttgcagctaaatttatagctatacatttgcaagagttatataaagatccagagattaaaagggcaattatgttgagttcacaacgaatttctctccgccaggaaactgatactattgaactagtggatgacattaggtactatttgctccgaaaatattcttttgaaccggatgatgtggagctgttcgaaaaccaagacgatttagaatacctaaaacaagtagggtatttggagtacagaaaagatatgggtatgttagataatatcctagctgatctggaacttgatgtataattccgcattcaataaccttatgtatttttacgcgtcactgcgaacggatgaatattgccaatgactgctgcgcactcttaaaaaatataatgacaattataataagaagtatgatactttttctgtaaaaaatatatatacatatgattcacgtgaaaatttttatatttttaattaaatttttataatattataaattattataatattgatatttaaaattaaaaacaaattattaatggttttgttttccgaaatgttttttataattattacttcagaatagttattttcacgaatacgagatacagggtaatgaaaacaggtgttatccaaaaaaaaaaattgatatattttagatactttacatacagaggcaagcttcagctgtagccaggtacataatattccctataaagtgatcaatattttttaacgaaaaattaaaaaaaaaaatccttgaataaaggaatgaaaatattgtaacaagcgatgacatttctttttttgattgtagttgtggcattttatatttgcttttgcatttaccctattcttgaaggtttggatagacaagcgagataacaccagttgtccttcaacttattcaaagcagcagctcacttaattattattaagtatacacatgaaagccttgtgtttatttcgaatctttttcttgggtagaacttttaacgttgtcagacggcatgacaacaggtttttgggaagtagatctaatattttttgtagagtctttggcactgttgaagtgttttttttggaaggttctattcttgttattgtaaggactcctataataattgttcttattatatccgaaattttgatttggagactgatttggagggtacggtgggtaataagggaaggtatcgggattggggtaggccattaagggataattccattgccattgttggaaatactggttttgcgagttgtaatgcctattaaatcctggaatgttagttctttttctggagacagcaatttttttgcctttaagttctcctccatttaattgcagggctttttctctgtatgccggactttcaaattcaatatagccgtagccttttggtgttcccgtattcctatcataaagaagtgttattctttttatctggccacagtctttgaaatgatcttctatttgctctggggtgacatccggagtgatgttaccgacaaagatagaacgcgagtcagcttcaagttgatgagcgtgtttttcctccttgcttagcttttgcgacacctgtggagtgccctcgatagatagtttacccacaagttcatccagctcgagctcttgcttgtcgttctttttattgttcgaaatttcagtctttaaggttgccttagcatccactttctcttcctgggacataacagcaattgcaaatgatgacactatgtgacagcagatatatgtttatgttaataggcctggttggagagcgaaagttgagattacttacttaatcaaaattaaatttgaaatttgctgcattttaaggttacttttcggagtgtaggaaattgttgcggttttttttcacctaacgaatgattgataatctttttcatatcctccaagaaacaagctgtttattatggtgattgccacaaattgaagcgctatgcttagtgcttcatgacagaaaggttttgcattggtaggcgtggaagattacagattgtactcgtcgttggctcaatttttatattttgttgcttcaaaaacagtgccgtatccttaatgaatgaaaaattctaaagaaaataagttgatactaaaaatataatgtccttgaagtatttatgcgatatatagaaaaatctataaatacttaaatattacagcagcgttatttttgtatagacgccgacgtataagagtctcctatcaaaaatcagaatctgagcccagtatgtcatctaattctgcgttcgataaggtaaaagattgggatgaatcatggttgacactgttgttatcgacttgacttttatcgttaacttttacaaattttttttcgtctcgtaacatgcctctcgccaaacatttagtatagttcatatcaattgtcctcttcttattatcattactctcgtcgttaaataacgtaatgatttttgaaactttgtgacaatgcggaacttttacccctttggtgtattgtacaaaattgggctccacatcgaaggaaacaccttctgggatatagcggtttctgaaaaaattccaatcgtccaaactcaataccatgttattcttgtcaacagtacagctcttttctttttcaaggttgtgttgatttcctcggatgtctttcacatttttctcgattttagttggaagaccacaatcattcacaaataaagccatattagggcgttcaaaattatgaagtggcttgagtgtggtaagactttcgccagtgcgaataatggcagtttccaaatctttttggcatccattctgcccttccgcaatgaaaacattattatcatcactgacttcttcatcttcagtttctaatgaggaggaagcttcctcggttgaatcattctccagattatccaaagctttaaaaatcttccgcttcttacttgggttttcattactcgttactagttgtttcccgccactttcattcaccaagaacttattaattaaagtgcttgcactaacaatactggtctcaacattatcaggcataaagaacttcttcggttttttattttcctgaactctcttcttctttgttatggctttttttggcttcacctttttgcccatcatacactgagtcgcataacgaataacttcgtcaacatcttccatttcattaattatttcgttttcatcattaatcgtgatcaatgtctcgtgacattccggaataatgtcttcagggattatccgatctgattttttatagtcaatgcattgcttggatataagcgcttgcagggttgaatagtcttccatagcacgctcgaatttgtatgattcattactgctaaacagtagtactatcttaccatctcgttttctgcctgttctacccatacgctgaatatttttgattggactacttgtagtatcataacagattattaaatcaacttctccgatatccaaaccttcttctccaattgatgtacaaacgagaacattatattcaccctttttgaaattatggataacctctttttgcattttttggttcattccgctaatctgagcctcttcagagctccccgttcgtctggcacttctttcaagtttatcattcgccgctctcttagttcgttcagcttccaaaaatttctcttgctcttgcctatgcaatctctctaccttcttccttccctttggcgcatgttttcttgtgtatttgacctcatcaaaaccttcttttgcacgagcttgtccaataaaaatatgaggcctgatttgatcgtcagctaccgagtctatgaacttcacaatttcaagtgcgctttctcttaattctgtaaaaataataaccctcgagtcggaaccccttttctgaaaaaagtccattagttcatctctaacacattgtaacttcccatgaccgacaaactttggatcacttaaataattttcgcattgatttttgatgtttttcaaaatcggatggtaataaaactcagctgcaattttattagtagattttttaagattatatttcgtagtgaattctgtacatttattctggaagtaattgaaaaatgtccttattccataaatttttaatctctttagcatttgacccacattgttcaataactgtaaaataaagaagttcctccacttaattccttcaggtatagtagggttagcaataattttttggctttgttgcatggctttgaaggcgtttatttgtgaagggtcacattcctcatatataccgagttcaattgcctgttgaagcactggtttgacggccatacctaattgttcgattatgtcttcaatttccaacaaaaggggcacttcaattttttccttttttcttttcttcatatatttcacgatatccatgctttcttcagtcctaatttcaatcttggaaatatctaagttattaaccacttcttggacaccttccaggtcagaggctggtgtagcggtcaatgctaataatctgtatgatgaattgaacctatctatgaattttaccacatttgtatacgcagaggagccagtagctctgtgagcttcatcgatgacaagacatacaatatccttaggatccaatacacccctcttcaagtcattctccactacttgcggtgtggcaaagaaaactctcttattggcccaaatttcttctctatttttcctgcttttatcgagtaatatagcagtttgatccgaaggtattcctgttatacctaagcatgccttaatttgctgggctaccaaaggtcttgttggagcagtaaagattattttggcttttttggtccaacgaaaataatttaacattactgtactggcaatgaacgttttacccatacccgttgggatggcgcataacgtattttgaaacagtgatttgtgaacaattgtatactgataatcccttacctcgtaatttgtagggtacacgtagaacgacaaagcatcgtaatcaagctcatgatgagtgggtccaaaactgacatctctttgaatttcttcgtacacagttttctgcccaggtaaaacgttatcatgaaggtctttttgaactggtacagcacgtctcgttatagtttccttcacagatttattgatagccttttcatacagtttatccagctcgtcatcttcgaaatcactaaagtaatcatctgcactagccatcagagagaaaaaaggacactaaaataaaacagaaccggaatgtgttgaataaaactgaagtgagctactatatcttgaatcacaatatcttagctccgtgatagagcatagggcacctctattgatctcttcgtgatgcccggttatatacacacgtaaccccgtaaaagccgttacccggtttatgtctttctgtgagcacagtaagctaggaaggtcgatggagaagaagactcctgtctcatatggaacaaccttgcaaattgagtgcaattatcccctttggagtttgaattttgtgttagtacattctccttttttaacttgtcttttctaccacatgcacaatgaaagcaatcttgttttaccaggcgcgaagcaaaagaaaaggagaaatattgagtatattttaatttaagctttctgatttagaaagtatcatgttttgttggtgatctaacaggaaatctattttgaccgattatacaatgccatcggaagttacgccaaaagtacctgagaggccctcaaggaggaagacatctgagctgtttccgttatccggctctgaatcaggagatattaaagctaatagcgagccaccaacaccagcaggaacgcccaatgtaccaacacgtagacccatacttaaagcaaagacgatgacttcgtttgagagtggtatggatcaagagagtttgcccaaggtaccattgcagaggccagttagacgctccactactgaagaactaaataatgtaatgaataacaccagtaaggagttagaggagattgaaagtttgatttcaaagcacaatatacacaatgtttccaggaaaaaaagtccaacttctgtggaagagggaaaggtggccgccattcatcaaaacgggcaaagaagtgcatcagataacaaaacttctacaaatccctccccactcgaaaaaaatgagcacgagggtgctgagggcaatgagtctgctatttcaccttctaatttagttaacaagtctaataatgaagtgacagagcatagtgactccgaagaccttactgaaaagcaaaaggtacatgctgccctagataatgaggcaggggatagaagccattttgaagaaaagctcattcctggagatatgaaagtacaggtagatgttagtaaggacgtagaagaaggcagcctcaatgctctgcctccatctggaatcacagaatcagacgacaaagctgaaaagttcactaaacatcctgaatctagtttagaagagctacagaagcatcaagaacaacaggaagaaaaaattttccaaaatccaaccgatgaagaaagtactacctctttgaatgagaaacaagaaggcaaggacaacatggaagtgaattctcagccgcaaggaccttctgatactgaaacagttatagcagcaactagctcaaacgttccttcacaaattgcaagtgaagaggaaaatgacgttccagtgattccaaggagtaggcctaagaaggattttgaagcacacgtacaaaaagaggagttgcctaacacacaagagaagcgagtatcagaagagtgtgattcgaccctaattagtaccgaagaggaaagtaaaatcccaaaaattccctctgaaagaccaaagagacgtgccccacctccggttcccaaaaaaccttcttcaagaattgcggcctttcaagaaatgttacaaaaacaacagcaacaagatctgcataataatggtaattcttcagctactaccgcttcagcagatattgctaaaaaacacacagattcttctattactagcgataccacgaaggcagattttacgagcaaattgaatggactgtttgcgctacctggtatggtgaaccctggacagcttccaccttccttggagaagaagttgtcctccccggatactgaatctaagctaggaccccaggaccaatcacaggcaaaaacgggacctctgggcggaactagaagaggtagaggacctcgtgggcgtaaattaccttctaaagtagctagcgtagagaagattgaagaagatgacaacactaataaaatagaaatatttaacaattggaatgtttcctcttccttctctaaggaaaaagtcttaatagatactactcctggtgagcaagcagaaagggccttggatgaaaagtcaaagagcattcccgaggaacaacgagaacaatctccaaataagatggaggctgctctttgtccttttgagctggacgaaaaggaaaagttacctgctaatgctgagtcggatcctctttctcagttgccacagacgaacgccgtaggtaatagaaaagccataagtgaggaatctctgtccccatcggaggccatcgccaacagagatcaaaacgatacgacagaaatacaggaacagcagatggaggaccaaatggaggttgatatggaaagagaactctcaggtggctacgaagacgttgattctgccttacattcagaagaagcgtcttttcactccctttagaatcttataaataatatgtatgaataaactctatagtatgtatcaagagagaaatatgtgaatgacgagcaaactagaggtgttattaataataatggcataaaaactagattttattctatatatatatatatatatttcttcgactttttttttttttacccgcacaccctgaattttgtgctattttgaagcagagcgtactgaacaaattggcagatttacaagaggaataacagagttatgctaaatcattaagtgtttcttgcggccagaaggggcattatacaaaagatatggttgttgatactgagtattacgatttgttaggtgtgtctaccactgcatcttccattgaaataaaaaaggcctatagaaagaaatctattcaagagcatcctgataagaatcccaatgaccccacggctaccgaaaggtttcaagcaatatccgaagcttatcaagttttaggtgacgatgatcttcgcgcaaagtatgataagtatggaagaaaagaagctattcctcagggcggctttgaagatgcagctgaacagttctctgtcatctttggtggagatgcgtttgcctcatatattggcgaactgatgctattaaagaacctacagaaaactgaggagctaaatgctgaagacgaagctgaaaaggagaaggagaatgtggaaacaatggaagaatcacctgcagacggtaagacgaatggcaccactaacgctgttgatgcagcattgggcaatactaacgaaaaagatgacaaaaataaggcgaggacaacttctggtaatttaactgtacacgatggaaacaagaaaaatgagcaggtaggagcagaagctaagaagaagaagacaaaattagagcagtttgaggaagaacaagaggtagaaaagcaaaaaagagtagaccaattaagcaaaacattgattgaaagattatcgatattaacagaaagtgtctatgatgatgcatgtaaagattcctttaaaaaaaagttcgaagaggaagccaatcttttaaagatggaatcatttggtctggacatattacacacaataggcgacgtttactacgaaaaagctgaaatttttcttgcatcccagaacctgttcggaatgggtggtatatttcattctatgaaggctaaagggggagtatttatggatacactaagaactgtttcggcagccatagacgctcagaatactatgaaggagcttgaaaaaatgaaagaagctagcacgaataatgagcctttgtttgacaaagacggaaatgagcaaattaagccaaccactgaggaactggcgcagcaagagcagctattgatgggcaaagtattgtcggctgcttggcatggttctaaatatgaaataacatccactttacgtggcgtttgtaaaaaagtactagaagatgactcggtaagtaagaaaacgcttatcagaagagctgaagcaatgaaactattgggtgaagtctttaagaaaactttcagaaccaaagtcgaacaagaagaggcacagatctttgaagaacttgtagcagaagctacaaaaaagaagagacatacatgaagttagcaatcatctcttgtatattaaaaattcaaaaattcacttttttttattatctgtattcaatataatataatgtatataagatcacactaatactgataattctattcttgaaagaaagacaatagaacaataaagaagtgattgaactcagtgacaatgataatttatgtgataaggaagtggttatggctggagaattatgccacacttaaatgataagctcttttacctttctgggtttaggaattttttgagattaatacagataaaaaaaaataggccgaacattaattactcatacaactcaaaaagtgcagcgtgcaattctagatcaagaacatagataatataaacaaaataacaatgaacaaaattcagcaaatcaacgataaagaactacaaagtggaattcttagcccgcatcaatcatggcataatgaatataaggataatgcttatatatatatcggaaatctcaaccgagaattaacagaaggtgacatattgacagtcttttctgaatatggagtccctgtagatgtaattcttagcagggatgaaaacacaggagaatcgcaaggttttgcatatttgaaatatgaggatcaacggtcaacgattctagcagtcgataatttaaatggatttaaaattggcggtagagccctcaaaattgatcatactttttataggccaaaaaggagtttacaaaaatactatgaagctgtaaaggaagaattggatcgagatatagtttcgaagaacaatgctgagaaactcattttggctaaaaaggaccaaccaaattaaataattttttctttcatcgcatatcttatattcatatagcctagaaaaaaataatcaatatcatatttgtaattctacatcctttcagaaattagtatacatacgtatctatagaaagcaaattaaatcttcatggaaggggtgggggtggaggaatacctgcaggtggaattgatgggatacctgcagtagaaactggttgtgccccttcttcctcttcatctgtaccaactgattcaggaatcgataaaacgtcatcatcagaatcggatccatatgcgcccgtgcctttttcagcaccattgtagttatcaacgtgagcgataataggttctgaagtggaagcttgttgagttggtaaaggtgggggtggaggcaaaacgcctccagctaaagctggggtggaagaacccgatttttgcacggcagtagctattgcaggtgctgagggaattggaggttcttgaaagccatcaacagcaggcaaagggggagccaacgggacgggtggctcctgagtaacagaaggtggtatcggagctattggaataggactactcttttcattagaggtattcgcctgagggacagggacagcaggtggaacaggggtaacagacggcaagggagcagcagtaacaggtggagcacgtgcatgatcaggatgaccaatctttgcttcttcaaccttattatctacagctacgcggttattactctcgtcttcatcagaccatccatcatcctcgtcctcatccaatcctctttggattcttctttgcatttctgcagcgcgagcatcgaaagtagatgtagagctagctgatgcatccttgaagtatggattatggcccattgtcgtggaaggcagaccagtactgttcttacctgcggcaggggtaacagcagcgtgtaccgagcgaggagcattagtagaattttgcgaaaaagctgcagatggtgccactggagcggcctgaggaacgttcacatggccgccaaagttgtcttttccgtttgtctcctcttcgtcactttcattttgagcatcctcaatttgcttacgtaaagctgcaagtcttttttctttatcagccttttttttaagtttcaatcgttttagctcctcttgtaaacgcttttcttcatcatcttcatcttcatcatcggattcttgctttgcattatatacattctgaacaggttgagttggttgaacaggttgagttggctgaacaggttgagttggctgaacaggttgagttggctgaacaggttgagttggttgaacaggttgtgttgattgaacaggttgagttggttgagcgacttccacatatttttcttcttggaatggagttgctctaggttcaactaaattggaagaaccagcaatctgttgtggctgttctcgagagttttcactgctaatcgatctggaactttgagtaacatttcgcctattcttatcaaatttagctaatttttccttcattctcttttttgcctgttctttcagataagctgctctttcttcagcagttttgaactgagaataagaaggcgacgaggaacggtcatctacaggggttggtgttgaggaaggcacaaagggagatgactcagtcactgatttatttgaatttgacttcagatcatccaaaaattcacgaacaccatcttctaaccctatgccaaattcccatctttcaaattcttgattggatatcatattcgatcctgtcatagtagacttcaaggatgcagaaatatctgatatagatgaccttatgtctttaatgatttcttggttcttaccattttcctgctggattctcttgatttcagcactttgctgttcatcttccatggaaagtgaatcctccgattccgttgattttcctgttagagcagacatccttgctctcaacaaagccctactcttagctttcttcctatcattttcagttatttcaccatttggaccagatccaattatcgaagaaggatttttttttctatacaactgaatttttgcattggtaatctcattatcaattgtagaaatttcattgaataggtttggaagtttggcgatgatggcatcaaagcggcttgtcaaatctgatggaatagaactgtcataacagttttcaggattgctgatatttttgatctcattttccagtgaagcaatatttttcagatttatttctcttgaaaacccagcatattttggtttcgctgtcttcttttcaacagtcttatctaccgaaatgtcatcggtttgaagggtgctgctagaatgattaacagatttagcagatggtgaagaaaaagaagattgctcttcatttttcgcagagtaaaccttcctacgatttctatagttcggcaaaacatcatcatcattatttttgtagctcaaggcatcgattttaccaaacgaaggtttttcttttgtggtcgttggctctgtctttaattggttctttaagttgtctaaaagttttgtgctggagggaattaaacttgaaggtaggacattggggattggcttcccgtttaatttaccgtaaaccaagtgcatacctagtgcaaattcttgtttattcaattggccggtgttgtttatatcacaaaggttccaaatttgctccaaatctgcacgatttaagccagattttctaaaaatctccacagcagtgggggaatctaacaaacctttgttttgagtatcaaaagtttcaaaaattttataaaacaaagatttttcctccgtggaaattttgtcttgacttgagttatcaattaagttattattaaagttggatttggtataaatttcgttattaccaaatcctgtcttttgggcagtcaacggcatggtagcactaaagttagatggtggtagaaaacccgttggttggggttgcaacccggttaactgagattgtaatccttgttgattaaaggacaaattgggcatacttgcaggaccgctttgctggggcataacggaaccatatcctccggtatactgagattgcaaagcaccgccggtcaactgaggtcctaaattaacgccaaatgaagtctgtggcatcataccagttgtctgtggcatcataccagttgtctgtggcatcataccagttgtctgaggttgcaaagcattgccagtaatgttgggttgcatagaggcaggtgctcctccagtaatttgggggttcaatccgggagttccggtattcattgacatgttgaaagtggttggtgccataaatcctgtggattgaggattcaacgccgaggcaacaccgcctccagtaatttgagactgtaatgggataccaaaactagtttgaggcatatatcctgttggttgaggttgcaaattttgtacgcccgctgtaatgaattcatcaaagggagtttttggggcatcgtttgcggaagaatcctggtttgcaatgcttaaattaatggcgtcaataaaacttgaaacttcgttttttgtcttagaatccaattcgtaagggatagtgtcaccttgtaagacatcattgatcaaatgcattgctaatgcaaattcaggaaacagtaactcacctgcttttgatgtatcacaaagcgtccaaattcttgcgagttgagaaggtggcaaaccggatctcatcaaaattttcctacaattagcaccggaaacagtattcgaaccattggtaacaattgatctgaatagagtctcaaattttgcctgatcttgggcagtaataaacgacaatctaatggcagggattttgatatcattgtttagaccgttgttggcaaatgagttgacaaagccagttgcggtgggctttaatggttctaagggagcttggttttgcggttgaaggtaaaatcctgtttgctgcggcttcaaaggttgcaaggactgtgcttgctgaggaggtggcacctgttgaggttgagattgataataaccagtgccctgggcctgaaggggctgctgggtttgattagaagagatcaaattgggtgtagacacataatatcctgtcccttgagattgcaaaggttgtactgagtgtacatttgcagtattagcagcttggtaatagcctgttccttggggttgtatggattgtagctgaggctgttgagccggattaggtggaggcatggtgccagtagtattcatcataggcatactggaatttggtacgtatcccgtatgctgcggtttcgcctgctgttgttgctgctggggttgttggccaaaattaccattaccatatacactaccattatttccattattattgtaacccgtttggggctgctgtggcatacttgagaaagaattaccaaaactttgaggcatcccaccaattccggtagcctgaggctggttaaacgccatttgctgttgtggttgaggctggccttggggctggtttgaagactgaccttgctgctgctgcgggtagaatccatttggttgttgctgctgttgctgctgttgctgctggtaacccatgccctgttgctggtacgggttatacatattcagttgtacagattagcaatttcgcgtcgctgatagattcttcctcttcctgcttctcgacgtgtgtttcgccaatagatctatatggctttctaatgctttttttcttccaataccaacttttgcccctaacaagaaaaaaatatcgtcgacgtgtcatgtgatcaagccaatttataataacaagcgattgataaacagagtatacatagctactatgcgactgagagatcaatcggttatcgtgagcacctacctttaaggtttaacagatctggacgtgattttttttttttttttttgacgaaccagattgtcaaataaacattgttaattgatgaatttttaatatctgcccaattgaagcataaaaagcgtcttaggaaagcattcgttaaatatctctactgttggtaagcaggtacttcagtaaaaaaccatattaaacccaaaattatcaaattagtagtacataagatcgaagtagaaaaaatatagattataatccgatatagtgtaacggctatcacatcacgctttcaccgtggagaccggggttcgactccccgtatcggagtatgtttattttatttttttcatatccgctcgaatattgccttcgtttaaggtttctatatctctggtaaaccttaacaatggaattaatattaattctatatttcgcaataattctactgacagttattttcttaacctttcttctctttttttatttatttatttctttttctttcgtacctaaattgtttgaatttaataagaacagatcatatgcctgccaaaatacacatttctgcagacggtcagttttgcgataaagatggcaacgagatccaattgcgtggtgtcaatttggatccgtcagttaaaatccctgcaaagccattcctatccacccacgctcccatagaaaatgacacgtttttcgaggatgctgataaagtcagtttcatcaatcaccccttagttcttgatgatatcgaacagcatatcatcagattgaaatcactgggttacaataccattcgtttacccttcacctgggaatctcttgaacatgctggtccaggacagtacgattttgactatatggattatatcgtcgaggtactaaccaggattaacagcgtacaacaaggtatgtacatttatttggaccctcaccaagacgtctggtctaggtttagcggtggatctggagcaccgctatggaccttatactgtgcagggtttcaacctgcaaacttcctggccaccgatgctgcaatcttacataattattatattgaccccaaaacgggcagggaagttggcaaagatgaagagtcctaccctaagatggtttggcctacaaactacttcaaactggcgtgtcaaacaatgtttacgttattctttggtgggaaacaatatgctcctaagtgcacaattaatggagaaaacatacaggattacttgcaaggaaggtttaatgatgcaatcatgacactgtgcgcaagaattaaagaaaaggctcctgagttgtttgagagcaactgcattattggattagagtctatgaacgagccaaactgtggttacattggtgaaacaaatctcgatgtgattccgaaagagagaaatttgaaattgggcaaaacgccaacggcatttcaaagctttatgctgggtgaaggtattgagtgcacaatagatcaatataaaaggacattttttggattttctaagggaaaaccgtgcacaatcaatcccaaaggcaaaaaagcttggctgagtgcagaggaaagagatgcgatagatgcgaagtataattgggaaaggaaccctgaatggaaaccagacacttgcatttggaaactccatggtgtttgggagattcagaatggtaaacgccctgttttactcaaaccaaattactttagccaacctgatgcaacggtatttataaacaatcattttgttgactattacactggaatttataacaagtttagggaattcgatcaagaattgtttattataatccaaccgccggtaatgaagccaccacccaatttacaaaattctaaaatattggacaataggacgatttgtgcatgtcatttttatgatggtatgacactaatgtataagacatggaataaacgaattggcatagacacctatggactagtaaacaaaaaatactcaaatcctgcctttgctgtagtgcttggcgaaaacaatatacggaaatgcattaggaagcaattatcagaaatgcaaaaggacgctaaatccatgcttggaaaaaaagtacctgtattcttcaccgaaattggtattccatttgacatggacgacaagaaagcatatattacaaatgactattcttcacagaccgctgcattggatgctcttggatttgcattagaaggaagtaatctttcgtacaccttatggtgttattgcagtattaattcacatatatggggtgacaattggaacaatgaagatttttcgatttggtccccggatgacaaaccactctatcacgatacccgagcaaaaactcctactcctgagccatctccagcctctactgtggcttcggtatccacttctacatctaaatcgggttcttcacaaccaccaagtttcataaaaccagataatcatttagatttggatagtccctcgtgcactttaaagagcgacttgtcagggttcagagctcttgatgctataatgagaccattccccatacaaattcacggaagatttgagtttgctgagtttaacttatgtaataaatcctaccttttgaaattagttggtaaaacgacacctgaacagataactgtccctacatatatttttataccacggcaccattttacaccaagccggttgtcaattcgttcatcatcaggtcattatacctataacactgactaccaggttcttgaatggtttcacgagcctggccatcagttcattgaaatttgcgcaaaatcgaagtcaaggcccaacacccctggaagtgacacttcgaatgacttaccagcggaatgcgttatcagctaaacaaaaattgaaccaaaagctatagtagtcatatatatatatatacaccctttttattgttacaaaaagatttcaccatcagaaatctaaagaagccggttcatcatcatcttcacgttctcttttcactgaacccagttcatttttcaaaagagaactcacatatgcttggaactgattgataaaaggttgtaaagctgttaatgaaacatcattatttttctccatttctgtttgaagatcaattagcttaggtgctttttcaggtgcaaaggattcatcaataggcacacagacattccccgtagcaggatgaatacaaaaaggggcctttaacaaatgaattgtttgctttgtaacttccacatccagcttcggataaagagtcatcaatacgagatcttccttacattcacgtaacttaattatgtgagagtcttgcttggggcctttgaagagcgatgtagctatctgatctatatcattccacttctctttgcttgacctccttggattgtccagccaatacttctttaatgaatcaatcaattgtttatcatataatgcaggcaataaagtttggatagcatgttggtcatcttcccaaggattttgctcttcgagcataatgctgacaaagaaaggtttcaattgctccaaagaacgagcaagatgagggtgataaggcctcttcaaagccaatcgcttgtcagtatttctgtctctaatcacgttgacataatctaaaacgtttcttcgttgtacatccgtcaaagcccgtgcccgtttgtcgcttacccaacaatgagcaccacgtctacctgaaaatacccagatgaagtccttataaccaaaatcctctcttagggccgtgttcgtaattttcattgccaaagatataaatttccagcacttagagcaaacttgggctccggagcaacacgttctgaaggcatcgtaatcatccatatcaatatcaaacaccaactccttctctaaagctttcaattcgctttttaatagagtatcacgttctcttggcggtttgttatatatggcaccgatttcaaatctgtctgggttggctttttctatttgtgctttgaaatcttgcacagagttaaaagaattataccttttgtaagcacctgacctgaacgccatagcgaattctctgttaatcatatccctagaaggtttgggcgaatgattcagccagttgaaaatgtgtttgaatggatagagcgacttatagtagtactccatgtctgaggagcttggcccattagtctttactgaattggtcatgatgtttataaaacagttttttgagttgctaaaactaatttttgctagtattatggcacgcttttctcttcagcttcaaagtatttttgattaattttttatctttttggcgttatgaaacttttcaactgaaagaaaacaataggtaaaagtggcaaagggcactgaccgagcaactgtttcgaaactcacgcatcattcacacgtaggatatagtaatggttgaaccagcaaggaaaaagcagaggattgatcgcgatactcatcacactgtggctgaaccagtaacggaagctaaaaatacgctgtacgtgagccagcttaatgaaaaaattaatatgcaacgactgcgagtaaacctttttttgctctttgctacgtttggagaggtactgaaggttagcatgaatttcaagaaacagcggggccaagcctttatcaccatgagaaccatcgaccaggccagtctggcccagatttcattaaacggcgagcgattctttggtaagcctttgaaagttgagttcagcaagagtgaaactaaaacactatgactggcttaacgctctattcatagcagcacgtatataccgagaagagctgccataggggcacatcaaagtcaagagcgcagaaccaaaccaaaatgtttatatccaaacaacccggcgttatagatggtcgtcaacggacaaataatatcaaggcatgtatcaatatggagtagatatagaatctacaaaaatctgtagcagaaagagtctcccgaaaagacatactgcagaacggccgcttattcctcacttcaattgcttaaataatacaaagggcaaaccacagagtaccccattgccaaaagacgtttattacattttggaagtgataatttagtatataagacagcttactatatgatgaattacagtgtagttcagcgtttatatgtggcttcgtttaaaatgatatatatttctagtaaaagcaaaaattcacaaatgataaacaaatcaaaataaacatcaaaagaaccgccaattgataaaagcacaaagtaccaggcagagttgtgaaaccgggcctcttctattgtaccacacacaaatttttctttatttaggtagaggatgagtctggaacccacacaaacggtctccggtacgccgccgatgctgcatcaaagaacacacaaacaagtatacccattgcggatggaaactatcccaatattggaatccgactccaaggctactctacaaagcaacgagcccacccagaaagatgaggaggagaccgaatattttgagaataaacaatccgtgtcgaatttgagccccgatttgaaattcaaacgacacaagaataaacatatccaggggttccctactctgggcgaaaggctggataacctgcaagatataaaaaaggccaagagagtggagaatttcaattcttctgcgccaattgctgacgacaatcatagtggagatgcgactgcaaatgcgactgcaaatgcgactgcaaatgcgactgcgaatgttaatgcaagtgcaatgcccgctccatatatgccttattactattactaccatccgatgaatgcaccaactcctgcaatgataccatatcctggatcaccaatgcattcgattatgcccaactcctcattacagcccttttattcgcaacccactgctgcaggcggtcccgatatgactactccccaaaatatatcttcatcacaacaattgctgccagctccgcaattgtttccgtacggatcattccatcaacaacaacttcagcaaccacactacattcaacgaacaagggaaaggaaaaaatcaatcggaagtcagagaggtagaagattgtctatgttagcatctcaagctaatgggggaagcactattatatctccgcacaaggatattcctgaagaggatttttacaccgtggttggaaatgcgtcttttggtaaaaatttacaaatacgacagcttttcaactggtgtttaatgagatctctgcataaattggagttgaaggctaaaaaccaagaggaagaaggggaacttgaacatctgaccaaaaaatccaagctcgaatcaacaaaggcagaaactgattatgtggatcccaaacgtctggctatggtgataataaaagagtttgtcgatgatcttaaaaaagatcatattgcgatagattgggaagatgaggaaaaatatgaggatgaagatgaggagaagattctggataatactgaaaactacgatgacacggaactgcgacaactgtttcaggaaaacgacgacgacgacgacgacgacgatgaggtggactactcggaaatacagaggtctagacgtaaatttagtgaaaggagaaaagccctaccgaaagaaccaaaaaaactattacctaatagcaaaaacgtggaaaacacaaagaatcttagcattttaacgagcaaggtgaacgcgatcaaaaatgaagtgaaagaatgggcagtcactttagacacttcgagaccagatcttgaatggcaagaattgacttcattctcatcacaaccactggaaccgttgtcggatacagaagagccagaccttgcgattgcagatgttgagacaaagttagaaacaaaagtcgatgagctaaggtaccagtcgcatatattaaactcgcactcactagccttaaacgaaataacaaattcaaaagtgaataaattgaacatagaaacaatgagaaagatctcaagcgaaacggacgatgaccactcacaagtgattaatcctcaacagctgttgaagggattaagtttatctttcagtaaaaaactggatttatgaaataaaagaaaaaatcaaaaaaaaatcggatacttctgcatatgtaacattacacagtcatacatttatatatacatatatatacatattaatgtatttgaaaaagcaaaagaaccattctatccttagttaaagggcgaatcagtagcagcgctaccactattgttattgttttcgtttgctgtcatggtatcgtggtggtaaataatactttcttgaagtgataatgttgatgacgatgctgctgaagggctacccatatctaaagatttgaacagctggagtgggcgttccaataacccatttgaatgttcattgtatacctgtaatcttgtcatatgacttttccagacggagctattatctgctaataaaattatcctgtcacgggcaacatgttcaataagcgtacaccatacgtgagacaattgttcaatgcatttatcgtagtagtaattattactagctaattcaaatctgggcaatttgataactaattccgtgcaaatgtctaagaattttaatgatgcgtgcaaattttccaaacgtggtggaatgttatccagtatgaaatccaccaaacagtttaagaactccagaatttgaggtttcattctcacgaaagcatagtcatctaatttattactctcataagacctattgtaaggtatgctctggtaaacggcttctgatttttgtttcaacatgtccagacacttttgtatactgaagtctaatccgatgactctcgtatgtacgctttgttgtatttctggatgttttgtcatcaaatccaccaacaactgctgtaattggttcttgttcattagttccatgcctcgttgcaagggcagaggctgccctctgatgagcgatcctggctgaggcctcctcttggagacgcccccatatttcatcacattcttgttacgaggtagttcttcctcttcttgctcctcgttggcataccgccttttttgtttcactccagcagttggaatcattacattgcctgtgccttgtgaactgactgtactctgtgttattttactgctgggtttaaaaccccattcaaaccccatcataatgctatactgtcctgtgtttgttgcttttgccaggtaccttcgaacacactaagtgagaatacttggttaagtatatttttaagtaagaaattcccactcgccgcattatcacccgcccgccgtttctttttctggcaaaattttcactatgaataactaaagagatacattcgatgggctttagatgaggccttttgaagaccaaaacagcaccaaatagcgacacattaagcgtaatggaacctcaagaagagtttataactaccgaagaagttgagcaggagattgtgcccactgtggaggtcgaacaagacgttcccgttgatattgaaggagagaatgacgacgatgatgaaatgatgaatgatgatgaggaagctttggaggtcgacatgtccaacaactcgcttacctatttcgataagcacacagactccgtgtttgccattggccatcatcctaacctgccgctagtatgtaccggtgggggtgataacttggcacatctttggacatcacattcacagccacccaagtttgctggcactctaaccggttatggcgaatctgtgatttcatgttctttcacttctgaagggggcttcttggtcactgccgatatgtcggggaaggttcttgtacacatgggtcaaaaaggtggcgctcagtggaagttggcatcgcaaatgcaagaagtcgaagagattgtttggctgaaaactcatcccactatagcaaggacgtttgcgtttggtgcaactgatggatctgtttggtgctaccagattaatgagcaggatggttctttggaacagttaatgtctggttttgtacaccagcaagattgctctatgggtgaattcattaacaccgacaagggtgaaaatacgctggaattagtcacttgttctttggatagcactattgtggcatggaattgcttcactggccaacaattatttaagatcacacaggcagaaatcaagggattagaagctccatggatttccctatcattagctccggaaactttgaccaagggtaactcgggtgtcgtggcatgtgggtccaacaatggtcttctggcagtaattaattgtaacaatggcggtgcgattttacatttatctacagtgattgaactaaagccagaacaagacgaattagatgcctccattgaatccatttcttggtcatccaaattctcccttatggccattggccttgtctgcggtgaaatactcttatatgatacaagtgcatggagagtaagacacaagtttgttctcgaagattctgttacaaaacttatgtttgataatgatgacttattcgcatcgtgtatcaatggtaaggtttaccagtttaatgcaagaactggccaagagaagtttgtttgtgtgggccataatatgggggttcttgattttatattactgcatcctgtggcaaataccggcaccgagcagaagagaaaagtaataactgcaggtgatgaaggtgtatctctggtgttcgaggtaccaaactgatagatagtcgcgtatacataaataacaaaaaaacaaattcaataacataaaataaaaatacttttacatacagaagaagaaactttatatattcgacaaaggaaaatgtaaaaaaaaaaaacacattattttaaaagaactgcgctcattatcgtcgttaacgattttattattacatgttgaacgttacattgtctttttgtcccgataggttgaaagctgaaaaagtataatgggtcagaatctgacagttccggtaagttctttggggatccttctcttagtcccggtacctttaatttgctccatgtatcttttagcagctgctctaccgaagcgcagaatcaattttctaaaaaacaacccacaagcattacacaggcaagcagcaccgttagggccctccctccattgtaatgaagtcttaatctctccacattgcccacatgtcctagtaatgcccgttcttggtcgagcaggctgagagtcagcgttcctagggaggccatgttgtgcctctgatccgctattcaacagcaattgaacggggacttttttgaaggctgttccgtttgaaatcacaataggcaacttagtggacatagcgaccctgtaatgttatgtttctagctaggaacagaaagtgccagctttttgagcagttaaagagtaaaatgtttatgtggtttcacggacttacatgtgaaagactagcctggcgctatctaaattcatgatgaaactcgatggccctttccatggcacaaaaatcttgacacatggatgtgcgcggcggcggtaaccgcaccaaggaaaaaagggtccaatgccaagaaataataaaacggacccttttttctttttttttgaaataaaattgaaagagaaatgcaaacacttttcaggtttgaaaagaaaagaaaacgtcaagaatcttacgccaaaagtgcctaagattcaagtatctctgaaaggcgtaccattttcaacaaggggcataggtggccgcaaactaggataattgacaacttagtttcatattgacaatgtcatcgcaattgaggagatagccataattcgggagggtacaaaacctgacctgctagtgttcaactaatgcatcatgggtactatagagagcattctagtggtagaaaaaaaaaaaaaaacaaactttaaaccgggtaatataaacttctcatatggcttttctccagggaaagaaagggaagggatacttcaatgacgaaggcttagatgacaagctaatacagaaagggaaaggagcagggcatcggaaggaaatgttgcatttggaagatgacaatggacgacaaaggtcagtgatagcgaatttgcagaaattcgtttattgctgcctgtacttgaggtttatcaaagatggatcattattcttgatcctcctggggtggataatttcatcgctctgtgatttcattcaggaattgacactcaggtacctgaagaagaactatttagaggtgggccgcgacaatgatcaggaagatgatgaaagtcttgccatcagagggttagaaacacctattgtaagaatgataataaacaaagccatacgatattaccaaggcctaatacttctagaaacagcgtactgtatagtataccacattaggctagacgtatcgagagacatatgttccaaaccgtacggatttgtgataatgcttttgataagggaatttacttgtccggtacccacagcgtttcctagcaagctacttctggtactactcgatattttattacttttctgccagattgtaataataaacggctcactgagctcgagtcttcagaacgtgaaacttattgtcaaggagttgaatgcagaagaagagggcgcactcaacattctcaaacttaatacctggcacatggatgcaaccggaccggaactcatagtactcaagaatcatgacaagtcgattcctcaacaggcagacggggatgacgctacagagatcactcctctactgaatatcgccgaataaattcaagaaaggaaaagaaaaaaaattaccaaaatgaaaagaacggaaaaaaaagatgaacagaaaataaaacaatacgtggttcttctactgtccttcccacatcgccgacagagaaaagacaagcaaaaagatgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggtgcggtaccgttaaacgttttaatattggcgccgatcctaattacaggacctactcggagcgggagggtaatctactaaattcttagggttattggtagggttttggaccaatgttttgagcaggacaaaaatgcggagtttccagattttctttaagagccgaccccccacccccttgcccctatacatggggtacgtgcctgtattttgagggaaaactacgacataaaacacagggaaaaaaacgagacgcccgtttgaagaaggtaatgtaggattccgtcttgccagcatagcggataaacaccgcaaggaggtgttgtggtcggtaatgagtggcacgaggtgtttgctaggcgtcggactaccagttgatgtgactgctacggaaactttgactcatgatgaacaaggaccaggtgtagagccaggaccgtgttcgcgaggaagttctatagatggtctgctgccctcgttgctcggtccacatgatgatgtggatgacgattcggcggcttttcacaagtacatgacactatcgcgagatggcgcaggcgccatccatgctccgtcattagtcgaagacgcctcaaggaacgacgacgacgacgatgatgaagacgacgacgacagttccatgtcgcgagacctatccaaggctctagatatgtcatcgtcatcatcgtccagcccgcgcgttcaaagtcggcggcaccgtagttctgtgagcgcaatatctgcaatcttacaccaaggaaaatctggccgcgaagacataactggaagccttagcgttccggcagaacaagaaaaactcagttttcttgccaaagcctcgagtattttctttcgaaggaacagtatgcccagagacaaacatacgcattcagtatgtcccgctagccgcccagattccgagagatttatcgtcacatctgcagccgcgcagtctttacgccgccaacaacaactggaagacgctcagtacgctcgagttattacaaactttcgtactataggatggtgctctcccagcgagatagagtctgtggaatataaacggtccttgatcaatgcggagtgggacgaaaagatctcgcttttgtctcacgcgcaatgctataaataataaatatacatatatatatatttatatgtagatagatgtgtgtatatatatgctaggtaaagaaacggaaaaatcgaaaaatcgaagttggagaggaaaaacaagacatcaggcccgcacgtttcgcgggctacctgcccatgttccgtctcttaatgtcattcaacaatttcaaagacttaatctcgttaatgtcattgagctttgctttccaaaactcattttccttgttcaattgctctatacgatcgcgaagtttgttgatttgcgtgtttaagttctgcagcttattcatgttctcaaaattcttttgtttcttgcgaatgcggaaccgctgcgacgcctctgtgttctttcttctccgctcttgcttaatcttatccagttcgttagaagtgctcacgggagcttcctcttcttttacaacaactgctgttgttgcggcaaccttcccctttctcggctcgcggagcttcttaaactgcgagacatcctggccattatttatcatgctaatgagctcctccgcgttgccactgctaaccagcagcaatgatagcaagcgcgagcccagctctgaatcgcttgatatcaggttctgtagatgttccgaaagattgttcacgttcatacccttcctgcttgcaatgtcaatgtttgttgatttcttttcccacccttgtttcgcactcatattgacgaacaaaacaatttgtcttcgtaactaccactggttataaatagttaaattcaagttacctcgtgttcttagtcattggctgcccggccttgactcacgccagtgacctacaactatggcgtttccgcttcccgcccaaaactgtggtgttagaaagtagaaaaaggtgaaaaaagcgaaacctaaaaccaaaaaaaaaaaataagtcacgtgcactcagtaccccttctattgtattttagtttacctattgggccgggcgggccccacaactgtggcatctttcagatcatttttttccagaatgcatggaactgacgagtgaacttttattccacggaaaaggacaaaaaggtgcagtaatggaatggtctttttgcacggcagtgatgtcgctatcatatcaatcactgaaagtgaagttaaccatattacaacaagttcacacaacataaacagtgtaactagcatattatcacagtcatggctctacctctgataaaacctaaggagtctgaggaaagccacctcgctcttttgtccaagatccacgtgtccaaaaattggaaactgcctccaaggttgccccatagagcagctcagcggaggaaaagagttcatcgacttcacgaagattacgaaactgaagaaaatgatgaggagctacagaagaaaaaacggcagaatagagacgcccaaagggcctacagagaacgcaaaaacaacaagttgcaagtgctggaggaaaccatagagtcactgagtaaggtcgttaaaaactacgaaacgaaactaaaccgcctccaaaatgaacttcaagcgaaagaatcggaaaatcatgcccttaaacagaaattggagacccttactctgaaacaagcctctgtgcctgctcaggaccctatcctgcagaatttgatcgagaatttcaaaccaatgaaggcgatacctattaagtacaataccgctatcaagcgccaccagcactcgacagaactgcctagctctgtcaaatgcggcttttgtaacgacaacactacttgcgtttgtaaagaactggaaacagatcaccgtaaaagtgacgacggtgtggccacagaacagaaggatatgtcgatgccacatgcagagtgcaataataaagataaccccaatgggctctgtagtaattgtactaatatcgacaaatcatgtatcgacatccggtccatcatccactgaagagagagaacttcttaatacttataaatacgtcattgaacagctcaacttttgtaacgtcaaaagaacgcacatgaaaggagtgacattgcttttttctttgcaagtttattactgtggttatgtgtaaagaattagttcatggacattggccgcagagtgcaaaagcgttttggacaccccgcctttggtgttctcgccgccatattttgagacgttagtttccgacgaattgagctgaagcggtggacattatctcaaggtaccgcttactatgcctatacattcctgcaatttttttttttttttttttgataagtattactgggtaatgggaagtataatcactaggcatattatttttgacgcagaggagtggcagcctgtctactatgtaaatgtaatggtagaaccgttattataacgtaaaatagatcgtacataagaaaaactggacgcaaaccatttaaatctaaatgcgaatatgcgtactgattattaacatgataccataatttagatctttccttttgaaagtcgtgtcaaattctagtattggcggatgagatcctaatgtgctaaacaatagagataatgggatccccgcaaatttcatttttaaattgctttcctcttctgagttgaacacgaatttttgagaatctagctgtagttagacgttacgcaaaagaagctttggcgcaagcaaatctccttccatactggtctcctttacggctgtacgaacactaccgtagtgacaaactgaaaaacgaggatttggtgagcagtctggaacaggtagatgaatcataaagcgcagcaaccatcctcgaactgatgacagtacgacttttctccaaaatagatataaagaaaggctggttattcgtggagagttcagtcctccgtatctaaccttgatgaattaaaactcaggccagaacaatctctttaacagacctccatacatactctcggagctatattttagtgcgatcaaactgcgaatagaataaagcagacgcaagaggcaaattacaaactcttgcgcttcctttttagcgagcttgttaaagtagggtctgaacgagaggctgtcacaattgcgttgcgttatgcaaaggatataacacggtgctgaagttaaactgtgaaactatacaagtggaggaccctttgagttttctgtagataaaaaggagaatgtttcagaagagcgtcagagatctcgaatgacagatcggtggctaccacgaaatcttataggcgtttctctgggctccctagttacgtatagcgctgacgtagtttagaagggcgcgcgcattttttctattgttgcctcttttctcgctagctggcttttagcatcatgttctgcggatattattctccgcccggaaggttcgtggaaggcctagaatgagatctatcaataacgctacgcagatttctaatgttacatgtcacgtcgatctgacatatatctccgtcaggttcgatccagactctctgcgcgcgtaccaagagctttttgtttcaataggaacggaatttcctttattgaatgtggcaacgaactgcggagggttattagcttcttgacactttcttcgtccattacgtagacctaacgttgaaaaggagacctcgaagaaattttaactcttggcacctcagaataaacaaggtcatctagtgcgatggcaatgcttcaaagtaaatggagaatttcgaaggctagcgtctctagataaatctcagcctaacccttttacacgaagttttcccaacaaaaaaaaaaaaaaaaaaaaaaaaaaaaagaagggcggttgtctttggcatatcgcgaaaataatagatcttatcaaggggtttttaagtcatcctctgattattggaagtcataatcacgttcaatggtgggaggccttcggaaaagaaaagaaaagaaaagaaaattttctcaatctgaaacagtctcttgtttacgttacactggcaattttaacggcgagactcatctgaaaaaagctattcgacttagtcctgtgtttttcattacagataatcctgatcaacgggtgtacgtttttccattttaggtcagtatcctccctctgtgtttcaaactaagtataagcgcccaccctaattcgctcgtatccttgtgtcaacttctttgctgctctgcagctgtaaacagtttttgcgataagcctcacatatgtcagtgctgtaaataccggaaatagaaagtcactgtggtctgtaccctcatttgatttacgcggttagaaaagtggaaactctttcttaaccgtgtaaatcaagtatgtcatttcaggaaacttcctcaattcttggcgtactatattgagttgccaatgtatgagagtggtcgatttcaatcggcaacattctatctcgcaattacgcaataaaaattgacatggtatgttattttcatccttcggatttttcaaaccattctgttataagagatatgtaccatcaatcgccgacagcgataccctctttaacctctagtaagaaggacccggcacttattgtaatacgtttaggggaagtaggtaaatctggaccggtaatacggcataacgatccatttcggacatcggggacatttcttttttttcctttattattttttttttctaatgtccttacgaatttcaggctctaaccttatttcttattaggacgtgtactcattgccatcgcaacaataaaaataaaacattaataaaaaattaattagagcctgtaacatagagatcaacgctactgtagcgttagaaggacagtgagagagtggcatgacaattaaagtttcttccgattacttcatgtcatctgcattacaaaggaaggaaagatgtttcgaattatttcccctttaaggtatttttgatgtgaaatttgaccccatactgtgaaaatcaactgctaagaactctgtgatcttctaagataaaaaggcgggccccttttttcttctatatctatttattatctaaatatgcttacataagcaaaatataccggggtagttagtgcacgcggggaactacctctttcttaccggatcttgccgcatccttttttctgttcattctcagaaaaaagaggctttttttcgtgaatacagtccgaagagcactagaatttcggaccgaaattagtaatatcttctgtacgaaaaaggaagaccccttttcgtacagaagccttggtcaatcagaacaggcaacgttgttttttctactccggaattttctgagcgaagacaatcggccctgaagagaggatcaatcgtggaaatctacatcgtcctcaagaatttctaacgagacttcatgtcaaaatttaacttttttagcttttttttaaggttggcccgccaaaatcgtaagtctcggtgctctgtttaggaaataaagaagagaaacgtcacctaaaaagtttaaattgaagatgtcgttctatctcgcgaatcttaaatgaaagacagagtgggttgatgacactagcggacttgtcattaaataacccatgatatctaggcacattaaggttagcgtggggggacgcgaataatataagcattactccagtaaactcacatagaaagaaggaaatattctttgttcaaagagcaaaggtgcctgtaaagatcctcttattcatcaaagcctggtcgaagattattagttgtgccaaggcaatatcaggtttattaatcttttaggaaaaatgtaaggttgttacgtctctttccgtctcgcggaaaaacatttttactcaagccgtccgtgggatgatttttggtggttatcattttccaagactccagacaaaagaacgtgcaggcgcttggcaaaaagaaaaaaaaaaaaagcgagagggaaaagtggcgcggtgccaatactaccggtacttgttcttgaataagctatcagatggtcaaaatagggctagaagaaaaatggtaaaataaagtaaaaaaaggtaaaagataatttttgaagaactaaaaaatatgtaaatgaatatgtattctacgggtagttttctgccttacaaaattatggcagcgaaaacagaatggtggaagaaagtaaagagggtatcgaaataatatcttaatttaagaatgaaaacatcgtaatgaagaaacgaacatgttggaattgtatcattagaatacaactggaagagcgagtagcaaccacataaagtttccaagaaccttgatattagcagcaccttggtaagtactcgagatagaaggaacagagtatgtagcgactgcagaaccagaagcagattgtagtggaccagttagagatggagatgtgacaacgggagccacgctagaagcagaagctgttgtagctagttgggatgtagtcttgattgaaatagggttggttgctgtggccacagtttcgtaattcttggcaccatttgaacctggaatcaaagtggttatgtaagtggttgggatggacttggttgtgtaaccagttgttgtttcgccagcggagttagtaccaacagatgactcagtggtaataactgtggttggaatagccgtcgtgacaggggtggtagccgaaggtgcagtgttttcgcctgcgcttgcagaacttacgatagtcttagcagagcatacagatgtagtttcaccggcagcgtttgtagcagcagaacattcagtagtggttattgtagttggtacggcattagtggcaggagttactggtgcacttggagccaaagtggttacataggtggttggtacagactttgttgtgtaaccagttgtcgtcttaccagcggagttagtacccgtagaggattcagtggtaacaacggtggttgtgacagctgttgtaacaagggtggtagcttcagtagtgtattcgccagtaccagttgaacaaggaacagtggttgtgacagtctttggagagcatccagaggtagtttcaccggcagagtttgtacctgtagagcaaaccgtagtagtaatagtggttggggtgaaattggtaaccgtagtgactgatggagttggagcaattgtggttaggtaagtggttggaatgtttttggtgacaaatgtagttgtaatttcaccacctggttttgtactagtagaatactcagtagtaacgacggtggttgagacaactgtagttacaggtgtggtaggtgaagtggttgttgattccgaggcggtttcgcttggactggttgaacatggaacagtagttgtaatggtctttggagagcatccagaggtagtttcaccggcagagtttgttcctgtagagcaaactgtagtagtaatagtggttgttgatgatgtagtgacagaagtcgtagttgtagttggaacagtagttgtaacggtctttggagagcatccagaggtagtttcaccggcagagtttgttcctgtagagcaaaccgtagtggtaatagtggttgttgatggtgtagtgacagaagtcgtagttttagttggaacaatggtagtttcggttgtagaagaaacagaggtttctgtttgactgccagggtatttggatgatgatggagtgacagtagtgccagtagaaaagctttcagtagtagagctgaatggaattgaagatggagcggaggaagtgatgttgctagaggaagatggggttggtactggtgctacagagctttcagtggtggagctggatactggagcagaagagctttcagtagtagagcttgatggggttggtactggaacagaagagctttcagtgctagagctgaatggggttgaagatggagcggaggaagtgatgttgctagaggaagatggggttggtactggtgctacagagctttcagtagtagagcttgatggggttggtactggagcagaagagctttcggtagtagagctggatggagttggcactggagcagaagagctttcagtagtagagctggatggagttggtactggagcagaagagctttcagtggtagagctggttactggagcagaagagctttcagtagtagagctggatggagttggtactggagcagaagagctttcagtagtagagctggatggagttggtactggagcagaagagctttcagtagtagagctggatggagttggtactggagcagaagagctttcagtggtagagctggttactggagcagaagagctttcagtggtagagctggttactggagcagaagagctttcagtagtagagctggatggagttggtactggagcagaagagctttcagtagtagagctggatggggttggtactggagcagaagagctttcagtagtagagctggatggagttggtactggagcagaagagctttcagtggtagagctggttactggagcagaagagctttcagtagtagagcttgatggggttggagctggagcagaagagctttcagtagtagagcttgatggagttggtactggagcagaagagctttcagtagtagagcttgatggagttggcactggagcagaagagctttcagtggtggagctggttactggagtagaagagctttcagtagtagagctggatggagttggtactggagcagaagagctttcagtggtagagctggttactggagcagaagagctttcagtggtggagcttgatggggttggagctggagcagaagagctttcagtagtagagctggatggagttggtactggagcagaagagctttcagtggtagagctggttactggagcagaagagctttcagtagtagagctggatggagttggtactggagcagaagagctttcagtggtagagctggttactggagcagaagagctttcagtagtagagctggatggagttggtactggagcagaagagctttcagtggtagagctggttactggagcagaagagctttcagtggtagagctggttactggagcagaagagctttcagtggtagagctggttactggagcagaagagctttcagtggtagagctggttactggagcagaagagctttcagtagtagagctggatggagttggtactggagcagaagagctttcagtggtagagctggttactggagcagaagagctttcagtggtagagctggttactggagcagaagagctttcagtagtagagcttgatggggttggtactggagcagaagagctttcagtggtagagctggttactggagcagaagagctttcagtagtagagctggatggagttggtactggagcagaagaactttcagtagtagagcttgatggggttggtactggagtagtagtcttcttagtgcatgtcttagatgtggtagttttcttctttgtacatggagtggtgtcgtgatgaggaggtgtaggcttttcctttgtgcatgaggtagtggttgggggtgtaggcttttccttagtgcatgaggtagtggttggtgtagcaggagcggtggttgatgatgatgtagatgactcggaagtgctagatgtagtggtagatgactcggaagtgctagatgtagtggtagatgactcggaagtgctagatgtagtggtagatgactcggaagtgctagatgtagtggtagatgacttcgtaccgccacaattattgtcacaatctatgttccaatagaagcctgggaaatccgtttgagagtggccttgattgtcatagttgttacaaccagtagacaaatcaaaagatgtagttccccattgccaggagcttgcatattgagcggcactaccttgcaaatactcgaattgaatttggaagttaggcatccacacctgacagctgttgacatcttgtgtggcataaacttcaaaagtggctgtgaaatcagttgggttgtcaatcaaataggtattttcgttgtaaccgtatagttggacggtaccttttggaccagtgacaccaatgattttcaaagaccatagatacttcaggtcaatattttctttacctttgacatgaatagtgatttggtatgtgttgtcttgaacccaagaaacggaagtcacatccaaagtatactgcatgatattttgctggtccatgtgccaattgaagtctaagttgggacagccattaacgatagaattacagctagttccttcggaggatcctcttggaactagtgcagttggaaaacccaaagccgagttaaatagaagcgaaaggaccaaataagcgagtagaaatggtctttgcatagtgtgcgtatatggatttttgaggcctacaaaagtatattttaattagaaccacaacatgacgagggataataactgatgaatagggtgctttttatacgtttattttaggaagcaagagatcctttttatcaattgggaacccttcaacaatttgtactggtaagtctatgagttatccgttcttgaactagaagagagcgcagtaacgtaaatgcttgaacatatttgttaaggtaaataaaactgccctaattttttatttaattcgaacacggacattcctcagataagacaagtctaacagttaattcaaagtagaaagagcttaatttctccgtaaaagaacgaagtatattgcgatgatgccttgaatcccaattggtaactctatgacatttttgtaaaggttacctcatcagaagagaacggacctaaaaagatgacccacatttctctagaaacaatcgtaccctaatagttgctttaaattgctcagcggtcaagaaaacgtatcataatgttattctattcttgagcaggcacttttagggttgggcaatgtcctcaaagtaaatattagtaaacaaacgaatacctccaaatccattgaattgaaaatccattccaagctctgcgcttccaattgttaatcacaccaccgataggcaatagaagttctgtccgtgaagataccgcagaatgagttgtgcccgtattgttgcacctaattacggaatcccaaggtatgcgatgtcccagtacgaccgttaaaaagacaacatgaatgactgatctgtttaagagtataggcagaaataaaaaagtttgtgcaatgcctgacaaaaaaaagctaatttttcttttaagaaagaatgtcattcttttaccgcaaagttaatttctgcctacaatcaccttctaaacgctcggactgattgccttgagcaatcagcagttctttgaagccactgtcgcaacaaagaaaaagaaaagggaagtccattcttagccccaaagaaaaggatgacaaaaaaaagaaaaaaagttaactcgtaccagtaaagcctaattttgcagtgatcgctagccccagagaaggactaaagacaaaaaggacccactcgataggaaaataacggccgaaactctttgggcgacattttcttgttaagaaaacagaagaaaaaaaccttaatttgaactttccaggcacacccaaaaaggattatgcttatgtaatgccacattccgagaaactgaaaggcaaaaaagaaaaagccttttttttcctgccgcgaaagtttaatttgcctaccggcgttcctattggagtcaggaaaagatcactaggaattacagctgtgagaacatactctggggctggcgtaggcacacaatccggtattcctaaagttttgtggtacaaaactccatacctaaaacataaaacaaatctcacccgtggatccttttattcataataccccgtcctgcacgccgtggaactgagtctaagttgacaaggctacgaatgaattttgggaaatgcatacgaagaggactgaaaaagtagcaggtttcatgtggtggaaataccgattagcgcattcacattcgtgttagggtccgttttcccgcacagctttcgaaatatgaaacaatgtccgtctgcgtcagcagctcagataaggaaaaaagagatggtaaaaaacattcgagaaaaacaagtactgcaggtgcatgtcctcaatgcatgcaagtgaccgttttggggtggtgagaaccatcactaattaaacttttcctattttttgtctttacaatattcattagtcttcattcgcattgggtgttctacagaaatgctgggcaaatctggagatgggttgatacgctagcgttcctacttgtaagggagcaaagatgttagatttttctgttttggaattttagctttctgtccaccttaggtgtatggctcggctctcgatgagaataggaaagtattccgcactaaccgatggggggttgttcttaccgtaaaaccacacttgaaagctatacgtagttggaaccccaaaacgacggtatgaaatgagggatacattaggggacaaaaaggactagtaatttctttgaaatttgtaataataattcgaaaagttgagcatccttaatctgacatggcacacagatgaaaaggtgttgaaagcactgtaaaagaggttaagaaatatcctcttttcaacgagcttcattttgagtataatatgtttatatttgtcgctggccctgagatgctcaactgtaagtaaaacatcggatgtgtggataaaaagaacatggaaaacgagtgcagcaacgactatatttaaaatagtatcattcataattcgatagatggacttttcagctacttgtaaacggcgaaattgtgtctaagttgtgaatgagcttttcattttcatttgcgtaccgaagtggtaaaactgacgacctaaagtacgatatacggaataaagcaagttctaatactctctgcagtttgaccagtgctacttggcgctgttcattccaattagccgtaaatttgtgaaatagatcccaagataatctccgttttatttgcttccaaagaggttatctttttaatagttggcattttctagcttcttggttgctataaggcatagttgaagtgcagtgagaggaagaggggaactcacggaaagagactccttatacttttgtcaaccggtgtgttccaaaattcgctagttaaacgttttattagcagcggtcccattgagccaaaaccccgctgagcgttgcgacacaatctgatcataccacataatcattgcagcgcctactttttaacttctagcagccaaattgttattcagatttagttggcggtacgactccttacagcagtaaattattcgaattagtaacaaacgagtgattggtatgtggagataggaaacgaagactgagcagaagcacccacgctaagtaattgtattcttgaattgggagcctgaagaattatgatcaagctcagcatctttccgtagcgtcttcgagaatttgtcctgtgagcggaaggttgaaagttataaatgatgtcttatttttttgcatgatctccccagacccagatgtcatctgtaaagaatttagtaggacaattgaagacgctgtcttccaattgattcagcgaaaccttttcttaagatcattcatattcttgtcaaaacacagatcagcgtcatattattcttgtctcgacattaggccgtaatttcgtcgaagaaaaatgatctatgtcattgtaaatatctacaattccagctatttacgataatcacgttagaatcttttgaatgaatgtctttcgatacttttccacgcttgaaagttcgcattcttttggcgttttgtatccttattattccaaactttgatccgtttcaacaacggaaaagggaaaaatgaaaaagtgctggtaagtgaaaaattatgaaaactcgctaaacggcgaagtttagatgtgagacaagcagcaatggaagtataggttggtattgaatatctgtggttactctaaagatgtctccgaagaatataacaaggtcggtgatcccggctatagatttgtattgccgcaaagcaaattttaaaactctaaaatcattgtcgatgatcctaggtagtaaaaaagaatggtatgacactaaaaaggcgccattgagaacctttttggtctctcgatgtggcattttcgagcagttgaggggtcgtctcgttgaagatggcaaagtcaacttgtttagtgttttcctgacaaacgactcattttctttttgcaagatgaccgttgatgataagttcaacactagcttggtcgattggcaaaaaataccctttgacagtacatttgcaactgacagaagacagaatatcagtttactacctgttgatacactgtttgcaactgaaaagatcatatcgattcttggtgtatctcctaatatgacgaatcttgtttctatagaaagagagcgatcagacctggtggattttaattgtaaactgcaatcaaacatcctagaacacctactatacgcgaaatgccaaggagtgtacgtaacttctaccaatgaaaaagctcgtttgcttgcagctgtctgcaatcctgaattcattgacaccttctggtgcgaattgactcccataagagtctcattaaaggaaaacccttccatttctgtacctcgagaatatcagatgtacgatccggtggtacgtgccactataaaggaggttgtcaccaagcgattactgcgatccgccttcgataatgacatcgacccgctaatgtgtcttcatttggataaaggctggaaacttaaattccccatactatcctcgacaacgggcctaaacttctccctgaaggattgtctttccctggacacaggaaaagatgcatctgatatgacagaggtgtttctcgctactatggagtcgagtaaagttcttcgtacgtatagcaacctcgttgacattgtgatgaaggacaatggtaggttggactcaggcgtcctaaagcaattcaacgactacgttaagcaagaaaagctcaatctacaacattttcaggccggttcctcaaagtttctcaaaggcgcaaagatataatcctcttatatagcatgtaaatagaaagtacgtaaaaaaaagctactattgactttattctccgtgagggcggttctttctgtagctgttggttttttccagatcttatgtgacacacctgcacaacaatgtcattctctgtcagctgcaagactcccaagaccacgaagctgctggtatcttctatttcagagagcgctgttgctcttattattattaccatacgtatacttttttccattggcaaaagcgatttcaaaaaaataatctccaaggaaataaatggtgcagaaacaatatactacagaaatataccggaaagtaaaccccaagggagttagcacaagatgaatctaagatttgaattgcagaaactattgaacgtttgctttttgtttgcatctgcttacatgttctggcaaggcttagccattgctactaatagcgcttctccgatcgtggtggtgctttcaggctccatggaaccagctttccaaaggggtgatatccttttcctatggaatagaaatactttcaaccaagtaggtgatgtcgtggtgtatgaggtcgaagggaaacaaatccccattgtgcatagagttttgaggcaacataacaatcacgcggacaagcaattcctcctgaccaaaggtgacaataacgccggcaatgatatctcactatatgctaataagaaaatttacttgaacaagtcaaaggagattgtagggaccgtcaagggctactttccacaactagggtacattacgatttggattagcgagaacaaatatgccaagtttgcattgttaggtatgttggggttgagtgctctgctggggggcgagtagttcgccaagtttttttggaacgatgtttacgtactttgtatttgtgcttatggtctttaacttgtttaattatataaccataaccattcggtccacgctgaaaacaaaatattgtcttaggacacgctttgagaattattgaaaaaggagctcccacagtgatgtaggcaattcaacagagatgatttgtgtcattttttataaggtgataccgtcgctcattaactcgatatcttgaaaaggcatatgtgtcggtaattgagaccgctaggtttaacttctcgaataaaaaatggtctaagctgcataagcatatagaattgtacaatcagtgtataggtagagcagaagcagtccaagattcgagctaataatactcatataatatccatcgcgatgggtattatatgaaacataacaatcgtacatggtgattgaaaataatagatgataagaatcattttcaaataatagtgtagatcttaaaaactcttggcctgtttagacgagcggcagaacgacaggcagccatactatcaaatggaccctcaccaatcaccagctgataatgccgcatcgcctacgaagagcgtgaaggcaaccactaaaaattcgtccacgaataataatgtcaatagcaacaacagcaataataacagtaaccatgatatactgaattttaatgataactatactaccattctgcaacatttggcaaacgaccatcctaatatactgagggagaaaggaggatcacaacaacaacagcatcagcagcagcaacaacagcaacaacagcagcaacaacagcagcaacaacagagcctggatacccttttgcaccattatcaaagtttactctccaagagtgataatgcaatagcctttgatgacaatgttagtaacagcgcagatcataatggcagtaatagcaacaataataacaacaataatgacatatctagtcccggtaatctgatgggatcttgcaatcaatgtagattaaagaaaacaaagtgcaactattttcccgacctaggcaactgtctcgaatgtgaaacgtcaagaactaaatgcaccttcagtattgctccaaattatttgaaaagaacgtcctctggggcaaacaataacatgccaacctcttcaaactccaaacgaatgaaaaattttgaagactattcgaatcgcttacccagtagcatgctctatagacatcaacagcagcagcaacagcaacagcagcaacagcgtatacaataccccagatcctcttttttcgtcggtccggcctcagttttcgatttgaacttgaccaagcatgtaagactagataatgttgaccaaatacagctatcaaaaactttatcattaagaaaggtgtctcctaccgcacagtttattcttcaggacgattttgacacgacccttcatagtaagcaagaatacgaagttgatttggtcgaaaatctggtacatccgcacggtcaccttttagtagagattttcttcaaattgattcatccttttcttccaattttacacgaacgtgtatttttggaaaagtattctagatcttatagagaactcactgcgcctttactggcatccatttactcactggcattacaatattgggattttcatcctgcacttttggggttccctaaacccgatgtaactgctcaactaaacaatatcgcattggaaacattttatgctcgagttggaaggccaaaattgagcattatacaaacaggccttttgattttgcaatgccgtagtgaatgtcataacaactgggtcctctgctccagcgtagtggcccttgcagaggaattggggctcggggttgaatgtaatgattggaaacttcccaaatgggaaaaagatttgagaaagagattagcgtgggcagtttggttgatggataaatggtgtgcattaaacgaaggtagacaatcccatttaattttaggtaggaactggatgatcaagctattaaactttgatgattttcctctgaattcgcccactattttaaattccttgcaaaatgaccagtcggggtcttcaccctcgtcatcaaatgatgtgaaaaaccatcagatagcatttggtaacttgcccatatttaacataaaccccactttagaagatttcaagaatggaacgcttatgtttcaacaaatggtttccttgagtataattcttggggaaatcatggacacattttacactcagggatccatgacaataaacaaaagcattgaacaggtattgaaactggcaaagccgttgcaactgaaattaagagaatggtaccattccctacccaagaatttgtcaatgagttatgccacgccacaaaaattgaactcaaattcaactttaactctagcttattttgccacggaaattacgttacataggaaaattatctgtgccttgaatcctcaaactccaaaggaactggttcaagtatgcaggactgctgcaagaaccaggcttgtagcagcaattgaatttataagagatctaaaaaacgaacatattaatgctttttggtataactgctcaactggaaatctgatgctaattggaacatttgctgccctgctgtatgtgacttcagctacgaaggaagaggctatgattttcagagattatgttagaaattatacctgggtattgaagataggttccaaatactttgataaactatcgaatgctttgaataatatgcatttactatttgcacaaattcctggtcttctgaccgatgaaccggtggtcgtgagccctaactctaacatcaattccgttaacccacaaaggtcaggtgtacaatcgcaaatcccaatacaatttaacgtgggatcacctgccatgaccgagcaaggatctcctttaaaccagtggaagaatttgccccaggaaatcttgcaacaactaaactcctttcccaacggtacgaccagtacaacaacgccagtaaaccccacttccagacaaacacaactagaatcgcagggaagtccagccataaatagtgctaataataatagcaacaacacgcctttaccatttgcgccaaataagtcttctaaaaaaacttcacaatcttcaccaaatgttacgccctctcatatgagcagacaccccccctctaatacatcttcaccaagagtcaattccagcacaaatgtcaactctaatacacaaatgaatgcttctcccttgacctcaattaacgaaaccagacaagagtcaggtgacgctgcagatgaaaaaacagcaggaagagaaagaaccgccaacgaggaatcatcaacggaactcaaggacgataatccaaactcgaaccaggaaacaagcgcaactggtaaccaaactataaaaatgaatgatgataaaaatgtaacaattaacacaagggaaacccctctgtaatataaataatagcacataagtaaaaatggaatacggtaataactatatagaaatatcttctgcaggaccaaggttactgagtggtgaatgtaaaattatttattcgcttgcgttatatttacatgtggtatatccggatgcatagagcctactatagaaattttgggattttatcatgttctttggcgatttcattcaaatcacctggttggttcatcatcatatggacatcaccacttaggtaaaccttttcatcttcttttttcgacttttctaaatcttttagaacattcaaatcagtgacaatcccttctttgttcttaacgccagcatctggagttttttcgattacttctttttttgcctcgtctattatactttgccagatctcttccaatgactcttccttaggaaccacaatatcagtctcatcttccttcatcccagttgcgttcttgccgacgattcctaaacgcaaattcacaagtttcaattcatcatctgcgtcgaagtctacctttccattattatcatgaaccctccgtatcagctctttcaatttatcaagttttagcttatatttcctttccatatcaataatgttccttttctcggctattactgcgtttaatatcgacccaaatatcattaccaaaagtaaaggtttgatcattgttttatcaaatcttgactttctcttaatgcccgcatttgctgatgcaacagttctagcggttatctttatgggagcaaggctccttaaaaatagaccatttcttaacacttgtcttgccataaacatttttccttacaccttttacgtatgacttgtctttccttgttgttactttttccctgctcattatatcacataagatgtaaattagaggatgcgtaaaatagttcaactgtgctacgccacatcagaataccgacaaccataaacagcggcgaagagaagacaaagcaatggcaagagcgttgagggatatatcattattcaatgatataagaaaggatcaaaattcggcaggagccaagcatgagagatataacatgagagatctccgaagtaagaagaaccagcatgtaaatggcatagatgattatgaagatgattcgcttgacagatttataagaaggaagaaatccagagttgtgaaatacattccatcattgtcagcgtataatgtgttcaatgaatttccttactatcctacgtcagccagtcagttactagacggcaaattagacgaatttctaatgctgtcagaacaatacaaaagtagattacccaaaatacgcaagctaggatggaatagattcaaaccaataggcattaataaaactatgtacgaattagaaatgctaaggtctcgagcacgagctcaaaacgcggaagggaacaatgaggaagacttcaggcagcacgattctagagaagaggatccaagaaacaatggctctataggacgcgtgatactgcctcatattctacaggaaaatgaagaatatgatactggtgagggtgttacaggattgcatagcatgccaaatgacagtatggccatacttgcgaataacagtgctaataattcgcaaaatgaggaagtatcagaggaggatgaaatatcatacgattatgatgcagagttcgatcatgttgtagatgaggatgataatgaggagggagaagtgccgggggaaggtgtggaaggtatagaagttcagagagagagaattgtgccggatgacttattaatgagacccacttcactgtcacgctccctacaacagtttgtggaagaggctcatcatttagatagaaacccatatgatattgacagtgataacgacggagaagattcaaaggtagaactggacatgaatccggattttgaagatgacgtgggaagagagcatgattataatagcgaatacagccaagagccgacttcttatggtgggattacacctgatctagcgagtaattggaggaattggactagggagaggataactagtttagatgaattaatggagagacgagccaggcagcaacgaggtcaagattagaaaaatgctctcctcagcaccaaaattcatctatctattaagatgtatacatacacaagtgcaccaaaagtgcttagtggtagttatatttgctgattatatctaagttatctatttactttctcggattcaaaattaaccatgttgggcaaagcagtggattgtaagggaaattgatccactttactagtttgcaggtggatagcggggatgacccacttaccacaactgcacctagatcctttccagttgtaaccgccaactttacttgaacagcctggacatgaaaacttcccttctaactcttgcttgccttgtagttcaggttgcatccattttaaaggttcgatgaaaaaatgagagcaatttgcttgtgactcttgaatatcaataatacgatgggagttggcggccctcttgatgaagtgtccctctgatgattccttacttggtgggtcatgcgcgatgaaagatgtagataacgccaatttggttctgcacttcttacatctcactgcggtgaccttgctcttctcagcttcagttaatttatccaagtcttgcgacgactccgaatctttaaacattccagaattggagaccaattcgctgcccgatggatctaacttgatagattgcttcagcttccactgcttataggctgggttgtcgaaatcgacaaaatctccacccattttctcaaagagatgtaattgttccatgaaattctcgtttggctcaacactcggtttcttcctcttgacagcgtgcatagccattgatagtgacaatccataacgatacattaggtaggctactatgaaggttacagatctcgagagtcctgcttgacaatgagcaaaaacagcaccacgttgtggtttcttcttgaaatctactaatctgggcgaatactcaacttcattggggaacaagcattgatcaatgaatcggttcgtttcatcgaagtattgcagcacatcagtcacatcatcatcatcgatgggtatgttttttagcgtgtaacctttccttattagatactctggaatgacctggaatttgataacagaaagaatatgagtaatgttaaattctgcacccaatggtctgtggtcaataattggacggattccgccaagatatatgcctcctaatatcctggtaacttcctcgtctactgagtttgcatttccagccatcttccctgtaatttcttgctgcttttactgctttctctgcgttatacctgtattagatgcattcgatgagctgaggtataattttttttttcagttagatttcttttttttagcgctaagaaaatttcaaaattgcagccgtggagacccagatggatatattgtagatcattaaaagttgtgtcatctcaaactaagagtggttaatatatgtatgtgtgtaaataactttttataaatttgtttcttttatttctatagaatttctttaataaaaatttgcaactttagtttaacgtctagaatcaagcaaagtttgacccaatggtgttttcgagactccgttggcattcgtatataccacctggcctcttaatatggttttcaaaactgtgcccttgaccgtcatcccgttgtaggcagtcaatttgtttttgaagtagacacttgaattacttattttatgtttacttgcagtatcaaataccaccaaatcagcatcgtacccgggagctatagtgcctttttggtgagatagtcctacctgatgggatgtatttttacagcaccatgtaacgatatcgaccaaagagcagccttgggtaaacatcaatggcaaacctagtccgacggaagcgattcctccccaagaatcgaaaaagtcacctttttgcaagttcttcaactcaggggtgcatggcgaatggtcgctcactactgagcctataacaccttcacgcaaagcgtcccataggccttggcgattagactcagagcggatgggtggacaacatttaaagtaggtggctccgtctgggatctgctctgcagcaatacacaaatagtggaaacaagtctctgttgtgactggtagccctgacgcacgtgcctttctgatcaagggaattgctttcattgatgccagatgaactatatgtacaggaggaactggtccatttctggctctcaagcattcgagaatcaaattgatggcgtctatttcgaaagaatccggcctcgaggacaaaaacgaagaatattcacgatggctttgctcgggttgctgttggtcctcatgtgccttgggcaactcagcatgaaacatcatcatggtatcctcctcggctaagaccttcaaggcttcttctatatattctttgccaattggagggaattcttccacaccagaatcaagcaagaatcctttgaacccgcgaacgccagctttgacaagcggaattaagtctggcaagttgtgtggtaccagtccaccccaaaacccaacatcgcaccacatttggccctcagcagcttccaatttaattcggaaattctccacatttgttgtgggaggaatagcatttagcggcatatcaaccaccgttgtgaccccgccactaatagcagcttgagttccagtttcgaatccttcccagctagtcctaccgggctcgttcaagtgaacatgagagtccacaagtccaggcagaattgtacatggagatacgttctccagcgtatgtatttcatatttggttatctcagttttctccataaccacggagccttctaaaacatccagaatcgtgcctgattcggtcgaatacacaatagtcgcaggtttatttgcaccattgataatgacatggtcggaagtgatggcattgataggcatctttgttcttcgcagtatttcactttttttttgcctatacgtttttgcgaaatatacacttttctaacctaattaaagatagctaaaagaaaaaggggtaccttcaattacaagataccagtagaaactcatcacttttgcgttacctcatcattgtccccttcgatgagatatgcctcctctatatagataattaagcaccgcaattttgaaccacttctcctgataaagttccatcagtccaccatcaacacatttgcgcctattcgatgatccgcagtaagggacaatagaatcgaaacatgcagttcctttctttcctgcaattctcgggtctaatgtggctcgagggtatctcttatcggtattactttcttatcaatgaaaaatttctgccagggaaaatgcgcccgctttttttccggccatccttactcgctgtcgcatacaaaatagcgcctctaatctagttgcgataaggaatgtgtatgtgtaattgaagatccaggatgttttccttttcagggagatgagaaggaataataggatggattgaccgctttgctgtcacgtcgataaggttcctttaaaaattgtgtccaatgattagcatagagaggtagagtatcagagaaacaagtttgtaatcgagaaacttgatctgctagtgttgagcatagaaggctaggaaaacatggggaagaaaaaaaaagtataaataattagcttgatgagtagtttgaatatatatgttactttagtttccctttttgaccttttatattcatctacatcttgtgatataaaacatcaacaaagacgagaatggctaacgacgctctaagtgctattttcagtaatccttcgaggaaaggtgtccaaccctccacatctattgtgtcatatacaaacaatgaagatgatattatagatgtggaaaatgggaagttcaacaagaacaagaatatcaacactaatgtgtatgtggacaactcctcaatagaggagagcgaagtcgtgcccttgcccgaaacaaagtccatctggagtaaaatatactacgatttcattgtgttagacaagacaactttgaatgtttcgttgaaagagtcgttcttgtataacagagacttgaaaccggttgaagaagaaagaaggtgttggtcctggttcaattacttatatttctggctggcagactgtttcaatattaacacatggcaaatagctggtacaggtctacaactaggtctgaattggtggcaatgttggcttacagtttggatcggctacacttttgcaggtatcttcgtagtattgaactcgagatttggttccgcatatcacttatctttccctattactgttagggcctcatttggtatattcttttctatgtggccgattataaatcgtgtcgtgatggctatagtatggtatgccgtgcaagcctggttaggtgcaacgcccgtggcactgatgctaaaatctatttttggcaagaatctggaagatagaatcccaaaccattttggttctccaaatagcactacttttgaattcatgtgtttctttatattttgggtggtcagtataccatttgtcctagtggctcctcataaaatcaggcatttattcacagtaaaagcagctttgatccccttcgcagcctttggatttttaatctgggctttgaagaaatcgcacggtaaaattgagttggggacgctgaatgattattcacctcatggttccgaattttcatggatattcgttagatccctaatggcctgtgttgctaactttgccgctttgattatcaacgcccctgacttcggtagatttgccaaaaatcctcaagcgtctttgtggccacaattggttgccatcccattgttcttcgccataacatgtttgatcggtatcattgttactgcggccggttatcacttatatggggttaactattggtcaccactggatgtacttggtcaatttttggagaccacttacaccagaggtactagggctggtgtgttcttgatttcttttgtatttgccttagctcaactgggtacaaacatttctgccaactctctggcatgtggtgctgatatgacggctttgtttccaagatatattaatattagaagaggttctttattctgtgtggcaatggctctatgtatctgtccatggaacttaatggccagttcaagtaagttcaccagcgctttgggtgcttatgcaattttcctttccagtattgctggtgtcatttgcgcggattatttcgtagtaagaagaggatatgtgaaattaacacatttattcctggcacagaagggttccttttacatgtttggaaacaaatttggtgccaattggagggcctttgttgcgtatatttgcggtatcgctccaaatttaccaggttttataggtgatgttggagctccaaaaattacggtttcagagggtgcaatgaggttatactatttaggttatccggtaggtttctttattagtgcggtgatatacctcatattatgttacttttttcctgtccctggtactcccgtaaccaattttctgacagagaaaggatggttccaaagatgggcttatgttgaggacttcgagcaagattggaagaatgagttacgtagggatgacctctgcgatgacacagtcagtatctatgatggcaccgaggaaaagatagtttactaaataaaaatcccaatttattctcttaccagtagtgatcaggagaattgataatttcttcaaaacaccttaatattcgttctgtgtatttttatgtacctttcttaatcaaatttatcagcttcatacatgcattcccgtctgaataatgtactgatgattagctaaaccgtcatcaacctaccaaacttgcgcttgtttgagcctatcagaactccggataattccgacatcttatctttgactcgaattagcgataagataaaaacacaggaaccacaatgaaattcagctggaagaaaagtctaaattatagacacattttctgagatcaaatgctataaaggaatggaagtgcattttgctatgatatggggaaattatgaagccgatcaaacaattaattgtatctaatcggtctcttctttagaaaaatgaagttttttagtttggcagatgaggcagaatttaagtcaataatcatttcaaaaaacaaagcagtagatgttataggatctaagttaggtggtcaagtggtttctttttcagatgaatggtttgcttctgctgaaaatttaattcagccaactgctcctataagggatcctaccagatttgttcattcaggcgcatggtacgacggctgggaaacacgaagacataatgagatggaatacgattgggttatcatcaagatgggagtcgctgctgcccatattattggtggtgaaattgacactgcgtttttcaatggtaatcatgcaccatttgtatcaatagaggcgctctatgacgagggcgaagaaggtaatatagtggaagatgactcgcgttgggttgagattgttgagaaatttgagtgtggtccttcgcaaaggcatcttttcgttagaggcaacggccttactaaagaaaggtttactcacatcaagctgaagatgtaccccgatggaggaatcgccagatttagattatacggaagagttgttcctccagaactcaaaacgaaggatcatataattgacttggcttatgtttgcaatggtgctgtcgctttaaagtattctgaccaacacttcggttcagttgataatttgctactgccaggtcgaggtcatgatatgtcggacggctgggaaaccaaaagatcgagacaaccaggtcatactgattgggcggtaattcaactgggcagggagtcttctttcattgagaagattattgttgatacggcacacttcagggggaacttccctcagttcattaccgtggaaggttgcttgaaggagtcagaatcaagtgagaacactggtgaaggaacatgggtagagctagttggtaagtcaaagacggggcctgacaaagaacatgtgtatgaaatacgtaagagtataagagtctcccatgtcaaattaacgattattccagatggaggagtgaaaagaataagagtttgggggtactgataaatacttaactactgtatattttaaaccaatgcactcttggcactttaaaagtaaaggtataaatgtagttaaaagtttttgttttgataattgaatgttttcatttcgctatccccacgctactttatttacttcttcttcttcacgacaaaacattaaaatttacactctataaaaaacaatcatatttctatttatttttgtgagttgacaaatcttatcatagtgattagaatctgtaaaccgatctcaatcgtgtccagaaacagcgtgccatccctttggaatgttttcgccagtttattttgcaaacccgagaatcctgcacaacctaatattacaatgtctgaatcaagctttttaatattttcgcgatatataatttctgctatctgctggaaattttctggactatgtaggtcgaggacctgtaaatcagtagataccgtacctttccataaatttttgttaactgtattccctgtcaagaatttcgattccacagagttattcaatattggaatccattctttatttgaagtaataatagagaacttctttccaaccaaattgcaataattaatactactatctaataacccaacaatagaaacatctgctttttctttagcagctctatcctttatctttgctaccaaaggatgatctgaaaaacaggcaattaatatcccgttgaatttctgaaagtaatataccgactcctggtcatcaattaagaggggaagacaggcctccatacttttaatacttgtttcctgcccatcaatttgtggtggcgacgtgtctggccctgtgaaataactgattttacatgattccattgaaaaagtcttttcaatggtttcccgcaaggacaccgtcattgacttcgaactattaggattcacaacaagtattcttgtttccatcgttcgataatttgcttagctagtttttctttgttcttttgattttcctgaggtaagaattagtaattcagtttccttacatattctcgcttcaaaggcttaaatatgatctggcatggagaaaaaatatgagttcaatttgtcataccttatcaggccttatcagctcaaatttgattggattatgcgttaaaacagcgcctaaaattcttcgaatattcgtcaggttatgtacgtatacattctataatttacttaagtcaactggtttggcacttggcttaataatttcatcatacaataaagtggtcaagaagtcgctaaagattttaccagtgacttcaggcaaaaaatacttggctgccaaggcaaacttgttcttttcacccagcggacttgctgaagccaattttgcagtctcttcatttaatatcttagcggtcaattctggagttactttgtcaccggtatcacttaagacaacaccatgtttaacccactggtacaattgacaacgtgatacttccgcagtagcggcatcttccatcaaatgattaattgggacacaaccagatccccttaaccaagcctccatatattgtaggccaatatccaagtttactctgattccctcagtagtgacttgagcatcttgaatcttcgtattcaataaatcagatgatgtaacatgtacatccgggacaaaatatatttgatttgctgtacccatgttactgaaaacttcattacaaatcggtgccaatgctgggtgtgctacccatgacccatcatgcccattcttcatttctctaattttgtcattacgaactttgttcattgcagcttcattagcctttggatcatcttttatggggatttgggcagccataccacccatcgcatggacccctctacggtgacatgtattgatcaatcttttcacataagcatccataaaaggtgaagtcatagtcactagatccctatttggcaaaacgtgttcaggcaagtttctcagttttttaatggtcgaaaatatgtagtcccaacgaccacagttcaaaccgcttgaatgttctcttatttgatagataatctcctccatttggaaggccgctggcaaagtttcaatcagaacagtggccctaatggtaccgcggggcattccaataaaatcttgtgcaacacagaatatgtcattccatagttttacctccatatggtgctccatctttggtaagtaaaaataaggtcctttaccaattttaactaactctttagcgttatggtaaaaatataaaccaaaatcgaagatggaagcactaatcggttcatcatctatgtaaaggtgcttctccaccatgtgccagccacgaggtctgacaattaaagtgggcagtcttgaaatgtcatccttcaacctgtactcctttcttggtgtcttgaaatcgatttgatttctaatggcatcataaagattaacttgtccgtaaatcatgttctcccaagttggagatgaagagtcctcgaaatcagtcatatatgtcgttacttcagcattcaaagcgttgactaacatatttctcaatggtggcccagtaatctcgctggatctgttgatcaaaccaggggctgggatagcaccttgccatgtaggatcgttcctgatttgttcggtttccggcaagaaatcaaatcggtattcaccagagtctaactttgattgtaaattgcttctgttggctaaaagctgtttccgtgttgaattgaaagttctatgcagcaaaacaatgaactctaaggcatcttttgttaaaatatcagctacagtagttttggaaggttcaaattgaggagtcgtgtcgatgtctgcgtatagagcagtgttgtccaagcttatcttcaccattgttcagtgctctttaccgtgcctatgacacatactctaagtgatatcaactgcacagaaagtgaagaattaagactacatgcgtaaatgtccccattttatacttattgcttcaccaattgacgaaactatccaatctttgtgatactttcacgatgtaccttatccaagataagccaaaacttatgaaattcaatttatgtgataagaaaagcaaacgcaattttccaaaatccgcggtattctatcgcaccgcaactttcagcggagattttatgtcgataatcgtaaacctatgaaattactaatacatgaacatttacatatttacttcgcccacagtcgcagaattagatgataatacaaacgtcgccatcgctgtagtgttcttccacacagtccttctcgggcctgtcagggtccagactttcgtagattaagactgaaaaatccaaatgttcttccttgccaagtactatcatgggcgcatgccaggtacctaagccataggtaacggcctgattacccaaacatgtaaaagccctcaacgtagacaagtctggcttatttccaatttctttagcgactactaccaagtatgctacttccgctgacgttctccccataggcacaaacgtctgcgtactacacggatgcttttcgaggactttgatagaatgagaaatcgcctgattggagccttgagtgaatactctattcaggtgcggctgtggaaagcaacggaataggttccaattgggaactttactggtagatttattctctacctggcttacttgaagcaatttgatcgctgttccctggtttgcacctttttcaaggttttgcatccttgaaatctcttcatctggcgaaattatcgtcccatactcctcgaaggactctttcgtcaatgtctccgccaccacggtcaccatatctttgcttcaaagattttttgccctacaagataagcatcaagagcgattggatgacagttactgacttatatatgcgaatgcacatgaatagaccgcatatgcttcttatcagtcttacctcgcttatctttccccatttatttgccaatccatcttatcttatctggcactttgtctcagggttagtgttacaaaaaggctaggacttatttccaaaattctacttttgaaaataaccctaacaataaaagcaagggcattctgatgttaccctagaaatgtcgtatttctttttatatcgtggatcatgacaaaaaactcaacattttcaaatgggtgagctctaaaccagaaaatacagccgccgaaagccttttaaaaggacagcggcgcttgatcaacagtcgttcttggggtcgttaagactagatcctgcttcccccccttattgtgcatttaaaggcacttattgaaggtcattttggcgaacagaacatttcgttatgcagcagaacagtgagttcttaacggaaacacctggaagcgaccctcatatatctcaattgcacgcgaatagcgtaatggaatcacagctcttggacgatttcctcctgaacgggtctcccatgtaccaggatgatagcatggcgcatattaatattgatgagggtgctaatttccaaaattttatcaagacagatgagggtgattcgcccaacctgttgtctttcgaaggtatcggtaacaatactcatgtcaaccaaaacgtgtccactccactggaggaggaaatggaaagtaacagagccttgaaggaggaagaagaggacgagcatgaaaataaggtttttaatgaaaaaaatataggcaaccctgctcatgacgagattgtatttggaagaaaggagacgattcaatctgtttacataaatcctttagattaccttaaagtgaacgcagcgcagctacctttggatgtagaggtctcaggtttgccacaagtatctagagtggaaaatcaactgaaactgaaagtgaaaattacgtctgaaacaccactaaaccaaagcatgctttacttgcctagcgattccatttcaagagaaaagttttatttaaaaaaaaatatcgaggatttttcagaagacttcaagaaaaatcttctgtacatcaatgcgtttgttctatgtgcggtcagcaacagaacgacaaatgtttgtaccaagtgtgttaagcgagaacaaagaagagccgctagaaggaaatcaggtattgcagacaatttactctggtgtaataatattaatagaaggttagtcgtgttcaataacaaacaggttttccccataatgaaaactttcgataatgttaaggagtttgaattaactaccaggctagtttgttattgcaggcaccataaggcaaataatggctttgtcatattattcactataacagattggcaaaatagactgttgggtaagtttacgacaacacctattatgatcacggatagaaaaccagcaaatatggataccaccaagtttaataacactactacctcgtccagaaggcagctaacggaagaagaatctaccacagaatattattcaacggataacaaccaattgagcaaagacgaaaatatgccatttcaatatacttatcaacacaacccatatgataatgacagtcaaatgaataatattccactgaaagacaaaaacgtaccattcccatattccatctctcaacagacagatttgcttcagaacaataacttatcactgaacctttctctgcccaatcagcatattccatcaccaacatctatgagcgaagaaggctcagaatcatttaactatcatcatcgcgataatgacaatcccgtccgtactatctctttgacaaatattgaacaacagagtcaattgaaccaacggaaaagagcacgcaataatttggaaaatgacattggtaaacccctattcaagcattccttttcaaattcaatcagtgcaacaaatacgatgaatccagctttacattcaatgcaagatttctcaatgaaaaacaacaacaataatttgccatcaattaatcgcgttataccttcacaaggcccaatcaatggtggtatcgaagttacattactgggttgtaacttcaaagatggtctttctgtaaagttcggctctaatcttgccctttctacgcaatgctggagtgagaccacgatcgtcacttatctccctcccgctgcctacgcgggtcaagttttcgtctctattactgatacgaataatgaaaataataacgatgaccttccccaagaaattgagatcaatgacaataaaaaggccatatttacctatgttgatgatactgataggcaactgattgaattggctttgcaaattgtgggattaaaaatgaatggtaagttagaagatgcaagaaatatcgcgaagaggattgttggcaatgattctcctgatagcggtacaaatggcaacagctgttcaaaaagcacaggtccctctccaaaccaacacagtatgaatctgaacacaagtgttctttactccgatgaagtcttgatacaaaaagttataaaatcattgaacataaattccaatatttccatatgtgattcattagggagaactttattacatcttgcctgtttgaaaaattactcaagccttgtgtatacattgattaaaaagggtgctcgtgttaacgatattgattcctttgggctaactccattacattttgcttgcataagtggtgaccctaaaattattaagatgcttttaaattgtaaagtaaattattcactgaggtcacacaacggattaactgcaagagaagtattcatagcaaaccacattcattcaaaggaaatagacaaaaaacaagataacagagacaaccataagtttgttcataatgacacttatatcagcgaagtattgtcattgtttgaagaattccaaaacggtacgaagtttaccgatagtgtagaaacagacagtaattattctattagcaggaaatattcacaatccagtttcaattcaagcctgctagacaatgaatctttgaatgagaacttattcgaaagccaaagcatgataaatcccacttctatggagattcagcatccaaccttgcaactatttgagaattcaagttactctgagtacgaccaaagtgatttcgaagaagacggggatgaagatctgttcgtcactgacgaagtagaaaaaccaggtgttgcatgcagggaggaacaaagcgaactccttgatattggatctagcgccaacgaacccgaagaggataatggtagtacatctctctggaatagagttttacatcgaattaatgatgacttaccaaaatatgaggatctgttcccgttgtcttggggtaaagatgataaattgaaaaccacaaatcaagacagtattgtggagcagtcagcatctaatattgaaaactctgaaaattcggaggaagaggattatgaggaagaggaagaatttttgaaaaaacagtttaacagattcttccaaaacaaacaaaacttccgaaatgataaaatgttaatatttttctggatacccttaacactactacttttgacatggttcatcatgtacaaatttggcaaccaagatagttccatcaatcatataagcgaattaatctcagagtacttgagaattgcattagcaaagttcttgctgggaaatgaaaggatgaaaactgcattcaggtcaaaattatcaaacctgcaaacaacaagaatgttgaacgatttaattgtcagttagtctgcttttttacgtatatatatatatatatgtgtgtataatgaaaagacagtacacttaaaagaagagaaagtcatttaaaaaaagtcaaaaaaaaattaaacttgtaaatgtcagcgtaacgataatgtatatactttaaatgtaaactacaatcttgaagatcttttaacacgagcgcaatgtctatcgaacaatttcttggctctaacccagacaggagcagtttttctttgaggtaggagctctaaagatggtaagagatcatgagagaaaaattctgaagcttctcttggcagcaaagaaggcaagtgatcaatagagatgacagataatttaggcccggcagtggtaggtaccagaacggtaggtttgttaaacacagtagccacagtgtatattgggatggggttgtgagggttggtagtgtctgctgatacgtccaccacggtccttagtcttctgttaggattattcagtttctccatgttagtgaaaggagcaattggcttcgatagatatatacaattgataaaaatatcagcttgtggaatttcgtcaaagggaccaccacgggaagtttctttgatatcccattttaatatgttagcatctggaataccaactttgtgcaacagatcgatggcaccggaaccacatcttcctagcgcaccaatgattaacacggttggctttctggctccggtggctaaggcttctttataatctttggtaacatctttaaccaatgccttttcattggggtaaggcgacactgcaggcaagtcttcatcgtcagaatgcgtttgcttgaatgcccagtctcttacaccaagggctgcacctgcgaacccagcgtaaaatccaaaggcagcaactcttctaccttggtcattttccaaaaattccaaatcatatagagtaccgtgtcccttaataaatctcataaggacattttgccacccagcttggtctttgtagcagtgagcaaactggatgtgttcgtggactagagggaaagtatcggtttcaggcatttccttcaaacctataatgattctgtcgcgtggagcggttttccatgaacctgcaggcactataatggcacctgcttgacgatattcgttaatattgaaagtagattgtggactgtcctctacatatattttgaagcccttagctatcagttttttaaccgtggtaggtgttaaggcagcacgtgcctctaggggtttagtttcagctcttagatgtaatgtgacggcagccatttttgcggttgtgtgaaaaataaagcgttttcgttgttatcttatggtatgcctcctaaaataccagtttccgtcagggaagatgggctttttatatatttcatcgtggtttctcgaggatgactttatgactctttgtcgctgaaatcgcaggggaattttggcggttgagagcggaattccaaattccgctggaaaaaaaaaataataatgcaaaatgtataaatgtataagagtcttttttgactcatcgacttagtatgtaacaatttatatgtacctgctatcctcaaggcataaagtccgccaaggcagggtcattatagctcaagtactgtccattaacaccgtcaggaataccatgaagggccaatttggcataaactgtagctggcacagagctatccagcaactggttattctcctttaaacctctaaacatcttcaattgctctgcactcatggaggaaggccccacgttctccctaatgttaacttgcatatctgtgtccacaatacctggggcgacggcaatggctttcacttgcctttcctcgttggccagagtcatggcgaagtggttcagagcggcttttgaagaaccgtaagctccccaactgctgaagtacatgttacaggcgtccgaactgacgaataccacgttaccgttggtcttcttcaattcaggtaacgcaatgccaaccaaggaaacaatgctgaagaagttgatgtcatacagcttcttccaagcgttgacatcaatctcgttgacattttgcacgggctctaggacaccagcgttggcaaccaaggagtcgatcttgccgtggcccttaacagcagcgttaaccaactgcttcaacacggaatcctcggtaatatcaccgacaacgtaaaaaaacctgtcgccatacttctctttcaacttcttcaagggtgcctcagacctggctacaccgtaaacaaccgtgtccttgtccaaactgaaaagaacatccacgatggacttaccgatacctctggaaacacctgtaactaaaataactttacccatgtttttttaacctgttacacgctgtagttagacccttttttttaggtacaatattcttccattgcacttgatctttttcgtttacgtatatatatgcaaaagttaatgttcatactgtcttctcttcatttctttgaaaacaccgcggaattccttcggtgatacattcaatccggttcttggcacagaaatggccgcacaaaactgtcgctcatcgcaaacccaataaaagtttagtagctaaaaactataactatacccttttacataatatagtttagtactagccctgcaccggccccagtcgctcatcgttgtagcggagatattgaccgttcaaagagtcgggaatacctttcaggacgagttgcgctagtaccgccgcaggcacctttgggtccagcagtgacgaagtcttgtacaattgagtaaacctctcgagagccttgggtgtcatgccctgaggacccaatgtttccctaatatctttctgcatctgcgtgtcaacgacgcccggtgcaatacacacggcacgcactttatcactgggctcttcactggcaatgtccatggcaaagtggtttaatgcggctttcgagcagccgtacgccgaccatccgttatatggtttcacactggctccagagctgacgaagacaatgttgcctacaaatggcgagctcttcaagaggggtaaacacagtgccaccaaagagacaatgctgaaaaagttcacatcgaacagccgttcccactgcttgatgtcgtgttcggagttggactgggagatggacttcaccggttctagcatccccgcatttgcgacaataccgtccagttttccatgcttttgccggatttcctccaccaacgcttccattcgagacctgtccgtgatgtcgaggacacgatagacaaatttgtctgcaccgtattctctttgcaaagactgcagaccagcttccgttcttgctacgccgtagacgatgcattcatcgtcctcttcgataacagttttcaccaattgcaggccaatcccacgggaggcacctgtaatcaaaataaccttgcccatatcccttctttgacagattataagttgtttctcttgttgctgttcgcgacagcccttatttcctgtattccttcttctttttctgcattatcgtttttagccactttacgaaaaaggtcaaaaagtgaaaaaaagagggaaaaaaccatgaggaacagtatgctcccttaatatcggaaaagcaatagtaataaaaacagcatcagagctttccacgtctctctcttccaagctgtcatctcgtaaagtattcaagtttatcatgtcagaattctataagctagcacctgttgacaagaaaggccaaccattccccttcgaccaattaaagggaaaagtggtgcttatcgttaatgttgcctccaaatgtggattcactcctcaatacaaagaactagaggccttgtacaaacgttataaggacgaaggatttaccatcatcgggttcccatgcaaccagtttggccaccaagaacctggctctgatgaagaaattgcccagttctgccaactgaactatggcgtgactttccccattatgaaaaaaattgacgttaatggtggcaatgaggaccctgtttacaagtttttgaagagccaaaaatccggtatgttgggcttgagaggtatcaaatggaattttgaaaaattcttagtcgataaaaagggtaaagtgtacgaaagatactcttcactaaccaaaccttcttcgttgtccgaaaccatcgaagaacttttgaaagaggtggaataggcaggtcttcttcttttgaagttaggtaaagcttagttttcttttatatttcctgataatacatactcgctagtcaaacctgtcaattattatgtgtcgcaacagactatatacgtatacatacatatgtattgaagtgtgtgaacgaattacgcggctgctagtgccgtacgaacgcaacaaaacggtttagaaattgctacctaaagcacgcgccttttccttagaagcagcatacgactcctctgaggttatggtctttaaccatttggaaatggcaggataatcctctggtgcggcaaactttctttcaaacgccatctgcaaagggaaagacatcaagatatcggcaccgctcaacttcccatcaaccaggtagccgttatttttggaaatttcaccctccacaaagtcgaactggttcttaacttcaccactagagtatgcctgactgatcttgtctgccacttttcttgccaagtacgaaatagggaagggcataccagaatccttcacctttgaaagaatgaactcaatcattaaaggtggttgcaaggaaccttctacataaaacagataatagttaatctggtctgcaatatcagcatcttcgctcattaaaacgtgtgaatgatcaaaatgctgcaagacatattggaagatgaaaccggactcggcaagtatcttcttcttaccagtttctctgtcttgaacttctaacaatggagatcttcctaatgggtgaattttctttaattctggtggagcacggaagttagcatctcttttataagggacaatttcatattcaaggttcaaatggtctaataaccacaaaagtctgaacgctctggaatggtccaaccaatggactttgataattggcaacgacataatgcttccttgatttaccttttccctctcattttaggttgttgtaaaaaatatcaacgatcgttttatatataaggattctgccatagtatttcaacgttatccacttcccctaaattttcaccatactggagcgagcgggtacgaggtgaaaatcattagtaaatggccgtagcatgaaaagtgcgattgtcatagtaacaaggaggggcttatccttggctattgcgaggcaccccctctgttgctaacggaggttgtaactgccggtggtggttttcctattaggctagccttggcatacagatcacccttagggcccactttggtgtgagcttgaggtgcttaactttgtcaatacaagacgggctgggctaagccttgtaaaaatcctcatttgagcaatgtactagttataagcgcaataggtgttttttggacaccctgtttccgtaatatgtcctcccccaagggagcttacactcttgagtaaagtcttcttcaaaaaagtaaggtcaaaccccgaaactgaacgccatgcatttcccccagccagatgtatgttactatcaaagatcttatccatgcaatgtcaagttaccgtatagaaccgatgacgcactgctccgtgcccatgaactgcattttaccgacggtatttggctaaagaagagaggagctgattcaatacaaactgttcgtaaacaattacgattctaaggatactagaagcagcagcggaatgaatagacggtaaccttacaagagaataagtacggttgcactagtaatatatatagaaagtgaaagctggcctgttttctttaccgtcacctgcgcagtgcgagccaagaaaaaaataaaatgatacaaggaaaaaaaaaagttgagcaggaagcaactttatttgctcaggatggtaggctataacttttcttgcagtagtaattacaatggtggtcacttcattgaaaacagcttctagtacgataagtggccggcgttggacatgaacaatatctgcgatattatacctaccaaatccgaggttaagcttcccgccttagaccgtagctgcaatgattcaaatcaacaatgtcgcttccgtaaacctctcgttatatatggtaataatattagcgattacttacgtatcttctaccagtaagcaaagcaaattctccatattctaattgtattgaccacggctgtaaaattaactaagccactcattcttggatggttctatctgacacttgtctgtatgaaagtattactgattagctctactttaatcaatatgagaaggaacacacggctaaaaccattctgcgtacttattaatacttctcaggaataattgaagcgatgcagtgtaatctgcggtaagagcattaatctttagtaaatatattggttgagaaaagcgaagcttatcgcgtgtcatcgtgcatagcactgattaaaaacataattgcccatgcactagcgaaatgagcccagtccttaatccatacgtggtcgtgctttactgaatatcagaagatgcaaaggctcttttcaattatctagtacattgaacttaggaatgtggggaaactgaaggtcaaggaaaaaattagcgccatatgttggtatgatgtcaatagcagtagaaaaatatatagacaagaaagacgggggagtaagaagttctgctcgagggtatgggaaaccacaacaaggtacaatattcttacataacgttattattatttctttctccatttttcattatcaatccttgaatttcagctccaactaaatctgatgaccgtctctcactttctatatcgttctctacacagtatattataatataccaataacacgaactccagtcagtagatcgttgccgatcttcattctaacaagacaagagatgaaagtattacaacagaaagatggcacttgtacttattaaagtagaagtggatgtattagtcctggatatgctttatttttgaagcataagaacaataagaacatcttcttagccggctgaataatcgctgataattcgattttaaaaagaaaagtacatcgaaaattatgtgctaaacaagatattaaacttttcttctttcgattgcaccaatctgagggagcaattcataaatggctgaaaagaaaaagaaatggtttgtgctttcgattagttgcttttacaaaattcttgtccttggtttgaaaggtcaacgggtatgaggacggagttggaacgtggtaaaaaacgttcatatttgcctacctgtcaaataagcatacagcgatagcgacatttcccctttagttggcgcacatattttactaggttagagagaatgtatgagaaagaaactaaaatttgaagcaagaaggtaccataaaaaacctaatatatgtctatttttggaagtattttttgtgcaaacggcacgctattgagagaaaataaagaaatgttcgtacttacttccattaagaacaatatcaacgtgcttaaccggctagaaactgcggaggaaaatacgtgggggtataaactgttctgggacgattgtgtcaggcacagagtcttctagaagaaatgagggaaatcaatttggaaaaacggcaacagtatttgtaagcgctttccagtaaaataacgaaaaagagaaacttcagtaccactatttatgaaggcacaccaaactttttgtttttacgagcggcaatgacatcaagaatggaccctataacacgaaacattgtctaaaaaaactttttgcctttttttttttcactggttttcaggcacattttaaaatttacataatttcttctagaaaaagtttaaaaagctatattttgcctgaatagcctggaacattcaaggcaccaggaaccatgaattaagattatagactttttgactgcaaaaagcggttcatatgacggattacgagatgtccgttcgctttgtgtcgagcttacgaagattgacgtaaccttcgtttaggttcgaggtgtgaggtgcattacatcatgaaagagtattattacagcatatgacatgtttcagtagagcaaagagagaaggaaaaggaccagatgaaatgtctggccaggccttcaataagcaaactgagtggaacatgtttgcccagtccttccgtttaggcatgcttatataacgctgcatgttgagggttttttatgtatttttagcagggtatccgaggatttaggtcatgaaagttttctacttcttcctcatctcgagagctaggtaagagtctcgatttcattatggcaatcttgataaatacactggaagcaaagtgttttcttaaaaagaagaaattaccgtgttcttgtgttacccaaaaatactccaggatctcttaccatacatagaaagcattcggaaaaatgttgaaatcggttagccaagaatatcgataatatgtcgcagtagaagttaaagacagataggagaagcttggtataacacatgtatgacagtaactttagttcttaacgtacaacgattgatatctcatagattgaatacggggagagaaacacaagagagccccattttggatgccaaagaaaaggataatggcagccatagagcctttgtcgcccctataccgttcgtgcacgaatagatgatttacaacgtcctcctaaacatcataatagactcaatgaaggccgttacagtgacgcggcgtctgaatcattgaacctataagtttgctcccactttcttggcaaaaagtctggtgttttcgaaagaaaattttgctgttcatttcttgaaatgaatcggcttaccaaattcataccagcagtggtcatcttacctaagatttctcttcacattttcacgcaatatcttcaacagaatttgaaggacaatctcatatctggataactctgtttattttgcttttattttatactttaatgctgtgagtgttttatgccgctaaatactgttctctgtatatgccaaacgttcttgataaaaccgtcaaccgataataacaatgtaggagaggccttttaacaaaattgaacgggttgtaatgaggattaagaacttttttagttttgttttgatgtacgcccggatttgctcacctcttcattctggctacgtctcctatttacttttcagggctagtgcagtatcattgagtccattgaagaagaaaaagcctcaataataccaagagtactttcgatcaagcggattctcaaaaaaatttccactgttactatttttttattttggagagtgaaaatgaaataataatgaatgcaaatcctccatagttcgtcaaaatatcatattttcaaaaccttccatctttttctcaaacctctatgattgagtatgagttatccagtaccagcgcccatcacgataccttaaatagtaagagacaacggcaaattattaaagattacaaaataactcgagagtagcgcatctaactgactttgatcaaggttgccactattcaaattgatgctactctattcaaacagtggttctgagctcaatacggtcaaaccttgtgtaagaagaagaatgtcaaggaaaaagaaactcttagtgctaaaagaaattgggctgctagagctgcttctgccaagatcaaatctcacatgtttatcattcatgagcaccggtggtttctttataaactgtttcagccacatatcatctgggcacaccgaaaacttgttagttttaactgatgatacctcctgtttgaagttcatttatccttcatatcactggtaaagcgaactcttcttcgacgtcaaagatcagtaaattcttgataaacggatagttagagtgatattttttatctaaaacgcccctttttgaattaattcaaacatttgatttactgtacctggtttggcaacaactttattacctaaacaagaaatagcaaaatgacgaataatatcagccgctgttacaacaaacttacagtaccatgttttcgtaagggtaataatattatctgtacggaatacatattggcggaaaaagcacagtccagctcgcgagatatgcaatattctcaaacagacatatattgttgccctctttttaaccgtctattgataaagtaattgtgcttctctctaaatagcgggcacttccattatatatatattttccagaaattttgagtggcgtatctcttacatactactaacactaatcctggattcttacaccaatttatagcgttatacagttcaattgagtataatgaatcatagactttattataaaagtagttttaacaagaggaatgttaatagttcatataattgattattagcagaaaagattcacctaaaagatgtaggggcaggtaatcaaaccgatgttatctaaaaaaaaaagacatataattaacttcgttaaattagaaaatgcggatgtttctttgcgtcatagtgtggacttgatagaacaatacctcaagctacctttgcattgagtatgacgtattatgtaggatatatgtggcgagtgattagatagatttttttagctgcacttaaaaacagtcagggctgggcggcaaagtggaaggtaagtaaagaaaaaatggtaagataaggaagccgcgatggagaagatgaaacattcactgctttttagcactgtgttattcttcttgttagcttatttgacaatattcgccattgcgttggccctggggaaaaagtgtgcacttataaggtcgttactatctttattgcagttaacagtcttcgtcatatgtataatcattacgctgtaggtttcttatttttatatgaagcagtgatatataacataataaagtttcatcgccttttacacagtatatagggcttcacctatacagtcccacacagtaacacactgcgaaactatgtatctcttctctacttataaaagaaaataagatatgaaggacaataatgaaaaggagaaagaagaacggtatttgtaacctgcattttgttttttagtggtgctttcgctagagccgccactacttgagaaagaactagcatcatcgctttgggctgcggtggcaagcaatgatttgtactgtgaaaattccgaatacgaggtccagctgacattaataaaatctcctgttccgatgggactaccgggcttatatacccatgtactaaagtatccgggagcaggggtggcacctgggacagtatcggagataacctcaatatcttcttcttgattattaaagctagcctgagcaatagaaatttcgtagttttctaaatcgtagactacatatgcgtcgacaaggaaagcatctcccagcatataagtggactcggattgcttaacatttaaaacgcaacgatccttagctgatgttacgaaattggatatgtttgccgatatattaaatcctccaaagtcgacggacagtaaagtatcgttcacttttgaacaatcaaagatgtagccttggtcgtcagagctgtactctccgtcaaaacttttgccgattgcttctgcaatttcggtgggtaaataggagaaagttgtgccagaatccaacatcactggaaattgaatatccgaaacagttttattgccagattcactatccaaaattgccacactttgtgcagtaataatcatcccaggatttgagccaagggtattgaatgcctgcagcataggcagggtgtaaagctgtcctgtgtacttacttttgtccactgcaccaaacaagatgctcccgaagtgtgcatcaggtccattcaaaaataaagaatacgctattttattaatctttccctgattttttaattccattggaaagttatcatatatgaaaggtgttctgttcaatgccaatgcgtattcgataccatctgtaaattctgcaatgggaagcgatatgcctaaaatgccacttggattgcctattgtatcatttgatacaccaaaagtgaaatcatttagagtaatattttcgaaagagacaacatccgtaccataagtccctgcataatacgtaccatctccgtatgtgttattgaaaaacgtcgcattattctcaaaagtagatgagttgcttgcatcgaatgtaccccaataagagcagagagtgttataagcttctgatgagatggtagtcgaaggaagcccattgaacgttgctgtgagctcgtaattatcagttgaagcgtagtcagatccgtcagacatcgatttgcaataggcaatgtcagcattattcacaatcatatctgaagagccagtatctaactgtaggtacaacgtttgtggaggcgttccgatttccatcttgacaacatacactcctattccatttatcactgtggtgttaagaacctcatttcttttgaagacggtagaaacatcctgtgtgcatatatttataatatcagccaacttttgaacaggaaacttaacataggaacttgcggaagaccctaaaacggtcaatgaacacatcaatgatgacaacaaagagaggatggaaatcaattgcatattgatagctttgcgttgtcttcaaatatccttattttcgaaagagacaaaatttaacaactgatcaaccaatgaaaaaagagaacaaggaagaacgatgaaaaaccctattccaagatcataacaccttatatactctcaactttgaaagcagttccaaagcttaaatcctcgaagagtactgcttgcatgaggtttacgcaacaggtctagtcagttttaactcctcggatatctcgagatattttgctgtagtgagcgacagggtagcaaatttttggacccttaaccccttatacaaattaccaccatatgttccttttctgcagcgaaaacctcggtgttgtcagaaacaatttaagaaaagcacaggcgaaattgggcttgcactgggtgatcaacaatgccagaaataaatgagaagctttttactcttgcttttgcttcttcctctttatgttcaagccagccaagctatgttatagtgttgaatgtcttgaaccgttatagtttctaaaaataactttacattttgttatgcaatcttcatcatctcgaacttttcaacaaacgttcaacagtgatggtcttccccagtgaaccaaaagacatatgacgctcgtatggtatgttaaaaacaacatagaggatagtaggtcggggtttattgtagaaaggacataaatagttgacgtggtaaattttcatcaactaaagccacatctattttgccaagtaggagataatgtaatatgtagagggatcgagatttactgaagcctcacgtgagggcaatctggaatcagattgcactggtttgcaccatacctctcaaagaagaaaacgtactacttttttagttgagtatggatagggtagtgtttcctaaagttataaggtaaaaggggcagaggaaaagtcgataataatttgaaagaaacttgcttccatattcacaaaggagctggatacttcatgtcatccgcacatatatctacaaaaatttcaactttttgaggttgatactaagtctttcgctaccaaaatgaaagaaatcaatttggagagacttaggctgaatatttccgcgttctctctggggatgaaagatttcttactgcaaagagtttcagtatttacggattggttacaattttttttttttatcataatcaattctttgaatatcaacttctctcaataccatccgcctctcagcggctacaattacgtaattgcaccaaggccttcgccgagagtttacatatttgcagaccctaacagtatacgactcccaacacacgtttaatgttgtacgaattcaagagatagaaatatttcttgcatggaagccgtttagagcagactgaatatgggcttagacaataagcttctgtacgagggtccaaatctaaaattcggatattctttttgaccgaaaaaggaaatgtcacaggcacagaaaagggttttataaggcacctcggcaccctataattggcattcccacattctgcgcatacgaatacacatgagtgccataaaacaatactccacatacgaagtctatgaaagatgtatgattcgttcagaaacaaggtcatctccatagagataatgagattgtgtgaaagatgagatatggaggatatgtgaggtgctaaatgagcacctgttaacgaatcgtttaagtagtgatgactgatgaaggcatgggtataaatagagctgcttcaactgtatgtctttgagaatatgtttttattcctttctttcctgttaagcttatatcagcactaaaaaacaaaacaaatataatggtcaaattaacttcaatcgctgctggtgtcgccgccatcgctgctggtgttgccgctgccccagccactaccactctatctccatctgacgaaagagttaacttggtcgaattgggtgtttacgtctccgatatcagagctcatttggcccaatactacttgtttcaagcagctcatccaagtgagacctacccagttgaaattgctgaagctgttttcaactatggtgacttcaccaccatgttgactggtattccagctgaacaagtcaccagagttatcactggtgttccatggtactctaccagattgagaccagctatctccagtgctctatctaaggacggtatttacactgctattccaaaatagagacatgcctttacgaatgagattccatagacattgaaagtaacgaaaaaatgaaataaaaaatgctttcaatataaatacagctgattacatataaacatatattaatattataaattcatttgctttcacgaactaccggctgggcgtcaatataatagggaacgcatagttgctcttttatctttctcacaactaggggtttttttatgtgagctgtacggaataggccagttttacaacaggattcgtagatcagaatccgttcaagctattcacctgttacagcagtagagttgctcttgtcttgacccgtgaatattaaatactgtagaaccagaacggatacttgaatatattcaacgatgggaaaataaaaagacatataagaaaaatgtgctagtacggtaaggaggatactgaaaagaaaaggaaaatatagtttaaaatagtaaagataacccactttcgttatgggtttagtgagggttggtaacgaaccgtagcgcggtgtagtatgctgtgaataattgtactttagcatagttaacattacaatctttgtacgtttatataacaaatatgatagagtatgagaaaaattaaatgatacattttgaggttaaggttgaaactattatatggaagaaaggtggaatatagttagggccaaaatgacactataaatgacatgatgtgagccttagtaaggtgagagctacgcttcctgggtttaaatcaaaaccgagagcccaaaatattatcggtatcgacgtaacatttcaatgtcattcaagcttaaaggagatcagcgcaaatgcgtgaagtcttagtcattgtaaatgcgatttttctttgttgaaggtgaagtcggaaaattcacatgactgcaaaaaaatcctagtctacagtatggtaaccaaaaaatgctatatatacatatgtcctgcatgaaagagagggcgagttttcagtttgacaagctttctcttattgctgctattcctctcttttgtttgccattttcaaaatttgttttgtctaaccattcttcaaaggttttacgaatgcgtaaccattctttatcgattattgaaaaccattgagtgtcgcgagtgcgacccttatataccaccacttgtcgaaacgtgccttcatacttaaagcctaagcgcatcgctgccctccttgacggcccatttaaactatcacacttccactcatatctcctgtattgaagatcatcaaatacatacttcattaacagaaattgagcttcagttgcaataatcgtcttctgtaattctggtgaaaaaacaacatatccaacttctagtgaaccgttggcttcatcgattcttattaagcacaatgtaccaacggcacgttcagtctctttattaataattgcgaaaggcacagtatctttagtttcattgagttccttaatgaattctagatattcctccaagttagtgaatggtcccgcaggtaaatacgtccataatttttggcctgcctcactataggcactaaaaagttccgaaccatgtctttctctatctagaggttctagtctgcaagtgttacctttcaatacaactttctctgggaaggcccttgttgtccaaccttcgacgtcagcaccaacttcttgcccaaatatatttaaattcgccataattgtttctactgaagggcattatttccaggttcagaggcgggaaaattcttgcaaggcgtcctcccatgctatttttatatcattgttgattgtttatcaacctcttatcaacctcctatcaacctttgaagaatggctcaaaaaaaaaacaaccttccattatgaaccaataaacagagcaaatatcacgtgcacaaagaactacgaactttttgactttcacactggcgatgatccaagacgtattacagtacaagagatctgctttattgtaagcccagtaaacagcttcttatagactctgcaaatataggtacagagtttgcataattttctaatatacacttatgccttatgataatcccaattttgagaaggagacaaattcagcgagtggcgtataagtgcgtgcgctattgaaacaaatctcacataaatgtgtttatgatcagcaataaccttatcgatgcaacagaaaatgtgattcgcgaaatttgcatctttcttttcaaaaaatatttcaaaaacaaattgccaagagatgatgaaaacaaatcactcaattcaagttaaataagaactcgtgtatatatagaaaatatgaggaaatgtactccatttcaactgcttgactttaaaatgatgctggctcatgagaagcctccaagaaataatatcggtgttactattccaatactttcgatccgctctgtgctaaataggcaaactcaaaagtaataaatacatacacatattacggagatttgtgcctttaaggaatataaattataattatctgctagtttacattttaatggctccaaacatttattttctagaagtgctccttaataaacaataatcttaaaagaataattatggagcgtgtccggttgtaattaatactcagtaattatatataatttgagaattatgctcgtgtgcattttcttccaatatattatactctgaaccatgtcgtgctgtgtgcataaaattgctcgatgaaaatcttaacccaccttttaggttgaaaaaaacatgttcactttttcactaaagacttgttaccacggattgtgcttctttaacgtatggccatagctcaacgttcaacgaagcaaaccacatagttttttttaaagataaaaggcgatagaaaaagcagctaaaaaaccattcacagtcaagtccatcgtagaaaaactcttcattattccagacttttttctcaaacaaatacctattcattttctttgcaatttcgtcccatccattcgcaccgctttcttgctcatttataatagttgacaagaactgcatcttgtgttccattttaacggataaaacaatcattcccatattttggaaatctctcgtcatgataaaaaacattactaccggaaacaagaaacgtgatataaggtcaacatttccagacgtgtagacaattaaaaaataataaaggaagacttgtaaacaccgcagcttgaaaatccttttaagaatccaggtaagcttaaatcggtaagcttctttgggaagtttagcatcttctaggccaacagggctccatgatttttcagtattaaacaacttccattgtttttcaacttctgtaaaataaactcccaatgcttcttcaatgtaagagacggaatccttaaatgacttaaccttggcagcttcgtcttttttcaaagagaagggttcgagaagggttgttctgaacgcttcttggcagcccatggcattgaagaaaaagtacctagtattccaagccttattttcatataagtacgaatttagatttgctgcaacgatttcccaattatgagtatccaaacttggtgcgtttttagtaatatctttgcaaaactgagtgagttgtttcgataaggagcgcttacgagaaggttcacgaataacaaggagaaatattggtcccaaaaccaggacaagaagtgaaactataaattggtaaacccaattgttggaaagtttccatcagatgctaagtggtagccataatagcatccagatgcgaaacgctaaagacttgtaaatttcataacaaaaccaggtcaattcgtttcggaaaacatcctggggtaaaacagtcttttgggattcgagctgtttgaaggataacacatctacgcttttctcatctttgacttcattctctttcatttggtagtgagatggcagttcgaggtttttttattcaaagtaataacttcttccttttcgcttttatgtagcagaaaaaaaagccgccgaagcgcgcgcgttcgtgcaatctcatgatagaaaaagggcaacaatgttgggctattttagacaaagaaactcagctattcgaaaagggcatccatttcatttccggttttctatctaagttactcgatagtcgtaataatacttttataaaactttaatgcgggtactttgagagcgtgtcataactttggcttacgttttaaggtgcgaccggcaatgtcactgctcgcacagcagttgccgcctgaaatgaaacacatatttaagcgtagattgcctgtgagaaaactgtgtaaacatatagtagaaaatagacgtagctgtcacaaatatttacacgggaaagagtctggcctacgagtatcttacatgaagattcatagaaccaatttatttccctatattgataacctttcgataccattttaatgccttctccttatgtttgttgtcactgtaaaacggatcaaagcaaaaacttagaggtatggtggtactcagatcatgcatgacctctgggtaattaccacttctcccgcttgttttgagattctgtatataaatattgcaaacaaaaggatagagcgcaaatgacagaccttatagtataaattgttcgtttaatcatgcgtcagtgtgagattccatgacaatagtatgggaagatagggcgaagtgaaaatatctgtatgactatagagtgcagttatattacaatatattaaatagagcatagtggtacgacgatattaaggaacttttacattaatgacgtcatggtagtgctcatacttcaagtcaaagtgtttatttcgtaaagttgaaaggtaaaatatttttatgtttaggtgattttagtggtaatttttctgtaatattgacataagtttataaaaattgagtggttagtatatggcgtaaaagtggtataatgtatgcattaagagcagttatacaatatttggagccgctgaatgagatatagatattaaaatgtggataatcgtgagctttatgggtaaatggcacagggtatagaccgctgaggcaagtaccgtgcacaatgatgtgagtgcatttgtactgatttagtgagagatgggccatggagtggagtggaatgtgagagtagggtaagtttgagagtggtatatactgtagcatccgtgtgcgtatgccctatcagtatacaattaaaggtgagtatggcatgtggtggtgggattagagtggtagggtaagtatgtgtgtattatttacgatcatttgttaacgtttcaatatggtgggtagaacaacagtatagtgagtagcagatggtggatggtagggtaatggtagggtaagtggcagtggggttggatatgggtaattggagggtaacggttatggtggacggtgggttggtggtagtacgtagagagatggattgtggttcggagtggtatggttgaatggaacagggtaacaagtggggaggaagggtaatggagggtaagttgagagacaggatggttagggttaaagtagggtagtgttagggtagtgtggtgtgtgggtgtgggtgtggatgtggtgtggatgtggtgtgggtgtggatgtgggtgtggtgtgtgtgt

SEQ ID NO: 12213 - DNA, 745443 bp, Saccharomyces cerevisiae
cccacacacacaccacacccacacccacacacaccacacccacacaccacacccacaccaactctctctcatctacctttactcgcgctgtcacaccttacccggctttctgaccgaaattaaaaaaaatgaaaatgaaatcctgttctttagccctacaacacttttacatagccctaaatagccctaaatagccctcatttacgtctcctccaagccctattgactcttacccggagtttcagctaaaagctatacttactacctttattttatgtttactttttatagactgtcttttcatcctactccttcgcacttgtctctcgctactgccgtgcaacaaacactaaatcaaaacagtaaaatactacatcaaaacgcatattccctagaaaaaaattttcttacaatatactatactacacaatacataatcagtgactttcgtaacaacaatttccttcactctccaacttctctgctcgaatccctacataataatatatcaaatctaccgtctggaacatcatcgctatccagctctttgtgaaccgctaccatcagcatgtacagtggtaccctcgtgtcatctgcagcgagaacttcaacgtttgccaaatcaagccaatgtggtaacaaccacacctccgaaatctgctccaaaagatactccagtttctgccgaaatgttttattgtagaacagccctatcagcatcgagaggaatgccgtccaatgcggcactttagatggggtaactcccagcgcaatctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccacctttctcgagcgcttccacaacaaccgtatcgtcttttgcctcccattcttcctggcactttttttcgtcccagttcaaaaagtactgcagcacctctgtcttcgattcacgcaagttgctccatactttaaaatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaatatttcaaatatcctacagggtccccatgatatggctcgatgtcttccaagtattctttgtattcctcgtcatttcgcagcattctctccacagctagtgcttcccaagctatcctccgatacgatactttctggccagcccaacagacacagagctcgaacatcttttgacagcccttgcataatccgtattgtgtgaacactccctctgggcagaagtatatgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtagcactagtgttggagttggtactttcggtggtagcagcactagtgttggagttggtactttcagtggtagtagcattagtgctggagttggtactttcagtggtagtagcattagtgctggagttggtactttcagtggtagtagcattagtgttggagttggtactttcagtggtagtagcattagtgctagagttgatacttttagtggtagtagcactagtcctgacgttgatgctggcagtggtagtcgcactagtgctggagttggtactttcagtggtagtagcactagtcctgacgttgatgctggcagtggtagtagcactagtgttggagttggtactttcggtggtagtagcattagtgctggagttggtactttcagtggtagtcgcattagtgctggagttggtactttcagtggtagtagcactagtcctgacgttgatgctggcagtggtagtagcactagtcctgacgttggtgctggcagtggtagtagcattagtgctggagttggtagtcgcattggtactggcattggtggtcgcattagtactggcattggtactggcattggtagtcgcattagtactagcattggtagtcgcattagtcctgacgttggtactagcagtggtaatcgcattagtactggcgttagtactggcattagcactaccatgaatgcacgtgttgctgtcctcatcactgctgcaatactttctgtacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaattggtggtaattcacccttacgattccttgccgcccaactgttttttctagataatagataacagaggcccccatctcttagtctccctacaccttgaatgagctcaataatattaagtctattatcaagcatgatcaccatcatcaattgcttaatgtcaattccttcagtcactaatttcgttccgatgagaacttgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcactttcaaagagggctaaaagaagcttcagtgcttcttcgggctgtgattccactttcttccgaattttatgaacatgccctaaaggcacctcggatttctccttgattagattaaacatccgtgttggatagctggatagacctctgctgagatcttccgaccgtttgagctcgttgatgtccatcgatttcttggccagtcccgtaagcccaatacgctgcaacgcagcatcagctacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgtaaccttcttcaataaagtttcttacaggggccacattcaagcaaccgcgtcggcccaacctgatcatgcaattagcaagcaacactgtgtacggtacaaacagaaacgacacatattccacgtcgcccttagatgccagtgctatcaaggggagatgaaataactccgtcttaccatagcccggtggggcctgtactgccacagagggtgtgtctgccatgtatatttcataacataagcgcaactgatgcaagtccctgaattcaaaggagctgccaaagagtttctggcctgcgacgaggatatcgtttgtactcttgggctctcggggcctttttcgcgttactcttgaaattttttgatgatgatttgaactcgccgcctcacctgccactacgtcttccgcattccgagtactggagaatgaacaatggtagtcgctttcaaggcctaaccactgaatccagcgctcggaagctcgttcctgcaataaagtggcggtcgtcccactgacactagttaacgaaaaggaatccacaccgtaaatatttcgccctgtttgaacggaatgattggccatgagttcactcgtcgccgactcgtacaaatctgtttcaaatctgctacctacgcagtgccgtcctagggcaatcaacccctgacgcatctcccgaaaattcagcttctgaggtgcattcttcggaagttccctcatgtactgccgaaaagttgcgtattcaaccagacagcccttcgcggtattcagaaacatgtaggaatacaaaactatcctcgaaatgtctcgatttgttacttgatttggatcctcaaatcccaccacatccatccaaggatcatgattaaaagcgtcataactgttaccaagcgcacatatttgcatttgccttagcacagtgacaaaataaaacacgtaatctgaggtgagtccgtcaagcgtctttagtcgaggctccgatgaaccgttcttgttgtaatcagtgtacagttggatgcgtcttgttgtatcatcgacgtatacgttgcgctgaggaccggcaaaagcgagtagctgaagctctggataacggtaagggtatcctacggcaaaatggatcatccacataagtggcaccgtaagctcgtcaattgcaacagcgactttatttttaagagccgcggtcattttgttagtatctcttctcaacttgggcagcacaatttcacgatatttaacaggtatcatttgaagaaaagaatcgttttccagatactcgtcaattcctcgcttcggttctctgaacaaaacttctcgattacgcaaaatgaggttggcaatatcaaccactgtaggcatataaaagcagttgttcaactctccccaaaggttatcaaactgagccttgcatgcaaagtaaaagccgcggacatactcgcgattaaaaaagttttccacatactgatataccatcagaagaaggtaccaaagttattctataagagtccttcagcgtggtttcctgcgctacttcgtggtacagaattttgatccatttccacattgcaacgccgttgttgtcatcaaatatatctaaatcccttgcggtacaagcacaagacgacaccaataaagctttcacggcatctagtgtttttctgagtcttcgtggagtgttaggactgcgcaacttacatactttcaggccatgctcgtccacagagggaataatgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttggtatgcagaaaaaatcgatagctcatctacgtgtagtaacaaaaacatgtagggtgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttttacatttttcccgaccatgacggaaatgacaactttttcaaaagaccttttcctatccattgcaccagttctgaattttaccactttgattaggccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctctagcagcagcaaagaaaattcagttaataagaaatctcactaagataagcgactgtctgtccccttcaagcacaacatagaaaacagaaggatgtctcattcatcgcttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaacatggacctacgcttagcctgcgcttagcctacaacttcttccgctatcgaaaagaccaatataataaaaagttataaattacatttccttattaggtatacgacctcgcgcttcgaagtaaaggagccctttttggcgtacctacatatggcgcgtcagacagacaaccttccctcaaaatgtattaccccgccgaataagaaaacagacccattcaccaacgacgtatcaagttacttccttgatttgcaatgtcccactataaaaaaattccttaacgctagatctttgggctaaaatctgcgtcaaacaggaaatattgcctattttcgtacaaggttacttcctagatgctatatgtccctttacataataaattaaaaaattttttttataaattataataatttctttttatttctaatagtatcttgggattaaataaatcacttacaatatttattttattatattgctttgttcaattaaattttaatacgaaattatttaattgttttgtatttaaaatattttgaataataaaataatatagagttttattataaatttttcattgatatttaataaataaagatttccagcatacagcacataaaatattaattacatatgtaattaataataaggccatattttgaccctgccattaccctaccatgccccatctgttactcactatactgttgttctacccaacatattgaaatgttaacaaatgatcgtaaataatacacacatacttaccctaccactctaatcccaccaccacatgccacactcaccctcacttgtatactgatatgccatacgcacacggatgctacagtatataccatctcaacttaccctactctcatattccactccactccacggcccattctcactaaatcagtataaatgcactcacatcattatgcacggcacttgcctcagcggtctataccctgtgccatttacccataaagcccacgattatccacattttaatatctatatctcattcggcggccccaaatattgtataactgcccttaatacatacgttataccactttttcaccatatactaaccacttaatttatatacacttatgccaatattacataaaaatcaccaccaaaatcacctaaacataaaaatattctattcttcaacaataatacataaacacattggcttgaagtatgagcactatcatggtatcactaacttaaaagatccttaatattgcaatttgcttgaacggatgccatttcagaatatttcgtacttacacacacctgacattacaataatatgccacctcactgtcgtaacactctttattcactgagctataatacggtagtggctcgcactcatgcgggggctatgatacaattgtatcctatttccattcccatatgctaaccgcaacatcctaaaagcataactgatgcatctttaatcttgtatgtgacactactcatacgaagagactatatctgaacaagacgatactgtgataggtacgttatttaataggatctataacgaaatgtcaaataattttacggtaatataacttatcagcggcgtatacttaaacggacgttacgatattgtctcacttcatcttaccaccctctatcttattgttgatagaacactaacccctcagctttatttctagttacagttacacaaaaaactgtgccaacccaaaaattttgatattttacgtgtcaaaaaatgagggtctctaaatgagagtctgataccatgacttgtagctcgcactgccctgatctgcaatcatgttcttagaagtggcgcatattctatacggcccgacgcgacgcgccaaaaaatgaaaaaagaagcagcgactcatttttatggaaggacaaagtgctgcgaagtcatacgcttccaatttcattgttgtttattggacatacactgttagctttattaccgtccacgctttttctacaataatgtaaaagtttctttctatgtttatcatattcataaaatgcttcacgaacaccgtcattgatcaaataggtctataatattaatatacatttatataatctacggtatttatatcatcaaaaaaaagtagttttttatttattttattttgttcgttaattttcaatgtctatggaagcccgttcgtaaaattggcgtttgtctctagtttgcgatagtgtagataccgtccttggatagagcactggagatggctggctttaatctgctggagtaccatgggacaccggtgatcattctggtcacttggtctggagaaataccagtcaacatggtggtgaagtcaccgtagttgaaaacggcttcagcaacttcgactgggtaggtttcagttgggtgtgcggcttggaacatgtagtattgggccaagtgagctctgatatcagagacgtagacacccaattcaaccaagttgactctttcgtcagattgagctagagtggtggttgcggaagcagtagcagcgatggcagcgacaccagcagcgattgaagttaatttgaccattgtatttgttttgtttgttagtgctgatataagcttaacaggaaagaaaagaataaagacatattctcaaaggcatatagttggagcagctctatttatacccgttcctccatctgtcatcattacttaaacgattcgttaacagatgctcatttagtacctcacatattctccatatctcatctttcacacaatctcattatcactatgaagatgttcttgtttttgaacgaatcatacatctttgatagacttcgtatgtggagtattgttttatggcactcatgtgtattcgtatgcgcagaatgtgagaatgccaattataggggtgccgaggtgccttgaaaaacccttttgcgcgcctgcgaagtttccattttcggtcaaaaagaatatccgaattttagatttggaccctcgtacagaagcctattgtctaagcctaaattcagtctgctctaaacggcttccatgcaagaaatatttctatctcttgaattcgtacaacattaaacgtgtgttgggagtcgtatactgttagggtctgcaaatatgtaaactctcggcgaatgccttggtgcaattacgtaattgtagccgctgaaggcggatggtattgagagaagttgatattcaaagaatcttgtatgataaaaataaaattgtaaccagttcgtagtagcagtattaaaactttgcacagggggaaatatttgattccgagatgtattcccccttttctagtcagatatgaaggaaaaaagtgtaagggcaatagatggcgctaatttgttctattctattctaaaaacgttttctaggaaaaatatattaatagttgatactccttgtaatttctaagtcaaaagaaatgtctctatctttatcgtaacggctcatcgttagagctcaattgtgcctcttggatgtatttccaaagttccacgtttaataacccagccaacacagattcctttgagaacaaatggctaccaaagtttcattcaaataagcctgacaatcaaccccatcaaagaggagctctttgtttttccaaacccatgagaaaaaaatacagttccttttccataccaaaaaatgaagaagaaatcatgtgctgagagttgcctgcagtcgtagaagtttacgatcctaacccattatgtgattcgttgtgagtcacccttccatgattatgtgtccttactacctactatccaattactacatatgttttgaactcatatgtaccaagcacctaaaattacgcacccatttccattggcaaagacttgacgaaatttaatacactgcaataatatccagcgatactcttcaagaattcccgcctataatggcggctcgctgtccgaaagattgcgccgcacttgactgcttcttacactcctttttcccaggcgataaacagactaagcggaaactacgatataatgcagtagaggtcccccaagagctggaaagaaaatattagtttgatagccagcactattccatccagtgggttcttgtaccattttctgtggtatggctttgattcaactgcatacgtagttaacgcgatcagccgcacatgtccattatcattttcaggggtactggtaaaccctattgtttagaaagaatatctggtaagcgggtctgtcgagtcttcacttccttcatacacattttattgagtaaattatacttagatccggaatcataacgttggaaaaggagacaaggttggataagttatgtaggcgtatttcaataagacgtatatgatttagtctaagaaaccgacgtatctagccagcattcgcactatgacgacagtttaacgtcgtattgagcagcatcaactgaatataatgaaaaaaaaaaaatcattccttgaaattcgttcttccgaaaactgctcaaggtgatagcacctcaagaacaattcttcgtttgaatttattatcaaattcatcaccgtcagagttataagttgcactgtattcctggtgaccctagtaacccaaaataccattttctgattttgcaatcatatttattggctttagcgaacatatgatcaccatactatcttgatggttgaccaagaagcgaacatcttcgaaccaaagtcaccgaatctcaaggaatgcaaaattcgtggctcagtgctctcaagacaatgttgcaaccctttgcgtcaattatatatatatatatatatatatatatatcccgtccgctttcttttttttgtcagttgggtcgcaacgcagggtctcgagacctgaaaaaagcttcatagcgatattaaaggtagaggtacacccataatggcattgtttcgtgccctgtatattatttgggtattcctactcattccactgtccaatgcagaagaattcacccccaaggttaccagaactttgtcaagatatgtattcgatatagtaaactttgatgattcaaacactttgatcagagcagaagaagactctgtcgagataagttttgatgctggagaaaattggaaaacaatagatgagattgaagagcctatcgagtcatttgttgttgatcccttccgtgggcatgatagagcttttgctttcgtgaaaacggcaccaaaattttacgtcacggatgatcaaggtaaatcgtggaggcctttgactatacccatttctgagaaagcatcgaattatttttgcgacgtaactactcaccctataaaaaagaagcatcttattattcgttgtgatttgttgacaataaaaaactcaggcttaatgtatgttggaagagagatttacacaactaatgatggagtatccttttcccaagttaaaccttcttttggaaaaattgatggtcatattagcacggcacgctgtgactttattaaatctagtgaggattctgatctgggcggtaatgatgcttcgatactctgtcttttccgaaacactgagtacattgaaagtacaggctcaactattgacaagtctgaattgattttaagtgccgatggaggtgaaacattcaaagaattagtccagttcaaagataaggttgttagtcgatacgagatacttaagcatcatgtgatcgttttgacacaagatgatatgtataatgaaatgtcatcaacaaacatttggatatccaatgatgtatccacttttcaagtggctcgtacacctactaagatacggcacgttaatatgggacaaattcatgaagattccatcggaagaatcgttttacctgtatctagagaaagagatgatgaagacagcaaccaaccgggagctgctgaagtgttaatatcagattctgaaggactaaaatttttgcctataaattggataccaaacaatcagtttggatatatcaatgtagcttatccaggtttcttaaaaggaacattttttggttcgtttcatcccttcattgaatattctgatagaaaaaggaaatacagccgacagaaagtaagagaggaaactaaagtatctgttgataacggtctcacatggacaaacttgaaagttgttgaccgggaaaatgtagatttatttggttgtgatgtcactaaacccgagagatgttcgcttcagactcatttctatgatctaagaaatttaaatccctctgccggaatcatgatgatatcgggtattgttggcgacggcagtgcatacaattggaaagaagaaaaaactttcatctccagggatagtggtttaacatggaggttagtccataattccactggtttatatactactggtgatctgggaaatattatcatgtatattccatatcgttcgaatgaaaatggcgatgtgccttctaaattttattattccttggatcaaggtaagacatggggtgaatatgatctaatcatgcctatttatccatacagattagtcagcacaatatcagatggatctggttcaaaatttattctaacaggaacgtccattacagaagatccaatattcattacatattcaattgatttttcagcggtatttgattataaatcatgtgaagagggtgattttgaagattggaatctagcagatggaaaatgtgttaatggcgccaaatacaagtacagaaggaggaaacaggacgcccagtgtttggtaaaaaaagcattcaaagatttgagtttagatgaaacgccttgtaacagttgtactggatccgactacgaatgttcgtttgaattcgttagagatgcgaagggtgactgtataccagattataatctgattgccctttccgatatatgtgacaaatcgaagggtaaatctgtgttagtaaagccactacaattaatcaaaggtgataaatgtaaaacacctatgaaaattgaatccgtagacattccgtgtgacgaaattccaaaggagggttcgagtgacaaggaaatagtgactactgaaaacaaattcgactttgaaattaaattttaccaatacttcgatacagttgccgacgaatctttggtcatgctgaattcgataggagacgcctatatatcccacgatggtggacaaacgataaaaaggtttgacactgacggcgaaaaaattgtcgaaatcgtgtttaacccatacttcaattcttcagcatatttgtttggctctaaaggtaacatattcttaacacacgatagaggatactctttcatgatagctaaattacctgaagccaggcaattaggcatgccactagattttagtgctaaagcacaggatacttttatttactatggtggtaagaattgtgaatcaattttaagtccagaatgtcatgcagtggcatacctcaccaaagatgggggtgaaacttttacagaaatgcttgataatgcaattcattgtgagtttgcaggaacactattcaaatatccgtcaaatgacgatatggttatgtgccaagtaaaggaaaagttttcgcaaacaagaagtttagtttcttctactgactttttccaagatgatagaaaaactgtctttgaaaacattatcggctacttgtctactggtggctatatcattgttgccgtacctcatgaagacaatgaattgagggcgtatgtaactaatgatggtgctgagtttaccgaggcaaaattcccatatgatgaagatattggtaagcaagacgcattcactattttaggatctgaggaaggatcaatatttttacatttagcaacaaacttggaatcaggacacgatttcggaaaccttttgaaatccaactcgaatggtacttcttttgtcaccttagagcatgccgttaatagaaacacattcggttatgtggactttgaaaaagttcaaggtcttgaaggtattattatcaccaacatcgtttcgaatagcgaaaaggttggcgagaacaaggaagacgaacaattgaagacgaaaatcaccttcaatgacggttcagattggaactttttgaagcctccaaagaaggattcggaagggaaaaagtttccctgtgattctgtgtcattagataaatgttctctacatttgcatggttacactgaacgtaaggatatcagggatacatattcctctggctccgcgttaggaatgatgtttggtgtcggaaatgttggcgataggcttctaccatatgaggagtgttccacttttctaaccactgatggaggagagacgtggactgaggttaaaaaaggcccccatcaatgggagtacggtgatcatggtggagtcttggttttggtccccgaaaacgcagaaactgattctatttcttactccaccgattttggtaaaacatggaaagattataaattctgtggcgacaaagtcctcgtaaaggatataatcaccgttcccagagattctgctttgaggtttttgctatttggagaagcaaaaaacatgggtagtggttcattcagaacgtatacaattgattttagaaacatcttcgagaggcaatgtgagtttgatattaccggtagaaaaagggcagattttaagtactctcctctgggttccagaactggttgtttgtttggccataaaacagaatttttacgtaaaaccgatgaaaaatgttttattgggaatattccactttctgaattttcgaggaacgtcaaaaactgtccatgtacaagacaagatttcgaatgtgactataatttttataaagccagtgatggtacttgtaaattagtcaaaggcttaagttcggcgaatggtgccgatatctgcaaaaaggaacccgacttaattgaatactatgattcctccggctatcggaaaattcccttatcaacctgtaaaggtgggctgaaattggatgcacatttagcaccacatccttgtccgggaaaagaaaaggcattcagggaaaaatactctataaacaccggcgcttatgcgctggtttttgttacaattcttctcgttattttctttgtcgcatggtttgtatacgatagaggtatcaggagaaatgggggattttcaagatttgaagaaatcagattaggagacgatgggctgatagaaaacaataggaccgatagagttgtcaacatcattgtaagactaggattatgcatttctttaatcaccaagtctgcgtttcaacgcgcgaaggcaggtacagcgcaactttcttcaaaatttagggcaaggtttggcaacaaaaaaggtgccacttactcttcgctgcttcatgatcagctttcagatgaaccagatggcttccatgaagattccaacgatttatccagtttcagaggtcaaggtagtaattctgaaattgagcaagaagatgttgacacatctcaacaagagcatacgtcgcggacagacctacttggtgctagcaatattccagacgctttgccagcgcgtagtgcttctcacgagtccgatttagcagctgcacgcagcgaagacaagtaggtaggtctttttaaacgaacgaaattgttcacgcattgtatgttgggtttcttacatatcaatcactcagaagcccattttctacctccatcaccgtacttatagaattatttttctttcttgacacaatatactgtggctagtttaacatttcgtgccctttaaatatttttcatggtgtggacagaacaacgtcaattgtaaggagcatggaggtcaaataaacaatacctcaaactaaataatgaagaccccaagaagccttgcaatcggcagtaattatattcatggtactaattgtcactattcgtctacactctagtaaaagttcttgatgcaaatttttttatttttatgtatgagaactgccgaaaaaaaaggtttggatattaactttgttaaataaaataatacaatcaattcaaactttttactgtttcttttttcagctaactatatcatactattgtacacaattattaattaccacttacattaactgttattcgctacgctttagaatatcacatacccaatatcgcattaccacatgtatgtcgttactatttaaagtgcggtatgtaacatagataaatataagtatatgtatatgtataaaaatcttgtcgtcacaatcattaatcattcagatatgtaaattctgccctcccatggcttcaatgttctggaagacgcatcaacttcacttcttgggtagtttccgaattccaacttaaacgatgagctattgtttggaatcgtgaagtcgatcgaatcagagctgaagttcaaagcagcaaacaatgttttgttgtcgtatttctttgtgaagctgaacagtttcttattgtccaaatcaataaactcaaaatcatatccatacacagtaatatccttgtgtgcctttctaaatctcaaggcctccttccagaagttcaaaaccgagttggggtccttggattcgtcttcagcgttaattccttccctgaaagactcgttcaagtaaaaccatggtttagcattaggaccagaaaaaccagcatttggctcctcacgagaccattgcataggtgttctagcatggtctctggaaataagggcaattgcttccaaaaacctcttcatctccttcgagttttctccatgctcttccttgatcgcatcatagttatttctaacttcgacatcctcgtatttttcgataggccagttcttgaaattgatttcacccagttcctgtccttggtacacatatagagtaccgctcagtgacaccaacaacacagacaacaacttaccagaaataacacggtttttgggagaatcgtcaccaaatctggtaattgaacgaggttggtcgtgattttccagataaattgttgaccaacaatcagttccgttaacgtatctgaaaagttcagcaagggcaaccttccaatcctttagttcatatggtatcaaattttgacggaacttgggcgaagtcccgacatcagtgtgggaaaagttgaataactcactaagttcgtgtcttgacgcacttgtatacaacctcttggtctcatcagtagcatgtcgcatttcaccaactgtcataatttctctgccatccttcactctgtttctgatgaacttgttcatttcttgatgaaactcatggatacgtggtccgttcattgtgaaaggatcactgagttgccactttgagttttcgtcaatcacaggagcgtctggtagaccagcaaccttggagtacaagcttcccacatcaattctaaagccgtctacaccatggtctaaccagtatccaacggcactttcgtagattgcctttctgcagtcttcgttctcccagtttagatcaggttgggtggagcaaaacaaacgcaagtaaaactcttgtgtcttttcatcgaacgtccatgcagaaccaccgaagtaagacctccaattgtttggaggaattggcttgccttcggcgtcataacccttaggaggtctccagaagaaccagtcacgttttggattggtttttgaggatctgctctctttgaaccattcatgttcgctggagcaatggttgatgactaagtcggtgataaatttcataccaagcttatgtgtcttttcgatcaaggcaaagcagtcctcgttcgtaccgtaggttggccagaccttttcgtagttggcaatatcgtaacccatatcatcttgtggcgagtcgtaaaatggcgagatccaaatggcatcggtaccaagctctttgatgtactccaacttggaggcaatacccttcatatcaccccaaccatcgttgttggagtctttgaaacttgcgggataaatttgataaattgtggcctctttccaccacttgggttctgtttctggatgtgcagaagaaatagtcattgtacgttgctttcttatctctatgaaaaaactttcacttttgtttgtgtgtttggattggtgaatggaacatatattctagtacagctaattcctcgagtgaagaagtcttccttacttatatatgtctgtggacgtcttacgaatgatcgaaaataagaaaagaacaaagtaaatttaggatctggaaggagtgctgtatgtaaacgaagctttcagttttaggtaatgtttgcacaacctacatgatataagatggtatgttctgcaacagcgtgcctgtcacttggcccgttatagcagattataccatctgcaagcagaccccattattgcattgcctccgcagccttgcgtatacatagccctaagacaaaatacggagcgtaaacaaccctcgatccccgcaacaattacataaccatttctccgcggaattacataatcatttctccgggaaaattacataatcatttctccgtgcgagttataagtgcttttctcgtgcatttccctgacacttcacaaaaccttctttttcttttttctttatttcaggggaaatcagtgcaaaactaaaaagaaagaaattttgtgaaatgtaaactccaggtgtcaaaaaataaattatatccgtggaaaatcaggcgtcggaaattgtagatgaatccgcctcctccacaataaaaatgctgaccacacgagcaatgcatacactcggacaccttcgttcaaagtatcagtagcagttcgacacaccctatactacttagctcttaaggtctaggctcatctttctcagttcctctttttcgctaaataaaggtatataatgtcacagctgtgtaactaaagaacactgttgttcctatctttttcttcttctttttttggtatgagttggaaaaaataatcattgcacaattgagtactaaaagctttcgtatcttacccaatatcatgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaatcttccggtttttagtaactggaaaaaaatacatgaacttaattatttattatatacaatatttacttttttacgccttaatccttaacggactatttgttatgccttatagaactagaaattatatgataaacatgagctacacgagttgacagggtgaacagattactatagcatctttctctcatgaataatttttaaaatgtataaattttgtaacgttccgaagggtggagtgaaattccattcaagaaaccaagcattgagacagaacagtacagagttcagttgttgcggaccgagaattgtaacaagtagccccagaaacattcatatgacgtctgtttcaaattaagcttagtaaaagtacacatttaccataaaaaaatagtaccaagtcggtggcctgatatccttattttccttctgccaattgggcaagttggtactaatattttaggtgacactgccactttattgttatggattgaaatttcttaaatgttctcacaatcggccataacgctatttctccgacgtaacctcctgtcatagtgtgccgtgcctgaataacttaaaaaattaaagttttcaatgtgcccaaaaaaattcacaaatagtacgcgctcgttaaacaccctgtgacgctgggccaggcactatttagcattacttcgaaaagacgcaagtataaagagtgagatctcacgtactacaacaagaacatagagaagcattctaataagcatataaacaaggcttctagagaaaaatgggcgtattagaaaatatagtacctggtgagctttatgatgcgaactatgatccagatcttttgaaaattagaaaagagactaaaataaaattgcacgaatacaacacccttagccccgctgatgagaataaaaagagccaggtaataagagaattacttggtagttgcactgataactttataattgaaccgccgttttactgtgattacggaagtaacatctatatcggagacaacttttacgccaatcacaatcttgttatattggatggggccaaggtagtcatcggtgacaacgtatttatcgcccctaatgttggtatttatacggcaggtcatccaattgacgtggaaagacggcttcaaggattagaatatgccatgcctgtgaccattggagacaatgtatggattggaggtggagtgtcaataattcctggagtaaatataggtaaaaactccgtgattgccgccggtagtgttgtgattcgtgacataccagaaaatgtagtggcagcaggtaatccttgtaaggtgataagaaagatcactgaaaaagatagtacaactacaaactatcgaaaatgatggatccactttctggaggaattatcgaaagcaagtgttgtcttctatgattatgtaccgtattttcttataagaataaataaaaagctagttcagttttagtcgactaaatacgcagagagattattaattattggtatatgttctggtttaagttgctcattctcaactcgactgtgtatagtagcttctttctggtataatctatcttcgaggagaaaattatagtttacaacttatgtaaaactgctcaagttccaaccgtatagaaaacgcgtggctggtagctttatgttcggatttgagaaattttcggggaaataagtaccgttctaatttttcagcgcaaattaacatgcggagaaactttaaactgaaaatatggccacctgcatgcgtccatatgaaagggtcatcaaatagcctcgaacaaaacaagtaacattttcgatggagttagaaagggatgatcctatacgcacagatttcctaggtatttaacctgacctaatattaacaaaagtccaagtgacggcttctccatcaaacaagataaattaccaaacacaatggtcgaatctaagaatactgaattatcgcaaggaacatggctcaataagccaaaatctgtttttcaagaggcaggaaaagtcactctggaaacagatgaaaaaactgacttttggcgtgaaacattttacggatttacccgtgatagcggtcattttttgggagtagagacaggtagtgcttttactgcacaagtccgtgttcagggaagctacgagagtctttatgatcaggctggtatcatggttcgtatagatgatggacattggctcaaagctggcatagaaatttctgatggccacgcaatgctaagcagtgttttgacaaatggaaaatcagattggtcaactgctgtttatggcggaaatgctcgcgatttctggcttcgtgttactgttgaaaagggcgttttgaggattcaggtgtcctctgataaaaaaacatggccgttagtacgtttggctccatttccaacttctgaccattaccttgttggaccaatggcttgcacacctgagcgtggcggattgaaagttactttctcggaatggagtctcacagctcctttaggaaaagctttacatgatttgagttagttcacctatatatcaatatataaagaggggtttgcttttgttaagaacaaggcctgcacctcactaagatctgttgatttggcactatgctttttaaaattttgtttatactcaatttcgtcaagattttttttactagtacaatccatacagttaacaaaatactgggcaataaggcgtgcatactacgaaatttttagttttgttataataaacgacttttagctagtgttttaagataaagtgacgaaagttagggtgagaatagtcgaatgtatttactaattattgaattcgtggtaattagtacttatgatgatggggtttaaagggctaaatttagacaatagaaacagtaataatgatgttttctatttttctgctgtacgttgctttttattttatatttcttcggaaaaaggttcagtgaattttctgtcttctatatacatatataaattgcaattgaaaatagcgtacagcgtaagttaagtatccaatgctcacatatgaaaagcaaaagtaaaaagaaatatacaagtttattattcataaatatcggcataactatttgtttcgaaagatcagtacgtttatgttaaatgtgctcgttacttcaacaagtaaagtcttccttcccatggctgcaaggtgcgggaatcaccatttgagtttgcatagttgccaaaaaacatggtgtaggaggcctcattatcaggaactgaaaagtccgtattatcgctactgaaattgaaaacagcaaacatttttttgttatctgtgtcctttgtaaacatgaatagcttgtcattatcaagatcaatgaactgaaagttatgtccataaacaaggatatctttgtgctcctttctaacttgtaaggcctttttccagaaaaagaagactgagtttttatcttttaactcagcttctgcgttgattccgtctctaaatgattcattcatgtcaatccatggtttggcatccttcgagaaacctgcagaaggctcatcagcactccatgggaatggtgttctcccatgatctctagagatcaaagctaatgcttcaaaaaactttttcatcttttcagaatcttcaccataatcacgtttaatggcggcatatgtaccagtaccttcaacgcatttgatttgctcaatttttctgtttttgaagttgggcatacccaattcttgtccttggtagataaaaacagtaccagtcaatgaaatgatgagagtagccaacatcttggacgaaatctcacgccatttaggagaatctgagccaaaacgcgaaacgctacgaggttgatcatgattctccaaatagatggtcgaccagcaatctgtgttttcgataaacagaaagctttcagcaagagccagcttaaagtcttttaaagtaaagggaataagttcgtacttgcattttgggttttcacctactgaggtgtgcttgaagttgaacatcatatttagttctccttctttggcactggtataaactctgaagtcgtcttcattcccgataccaacttctccaacagtcatgatttctttaccctctggaacttgcgagagcatgtagttatgcatttctttatgatactcatggatacgtggcccatttatgaaaaattcagttcctttttggtaaggaactgtaggatcagtgataggagcatcgggtaggccctcaaccttagaatacatgctgcctacgtcaatacgaaagccatcaacgttgtgacgtagccaatagcccactgaggagtcataaatggctttacggcactcttcattttcccaattgaaatcaggttggccaagagcaaacacatgcagaaagaactcaccagttttttcgtcatatctccaagcagatccaccaaagaaagatctccaattgttgggaggaattggattacctttctcatcgtaaccctttggaggtctccagaaaaaccagtcacgctttggattagccttagaagatctactctccttgaaccattcatgctcttcagaacagtggttgataaccaggtcaacaataaccttgatacctctcttatgagcttcttctatcatttggaaacaatcctcattggtaccgtaacgtggccaaaccttctcatagttggcaatatcgtaacccatatcttcttgaggagagtcataaaatgggcacacccatatcgcatcgacacctaattctttgacatagtcaagtttggaggtaatcccagctaaatcaccccatccgtcattgttggagtccttgaaactagcaggataaatttggtagacggtggcttctttccaccatttaggattatggatgatcgtcatgtttttcttttcaatattgagcactttctatatagtcatcaagaaacagtagtttttcgcaccaagatatgtgaacaagtgtcctaatttataattcgtcagacgtttatgaacttactcctcaaaaccgtatcaattaccgtagcggtaatggaagatacaattcttaagtgtgaattactttttccggtgaattagcttctaggattgtgactatttcaatggacaatgttgcaaatagtttcaaatattcccgtgtttctccgaggattctccacggaggaaaaataatgcaaagtttatttccccgttttcttttctccgtctaggcatttacgctttcacgcaactttattatatcacctccgcggggattcaacaacgaggtatgtggagaaggagagaaattccagagaaagcagcctagagcatcctgctgcagcaacttataaacgtatctcacagaaaaggccggagaaagttcttgaaatgtgtaatttagcctacctgccaagcggctggaattatcccgagaataattccgcgaccgggcctgttcctgaactctaagaagttttggaatttccgaacgcttcttcgcatgaaagacatgaactcttaagtaaaataatatgaactggcatggtcgtaatcttttggacgacggaatatcatcgctaaccattgtaagggatgaagcttgactagatatatttaaacgaccatttttgtttcattcttattttagattgcattttttataagtcacttttagttagctcagaacgccagcaaaaaccatgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttagaccggtgaaaacacacgcaagcaaacttcaaagtacattgataaataatgtccaatgccctctgtaatataggggctttttaattcctaagactgattcgatatattaaacaccagggctactgaagactgacagtcacgttgagtcctattatatcattttactcacagaagatttggtaatatgatacttagatgggcttaacaacaaagtgttttcttgatgttactgcccatgaaaaaaagcaaatcaaattagtaggcggattgttaactttgtttattttgaaacccgtcaggactaccaaaatataacaaagtattgattatcgtcaacgctttatagatcacttttttttttttttgaggaaccgattaattaatacatcgtagcctctgcttattgcataacacaacaaaaaaatacaataatacgcaacttttgtttatagaaaaataaaaatggaacatatgatattctctgttcgtcatatgataacttaagcactttcgtgtgtacataggtattctagtgcattggaatgagatcaattatgatttcctaacccagaatttatattactaatgatttcagaattaataaaagctgaaataaaaggagtagcaatgtaataggaaataaacgagggcacatagaaaggaagaagaaaaattacattatgtggaattattgattcccttggcaatttcccatagtctcatgaaaattcctggcctattctgtattcataattccatactcttttttaacaatgaaactccggtaattaccacaatatttacttatatctcaatacgaacgcatgttctcttcgaggaagaccagcattagcgctaagcgctaagcgatgagttgacttaatttttaaaaggacgatgttggcgcgttagtgcataagaaagtcagcaaatccctttaagctgaaaaccttgatatatttctcggcctttaataatggcgcaactgattttaattatctttgaatggcttatctgtaacgaacatgtgttactaaactagtagtaagttagaaatactgtttatccagaatatgtaagttggtgcttctaaagtaatataagaccgctttaatttgttgtaacctctgaaatacaggtaaccgctgggtcatctcctatctaacttttggtaaaaatgacatcgaaaagaacaattttcgaaatattcaatttgttcgggtgtcggtttaatgctcaaggccccaatatttcataataggattctaagaattgcagaaaattcagctatgtttcacccattttgttattggtgaaaaccgccaaatcgatatcgatatagtcacattttagagcgtgccgatagtctctaaacttacacgaacgtcattatttgtaagtagacaactgggaattttaaaaaaggttgagaagattcgttttataaaatatgacgtcgtaaaagaagaaagtgacaatactgttgctgcgggttaaaaaaataattctcctacaagcttgagacctttattacaattcctacctaaattggctcttcaggggggttttctaggcaggtatctctagaatttactcaagaagtttattttctagtgccaaaaagtctactgctgatattcgcttctactgattaagagctgctttaaaccatcttgttgcaacattgagtttggacttaaagcctcaagttgttagtgatgttgcttttcaggatgacgtgtagttgatcatcttacagaaaaggaagcaatggtacgtataagatattattttaaatgagaagtagctggtcttcaaatcacagacattgtgatggcaaagcagtgataaataaagttttcacacccaaagcaacatctttccaaaccgtttgtgtgccgtggtgaacagatagaagagggcactgttattcaaattttgagggtcgggagaattaactcgttaattattcctggtgtcgaatttgcgtcattcctaaacttggatattcttatatggcaaaaaaagaattttttatgccaccaacacgacggcatattctggagtgattatagccactgctaacaagataaggcggtaacacccgattgtgcagatgtcctcatttatcctgtttccgagcatttgattaaccgtctctgtgagaccagttaaagacctctctcaagaaaaatatgtaaatttttttcagccactttatcggcactggaacgaaacgatatggtattcccagtatcagccacggccccgtgtaagccgtaaagtaaacaaaaatttttaccactaatttcgttgcgtatcaatttatactattctttgtgaaaacctacacagactaccaacagaaatttttttggtcaaacgagtccagtctggttattcgctggttcatgtaaaatgttagcaccatctacagattccgaacattaaaatcgtattatgcataatatagacattaatgagcaatctgttcattacccccttatcgtatggcaacagctattcctgatgtaatagtgatgttatattgctttcgccattattaattttgaggaagctttccaaacagattacatagctaactaattgcaattttgcgacgccataaggatacgcgatttcctccttttctttttcgcgttgttctgtgcgctctttttttcagccaaaaagggttcctgaacaaaaagaccctgttttttttctgcctgttaactctgatcttaaaaagttaccaattttctaacatttctcaataaagacccttcgataaacaagattcttgagaaataaaaatttttgtgacgtttacttttgaaagtccttgaagaattcattactaatagagaaaaaatggtgataatttttttacttcacctcctttctactatccctcttattcggattatctagctttaacttcgccagttttttcttgacacacttcacagatgatggtgccttcatgtcggcatgacgcattatctccatactaaaaaatgatccgacaatatctccttcctatttgatcagcctcttatcgttcgtaaacgacgtaacttgacggagaacggagaacttgttgaatagagaagagtatgtcggtaattgatctccgatatgagcgaatataaaagcaacatatttgctggtatgtagcgtagcttttctttccaattgacgggacatcgaaacagtatattaaccgagataaaaatgacgacttatcaaatcgatgtcaatgaaggaatgaacaagtccctggccgacttggtggcaccatagcgcccagagccactcaaaaattactgtataagtaacactaatttgatagatgtggtaagcggtgtcagtctcctcggagcttacatcttcatagaacagggtgtcatttccaaggtcgaatttggttctgaaaagccggtaaccgttgatgaagttgcctttgaaattattgacggcaccggtaagtatgtcactccaggtctgatcgacagtcatgtccacattgcgtcggttgcaggagaggctgatctgaccaagttaatgctgatgccaaagtcagttgcattactcagaataagatacactttggaagccgctctggcaagaggtttcacaacagtgagagactgtgggggtgcagaaggctttctgaaagcagagattcgtcagggatccttgaatggtcccagattaattacgtgtggacatgccatttcccaaactggtggtcatggcgatctgagatctggtgccctacctgctagtgcctttgacagctgttcatgccactttggtcaagttggtgttgtagcagatggtgttcccgaatgctacaaagcggccagagaagagtttagaagaggtgcagactttattaagattatgggtggtggaggtgtggcctctccaactgacaaaatatcaaacaaacaattttgcgacgacgaaataaaagcacttgtagatgtcgcaaatagttaccacacatacgtaacagcacacgcctacactgcggaagcgatacaaaattgtatcaagttaggtgttaagggtatcgaacacggaaacttattagatgaacgtaccgcagagcttatggcagaattgggttgctacttgactccaacactagttacctacaaagtgatgggttctgatcaatttagtgcattcttgggacctgaaaatagtagaaaaaatacagaggtgctttacaaaggaattgatgcaatgaaaattgcccagaaaaaaaaagttaaaatttgttttggttcagatttattgggtcctctatatggttatcaaacgcaagagtttcgtattagagggaaagttcaaacgacacaagagattttgctctcagcaactgttactcctgccgaaatgaacggattaggcgataaattgggacagattaagccagggttcattgctgacctactgatgatgaaatcaaatccgttggacgatataacgattttggatgaacccgagagcaacatactatttgtcatgaaagagggaaggatatattgatgtagttatagttgttttcacagtcagcattatttctgaatgctagaagcctttttttttttgaagtcataataaaatatttggcttgtaaatttaagtattgaagtcaaaatatcctacttatatcacagtgaaatgtgaggtggatatggccctttagggcccttaattttacaagttacagaatcttttttttttttatagcatttgtaaggtccgtgtattcagaaaaaaatccaagcttaaaaaagtgtatataacatttggtatctgaaatacggatctatcataaaatagaacacctcaaggaggtataaattttaaaagtttttttattgtatgctcgtgcccgttttttcttaaagtcggaatttgttatcgaacacttggcatgcgctaaagatcgttaatttacaaaaataaggcggatgagatgcctccgctaaatattgcaggggtcgctttgaatgtttcgaccaaaatgtgctctaaaatatagaaatatcattattaacagtataattaaacgttgagataaagtatttcaagttaagcaatatgaaaggatgacagaaaagaaaataatttcttaatattacagaatatgaactaaagtttgctattacgtgtgccaaattttgaattaaaacttgatatgaacctctgcaggtttattattatgttttcatgattaccaccatttatcataaccaaatgtctcacctttctttaaggtataaaattttttataatcattatcatacgttcttttccaaacgttgtttccccaccagctgagcttaccacctgggtactgtacacacaagaagatgatgacgacggagattgccacacctgcttcaacaccggcccccatgacgaaattgtacttattgaaccaagctctccatctttttcttatcaagtttaggcagaatgacattgcaaaaaataatgagtagttataaggtgtgcttggtggaatattacctgggcctgtgaaaaatacaggagtatgaatgtgcttagcaaatttaaatttagggaatttccattgaacagcataaacggctagtgggaatagcaaaccaatcaagaagaaccacatcagcggattataaatgcgccctgatgagaaaagatactttggcaaagaccagataatggaagcattgaaaaccgtgcgaccattagcacaagtgaagccatttggttgatcggtggtacataagccatcgatattatgcatcatccattcctggacaccaacgttaaccatgcctgatatgatagtggcatagatttgaacggcaaagatcaaacgaggggaaaccttcatgtacatggctaatttcaaatctctactcaaattcaagccttgtctcatgacaataaatccgtatagcttgaataataagtttgccattggtcttaaaggcagcatataaccgcagatcaattctgtgataatattcaaacctacgtgttggttagtcattgcttccaagataccttgcgggatgaaatttacaagggaaattaatattgcaataacaaatgcccaagctgggaacttagtatcgaaacagcacactgctacaaatcctaaaccgatcatgacaatctgcaaaagtaaataccaccaatcgggacaatccttatagttcttggagtagattctcatgtgaatgtcagtgccaccatttttacggtctttaaacttggcgacaatatctttaccgtggtataagatgcagtggacaaaaacggcgataacagcggcaaaatttaaagcatacgacaaaagataggaaaatggaacgaataccggtgagtattccttatatttctcaagattaatggaataatcctcgttaagaatctttgttacgttgtatttgttttgagtgttgtcataagtagaacctgaaatgacgggcatgtatttggcataccaggtattcgtaaaataaagacatggcagcactatgacgaagaatatcaacactgatgcataggtgttggcggagacgtagaatggtgtggcgaaaacagagccggacatggcttgggaaacctgggtgtagtcaaatgtaattggcaacgcaccgagaccactttgagtaccaaagattgtgttagcgatgaaattgtgtcttgtcttcgacccccataggataacgttgaaataggacagaccggtaaagaggaatccaggtacccaataccagatgaacgatccgataaggacgattaagaagaacctgtaacggggcatcgtccaaccatttgcgactgtcttttcaacttttctcgagtgcaacgaatcaaacaaggacactgaaattaaagtctgaggccagatagagcttgcagggttgacgacccatcttctggtaagacctgcagcaccataaccaatcatttgagatgtccaaaccaacaagaactgatatccgacattaagtttcatgttgtaaaagcttccctgggcgttcaaaatgtacatagcgtatgcagtagaggaagtaagcgccacggcaattgtgaccacggcgtgttcctttttggtaaatgggcccgggtttaaatcgaaaaatggcactttagaacacttccagtcgggcaagagagccagtatcctaccaattgggtagcaaacaacttgtgcaacaaggaagttgatctctagcgatggatatctcagggaaaaaaattgattaacaccggcgaaaactaccacaaacaccgtggtcaagaaccacgttctccagtggttgaggcggatggtggggtcatcctcgatggacaccgccgatctcacttcaggatatggagaattgggcaagtatgtagggtcgcccttccaaacgagaccttcctcctgtatggaatgcctgtcgaatttttggctttccggatcgcggtcctcctcatcagtagtcgcagtgagattattgacgtcctcgtcaatattcttaacgaaagcatctttcttttcctcttccatattgatctggataggaatggttgttggcgttggcgagggctccgactccaacgagtcgctctccctataaatggtactcatgtgttctgtgacgttatataattgttgcggttattttctgccacacagtcgaaaactttttaccaagaatacacagcttccgatgattgtccatatatagtcgaaacaattcattgaatagcccaaaatttgaaaaaaaaagaaaaatgatgggcaccccatgatgataagagctctctttcttcaacaacgattgctaaggcgtttacagacccatcgactgcccttgcagtgggtttgatgtgattaacaggcagcagcaacaagcaactgctgaaaaccttggtgccttgcagacggctattgtcctggattttgtgtgacaaaacgtagatgtggcgtcttgtagtcggaggtgtggcgggccggaaaaatagtggaaaaaaagaaaattaatgcgatagcgacgggcaggtagggaggtttgaggggtccgtagtatgcgtctatcgttgcaacaagggtgactaatgccatgtcttggcctttgatgcaacgtctcggaagttagtatcgatccgaggagtggaacggatgcgatttcccctccattctatcgataaggttgctgggaaacgcattataagggatgagtgaagacggagggaaagcataacgaggagagattgccgagataactgagaagacgtaatctaaaggcaacgcagcatgtctcgagttgcacagctcgactcgatagcgcttgataaagaattgtatggacagttttggtccgagttcaatgcagcattcaatacgagtgaacacaaagaggaatgggagttggcactgaacacagttgtgtttatgtgcgcgacgaggttcctgccacactatggctctagctgtacgtatggatccgcactcagtggcgtggtttttcagtgcaggaaacgcaccttgtatgtcgtcactgtcttggcagggtacgtgtggaagaagatcacacatattatttttaatgggccgcactgtgggaaccagatgatgtggctgaagctgtacaaatgggttaatttattgtatcacggctgtgatgtaaccaacttcctgaggtttctagcagcggaagggcccaatgcgagggcgtttttgtcgccgttataccgggcttttaatgtccattccacaaggttgattcgggatggttctgcaattgcctctgaattttattcgaactctgtattcgctgggttagaataccagaatagacaattgctatggaatgcactattagaactcttttccaatacactacttacgaaaagaggactcttgacctttgttaaaaaaccaccaaggtctcgttctacgactacttataagacagtttgcccccgttgcggcggttttccaaccaacccataccagatcgcttgttgtcgtgcgaactactgttacgtgtgcgttgtaaaggcgttggagtggtctatgtgcgatgcctgtggatcctctgggagactgaccgcctcaccagtgtactaaagggccccgttccctcgcttgtatctctatatatgtgtatactatattcatattcatgttgtcaaaatcggtcacgtggtaaagggtctggttttttttttttcactttctgctcaagaaaaaaaagaaacaataaagaagtggtataatatcatcatggaacgctgtacgggacgatgtgggaagcgacgtctgaaatccagtaataataaacagtgagcactttaggatagcagtagtttgcattttgcacgtttccctttccatgcaatgtttttacctcgtctcgttcggtacaggaccgagaggtttataaaaatggtacctaccaggaccttgcgacgaatcaaccacagcagcagggatccaattcaaaaacaggtcttggcccttatcaaagcaaatgcgaatttaaatgacaatgacaagttgaaaatacggaaatattggtctgacatggcggactacaaaagtcttcggaaacaagaaaatagcttactggaaagctctatattacacgaggtcaagatcgaagatttcatcagtttcatcaatcgcacaaaaacctcatctatgactacaagaggaatttatagaagagaatgtttgtaccaatgcaagaaaaacttggatctagtcaatcaagtggtctcccaagtttcatccgtaagacatcaaaagcccttgactacgcaattggatactatgcgctggtgtgttgatgatgccatcggcacaggagacatagttatggctgccgaccttttcctgctgtactacagattatttacagatgataaaaagctagacgaacaatatgctaagaaaataatatcagtattagcgtacccaaacccactgcatgatcatgttcatctagtcaaatatttacaactgaactctctgttcgaaagtataaccggaggcggaataaagttaacgaggtttcaattagaaactctttctaataaggccctcggcttaagtaatgaagccccgcaattatgcaaggctatactgaacaaactgatgaatataaactattctttgactaacgatttgaagcttcgggatgatcaagtgctgcttgcgtacaagtccattgatgaaaattatagaagaggaaatgttgcaagtgtgtattctatttggaacaaaatcaaagagcactatgtttccatttctgcacatgattccagaatcatttataaagtcttcaagatttgtacccataatagagcctatagatctatatgtagcgaaatgttttggcaattaactccagagtactattgtaataaccctttgatattaccggcaattattgacttcattacaaagcaagactctttaacaatggccaaggaactcatgcagaacattaacagatacactttacccgaaaaccatcatattgtctggcttaacaagagatgtctttcttcattgctaagaatgcatttgaaatttaacgattctaacggtgtagatagggttttgaagcaaataacaacaaatttcagggcgctttcgcaagaaaattatcaagcaataattattcaccttttcaaaacacaaaacctcgatcatatcgctaaggcagtcaaattactcgatactataccccccggacaagcaatgttagcctatgggtcaataattaacgaagtagttgattggaaattggcttcaaaggtcaagttcaccgataatttgatggcacttgtaaacgatttgttgacgaaggcacatgattttgatcctgaccacagaaactctctttggaatgtggtttccgctttatacattaaaaaactttgtcattataaaaagcgagatggtaaatttgttgccaatgccaagaaggatatcgatttggcaaaactactttatataaatgctgcaaagagaagtaaaacatactggacaaaatcgaactgtaacccattcattgcatcctccccatgtgatgtcaaattaaaagtgaataatcaaaacaggtttactattttaaggaatattgcattaagcgcactgcagataggaagaacagacatttttctttgggcgtgcgcagaactataccagaacggtatgacgattgaggaattgaagttagactggaatttcatcttaaaacatcaaattagaaattcagagttcaaaacaaacaaggagatcatacaagatattaaaaagcatggtgtgtcggctgtcaaacgttacttaagatgaacggccaaacgcacatttacgatataaataacaaagcaaataataacaaaacaaatttctgtaaatatatactaaatccaagcattgcatcctaattcttttctttttttgatcatcaaataaatgtattattttatgttatatgcgttagacttgttatattctttcatgctattctatcgttgtgttatgaattaatttatatttacagtttttcagtacattcaattccttttttttggaggaggtaacaatttcacatctttcgattgtttgatcgccgcgttagagaaatctctcactacaatttgacaatttacctctttgcataatgccttcttctttgaaggtggtactttttgcagaagttctagcccagtacttctctctaaagcatctataggaacttcaaagtcagtcaatttcgtctcatttgatatcggttcgtttggcaatacaaatgccgcgacagcaatatcctctctagcaggattggctgttggtgcttctgcaacaatcaatttaaaaaagtgcgttggaacagcaatactgggtggattgccaataacttcataattaaccctaaatttattatctatgggatcctttttgggtagatacaatggaccagtcacgattcttacactcttatatttcttagtcaatcccctacaaaagtactccaaatgcgcccaatagtctctattaaaaccttctcctacttgaggacacatattggataagtagaatgtatcatccatggcctgttgagaaaattttgcgtctgcagctggggcttgatggcctcgatcatagcccgacctaaaatagtctcttagtttacctctaaacttttctggaattacttcatcttccttgaaaaaggaattttttctgtcagcattccttgcagccaatgattctggcgttatatgttcgaggacccaataaggattttgagtttgtctgttgtaacatgagataaactcttcgcggttctgcagatcatgaatcggaccaggaaaaccatacttgaagaacccggaaggatcgacgttgaaagagtgagattgaatattactattaggtttctgggtaggtggataaggtgtctcaatgatttgcgttggagaatgtttgttcaaaagaagataggttaagccagtaccagcacccagtccgactaaaccggacaagagtatcctactgcacatgataactttaactttgggatctaataagtggggaacttaactaaatgttcttatctttatacaattgtaactctataaaaactaacaaattacttgatgagtgaccaataaccaattgcaccattgatattttttcacagattttattttttttttcttttttcgcgatgagttttatttccgtgcatatgcatccgacttgcaattagtcgaaagatttcagttgaaaggcctcttcgacagagcccaaagactgcgatttaacgtatgcctccatcacggaacctataattgctttttgttgaggacttatagtgctagaaatggcttctttaaatgaatttttgtccaatttagccaaagcaactatgccacttgctacttcgttgtctattttctctgtatatgcgctatgatatgcggcaaagaaagaaagacataaagcaattgacaatgatgccttttggtgatcttgtttgattacttcctcggaaaactgaattatcaacttagttttaatgcttgcctgcgataaggaatcgtttgtttgaatatcttgaaagaatctttttataaccaacttcataaaatactgcaacaacgggtatttgaaaatattagatattattctcttgaagccttgtagagcaattggctgcgtagcaggattattcaatgcctccgagagaatatttgcgcactgattcagttcctgaaaacttagcttagagtatccattagacagcaagatcaaaatggttgcaactttattctttgaatccagcttatgataaataacatcttttattgacccgtagaatatttctagtaacacaatatttttttcgtcctcagattccgtaagcgcttttactagtgccttgaaaagtgggagtatgattggaattattacttcacgatgactacattcataaattttccctatgatgaataaaagacatgaataaagatctactttgaacatattgtcgaagttactgatatttgattcgaacgcaataaatgtttttttcaacagactaatatctgtgggagagatttttatttcattatcatcttcttcgctggtaagcacgttatacttaataaatggcaacctctcagaaataattgtcatcagtagtcgcagtagctcatatagtttgtcaatatcttgtagaaatgtttcaggagtagcattacacttcgaatacccaatgatcaagtcactgatgatatcaacaagcaaaaattcttctttactgtcgcctgtagaaatcagtctgtccataatctcaacaacttcagtaataatatcatcctcaaatatactttttatgcacagattgctcttcaaaacattgtgtaaagccggtaaaacttgcatcttgactgaatgatcatcaatatttttgacgatagcctccaaacattggctaaataaaataaaaagaaaatactctaattcctcatcgttaagagatgccaaaatgacttgaacgtctgaatccagagtgcacccaagggcctctacgaaatttaaccagaccggttcatataactcaattttcgtacttcttggttcaatgagactattttctttcgagtcattctttacttgcacagtagaatcattatcgttatactttatcatcatgtattcacgtaaagaaatgatccataatgggactaaaatgctccaatatttcctggtaaaagagaaaagcgcatcatttgacgacgtgatggatctttgcactacctcagcccacgcatccaaaacggcaagttcaatttttcttttcgctttgggtgtaacgattatagcttcccctatccgtataccggaattaggatctttaaagttaccaagaaggtcaattagtaattgtgaaattcttcccaatttatctggtggcattatattcgatgccaacacttcagcagcaacagtaatagcaaaggacattacagtaggtgagcttcctttactaaaagcaggcattaatgcgctagttatttgggcctcttgctgttctaaaatcgacgatccaggaacctgaggatctctcatggtggagtagttcttgagaacaaaattcaaaatgtgtagtcccgttaacttcatgccttcattcctcactgtagatccacgaaatgatattttaatgagatctgcaattttgttgctgagggcaaggagcagattttcatatttttcggattctaagcacaacattaatattaaatttaagataatctgtctgctcttccattgcaggttctcagagtcgagaccaccagcatctgtgtcagtcagttggttaacattcgctattgattcttcttcttcgcctttaatttccttttctgaagatttttttaggccatttacctctagtagggctgaaacgtctctgttatagctttggaagagtcttcctaaactcatattaaatattgagtataatttatcgaaccaatgattatctcttttgaaagtatgtaatatccattcggtaaaataattcttgacagaaccggaatttggaaaaagtgcgagatatctccagctcaaattttccatttctttcatgaaaaattcctccatctgtaatttgtacaacaacgtcaataaatcaaagttttcaaaggcgcctttcagacttgaagttcgagaaatgagttcatttgagcccgtgaatgtagtgtcaaaatatgatgagcctattccagtcactattgaacttttaattatgctcttagaagcaagaataaagatttcatagtttagaatgtttttcattttaaaagtagctatgttttcaaacattttaatgctggttatgctgttgagaatattatttgaaattaacatggagagtgtaatgtttctgaacgaatcaagaaccttggtgttaagttctagaaaatttggccccacagtttcagtcaatgtccttgaaatttcaccgattgctacgtgagaattaaagtccctattatagttacagcgaagagtagagcgtccgtaaataccatacttatcctggaccaaaagctcttccatagaacttagcaacagagctgccgtctttaaatcaatcactaaatgtttctcaagaagaatatgcattgctttcaatgaccatgaatgaacaacagggtgtggatccctcattaatgcaaaaattacatcaaagtattcttcaaaattagcatattgtgagttatatttaaaaattgtagccaatgataagacatgaaacatccttaagtatggttcgtccatatctgcgacgtttttaatgaatattcttgattgctctgtaaggaatttttgtctttcttcatcgccaagtgttcttgcgatagccgctgtcagcaatcctacacaatctgccttgatttttgtgagaaaaatgtcattaaaaaactgaatcttctttattgattcgataattagctgccccactgaatagtccaactctagattgttttcttgcatgatgcgtaaagcattatgcagagcactacaaacattagcagccacagccacgcttctcaatggtgtagtcattttggagaacatggacaaatttaaagtttccataatggaatactgtattttgctattcaaaaaagggaatacagatgaaaaaagttccatagaagagtcgattaaagatgtagtgacctgaggtgcgtagcggtcaatttgggaataagacccagatccatatagtagaatcagtgaatctaaagataaaatgggtgaaattggttttgatacttctacttcgaaaatattgtaccaattgtaatccttggatggccaacttccacttattgattcatcatacttgtaagcactggacatcgataaattcacgatacggtccccagttattttgctggataggccgaatgcaaagccgttgttttgacgaagtaaagtattaattgaagattctaatactatattactttccatgtcgtccttgttactcactttcctgttaccaatatctttcaagcttcccaaaacggaactacttgactcggtgtaaagattgggatctgaaaaattcttcacgattaatattagtaaagaactattaaaatcgctatttatgtatttctccagcttaaggtatacctgtaaaattctgttttcattatgcagtaaagcattgtcaatgtttttcgatttcaggtcaatggaatgattaaaattggagcacttagttagcaaatatgatacttgtttagccatttctttatcaattgtcgtattgcttaaatacgtcaataaacaagtcaatgcatgatttcggatttctaggttcttgtataattcatcctcgtcgtggtatgtgtaggtatgtgttaataaaactttccagaaaagaaatagttggggtatctgcagcttcaaatactgttcatctttataattcatcaatcctatcaataatatccagcataaaagacccttgaagtacaaattagaagaggtagatgtagtattattcttaatgaatgatgtagaaaacactgtaattctcatgatcaactcataggaaatataatcgctctcggcacctttgattagatttgctattataaaagcatggccatgatttttatgaaaaataaattttcctgtagatttaaaatcagtggatagtgcacgtaaggagttttcaatggtctccgaaagatattctggacagttgttcaaaaaaaccttcaaaatttccacagtgtgaactcgtatcgtaaagatttcacatgtagctaaatcaaccagtttatctctaatctctttaacggtattttcctcagtggtgaaagtagaacctaagtcgctgattaacacatacgtgaagtcaagctgcagtaatgtaagccactgtgtttcaggcttcgcatcaatactatatttgaaatttgaagctgaatcacttttagaggagctctggtaagtatcagaacaacctaggatgtagtacaacatttgagtctttgcagaatcattcaaatgtggcaatattacttcatgcatatgttgaaagtatctcaaataccttgataatgtattcatgctcctattattcacttcgtaactgctgaagacgccgcttaaagagagaactatatccaaatattttgagttactcaaaaaagtgttgtcagctaataaattcaagtttatcaaatgaataatagattcgaagcaaccactttccacgtctcgtgtatcacagtttaagaatatcttaacgtagatggaccatacttcttgtagagttaaaatatttttagaaaagtaataatcaaataatatctccgctaaagattttgcggtaaagatacgagtttcgtcgtttgcaaaaccataaacacctatttcaccttcggtaaatctagaatatatggtctctataatatcatgggagtgctctctgataaaattagtttgtttgaaatgagctgtccagcattcaattaggacagacacaaaagtaactgaaaagtccttctcatcagtggaaatactgtcaaaaacggttttggatagtttcgaaaatttcgcatatgtggctggatcaaggattttatcatcattattggaatttcttagaatcgcattaaaaagctgaagaagggttgtcatgaaggtagcatgataatatttacttttctccataatttttttcaggtttttgaaaatagcattaaataacaatgggattaaggaagagatgctacttccaaaattttcaaataattgaacaagtatggtacatgcgatatcttttgccggtgagtatatgtacttttttttttttgtacttgacttcttcttttttttcttttggttagggtcggtatctccatcatcaatggatacatcttcttcacacaatacgtttgttaagaatgctgcggaatcaaaaactacaccaggatattcgtccttcaaacgccatatggaaatcgtatagagctgagacaaactgataaacactgaatgcagttctaaatcatccgtattttctagtacggagatatacctcacaaactcatccagttgagtgtgtatttccttaacctcctgtatttcattatcattaacttctttcaaacatataagcttttccaaattggtggttatccaagttaataaatcgtgaccattgtttgatgatgtttctatcactttcttgagggatcggtttgccattttcgtggcctgggctatttattttatcttttagttttttttaaacctaataactattatttcaattgaataataacaaatcactgtttcaatatggcgatgaaaaaaaaaacggccacacacggtatgccactatgtggtgtgaggaagcagataaaataataatacataaaaagaaggatgtagaagaatatacagatataaagaagtcgcgagtttaaaggttcaatttactgttgggtcagagctgaattctgaggaaaatatttgattgttggcagaagaatcttggccaattagtgctgaaaaatcgatgacatcaggtaatactctgttaattgagtagtcaaattcctcaaattctgctagaagtttatctaagtattcttcttgtgcagctgtcgttgtatggctctcattattggtattctgaaactttagatcagcttccccttgtggaagattcagaatggaacgaagactcgtggctggagtttggtgatgctgctgtccatgatgtaattctccttggcacttcgtaaaattattatttgtctgcaactggggcactaaagctccactactttcttgccgttgcaatttaactatattcaaaagttgttcagataatacagaggtcttctcgttaaactctttgaacaattggttcaatacttcaaaagtacgtttactcgcatttgaagcacccttcaaaagtgataatatttcactgccaagctgcgtagcgttatgaatatccgaatcaaccttcccatttcgtatcaggcccttttctgtttggtagacataaaatttgaggcaagcaacactaaaaaagattgtatgaatggaaaaccagtagctaccactcaaaaggttttgcgtaatcatttcataagataattgaataacttttttggcaacttcaatacagttttccgccatgtgaatttgaaattggaactctgggatatctaacgggtctatagaaatatagtggtagaatggtttatagagtacgattttggatagaaggaagtccagatataataatttcttaggtttagtgtatggagaactagtatcatttgcggaaacagttagaggtggttgcgtttgacgataccgtattgtgtcaaccttcaaaatatctggtaattgggcataccaattatctaattgatcgttcaacgatacaatctgcgtcctagaatcctcttctaatggttttcttctcaaagagtacattagcttgtagatccgagacatgattaaaataagctttgtatgcttattattcattccacaggaacttatcgttcgccaatcttgaaactttattccaatagtagatatattttcatcgtcgacgtctagaggaaactcttggtcgatatcagattcgtcgataccgcttggaaaaccaagaatacaattcatgtacagatctagtttgtacacagaccaaaagagccttttttttgtctcatcctgaatcggagtaggaccaactatggaagaccgcctgtgtaaaccttcctttaacgcagcacgcagagcgataccaatgaacgaatagcaagccttcaagtttgctgaacattgcaaaaagatcgtcatcataaatatagcttgaatggaatagatgtcagtaatattagaaaagtccaaagagtttttggcctctaaaaagtatctgtagccttcatcagtgtaaaattccctagttgctttactatccttgctgagatcttccttagaaaaaagggctccgactgctaaaacagaataaattaaaggttgtgttttcacttgttctggagtatattgcttgccatgtttttctgcttcgtatatcgagtccaagatagaaatgatagtaggtctgtgatagaacctaaatagcacacaggcacaatcccaggtcttttgaataaatttcaaggcaatctctctgggtggtaatggaacacttgtttgcatgtgccaaggcgtatcttttggtagactttgacgtattacctgattaacatttaattgtccttgaagtagacacgttttaatagtgtccaaaaaattctggctgttaaaagaagaagaagcaagtatttgacggagtgtttcaggtggaaagatcgtctctacaacctttttgtaatcaatggaacttatagggcccttgctatcttcccgttcgtgggaagctctctgtgcatataaggaactatcatcgcttacttccctatcaaataccgatgagttccgtggggggcgatcatatttgcattcgtaactattagtctggcaaagtctacatggtatattaccactacatcgtactttcctctttctgcaagctatgcaagctcgatgtgctcttcctttcgttggcttcaattcgttggtgcccgcatctctagataaaaccaaaatcttagatctcttgcctttcaacttcttcattgcacacgaaataggctttccagattctttcggcgtcatctattgaataattctttggtctaagttgtatgtattactctttaaattgagacaatcaaggaaatcacacatataaaaatactgtggatctgaaagattgggtttttataggataaatgcgtataaaggtagatcctaggattaattattatggtatttacatatcgccagaaacttatatatactcccctcacgccggattattatttgcgatcgtcccatcgcttctttatgagctcgtgtaaatgatgaccttgtggacgccccattttcctttcgtacacatagtagctgagacagcctaccataattgccaataacggatcagaaaatctgcaatagagaccagcttgggaaagagcacatcgacttgtttgatgttgcctcttcgaaacagcaaatggttaactatgcgttagtaaaagaataagtgtgaaaaaaaaaaaaatagaatagcgtatgaagaatgaacatactttcctaatagaaagggagcgtactgaaccatgttatcgatgatcttgtgtggaatcctcttataaatggagtgaacatttgtatgccccttgtgtgcgtgtggctaacagggaaaaatagagcccgcgtaatcttgaataatctaatatgtgaacagtcttttatttccgcacttcatacctatatagagtaatataattaatcattgataggaatttacataatgcagcaatctcgtatgcctaggccgtacattaccttttcaacgtctttccgtacacgaacccaatcgcttctcctctgaacaaattcataaatttcctcttgcgtaaaaatgccattgaatttcccaagatcagaaataagctttcccaactctttcgagtccttgcctgaaatgatgtataactggccaatagacttaagcccaacaaaatagggaacaacatttttttgttttaatttgttagcaataaaatcgtaaaagtaatttaaatcgcagattaaccaaattgcgccctccgtagatatgaagcacttcttcagatgtttgacgatttcattaaagaatctctcgccaatttcttgttggtacacgtcaatagtacccttgtctgtggcaccagtcagtagaaagcaatgattagaaagtaactcgactaccctgatagcacatttggttggctttatatcccttattggagaattcctagagggtggcggtggattataatcgtcaggcaattgaagagtcttgaatacaaatgagatttcatccattagtttgtttataccgatatttaaaccttcggctacaaaatcatcgatagaagtctcaaaatttttttttaattggataacatcattaagaaaatctttatttttatcgataatttttttgggaatcaattcgttcttgtaaaaaatggaaatcatttgtaatattatgtcacctatattgataagttcagtgaattgtactaaaggttcgacttgagtattggctggcgaaagtgaattgaattttatttctatttgttctatttcgttaggattatatttttgtagtagcaggattgccttttcaaatgcaggtttaacgtgatttttattcaattgtgtaattaaaattttgaaaatctcttgacagcgtagcttgatcaatggtagcaaactttcaatcgtatgaaatttgtaaatttgatccgtcttttcgcttgtttcctgtaaaattttgtaacataaatcgagacttattaacgatttaatgttttgcaagttattggaaattaaatttaagttgtaggctagttgtagttgttgctttagcctttgattttcattgttcgagaacttgaaaatcttggtgaaggaacttagaaagtctagtttatcattagaaatatcagttgaatgaactgattgatggatcgtacttggttttgaatccgcttctgggacagttttggaggtttcagtaattattgagaggtcattcggcaattcattgttacttgcactcgaagcatccgtttgatcttttaaagtgttataaatttttgcgttttgctcacgctgcttgtcttgaacttgtgtgtcataattagctaattgtgagttgatcaatgattcaaatactctagttgtctgattcatatagttgacaacaaagggctcgagatacaggtttaaaaggtcacgaacaactttacggaaatttgcgcctgcgtttactgagtcgtttaattcagtatcaaacttttttataaatgtgaaataaagttcgggtacgcattcataattggctttactatcctttccattttcttttaaaaattcactatagcttaataagatattgtttaaaatatctaataaaatatcttggataaaggactcgatgaactgtaatattacagggaactcatctttgaataaaatgtccgctaatttaatcttttcgttgaggaaatcccttagctgattgagaaacgtatctaaatttttagaattaaatatcacggtactcccaccgctgtcctcttcccttggttgttcggcccaaaataattcatcattagacggcaaaaccgttaaactgggaggcaaatcagcctttgacttgaaaaattcgatagcattgctttcctcattagatatcaataaaattttcatgaaacgagcgacggcagctaaattattagactggtaattcaattctgactctttgagaacagaattaatgaagatttccctaagaatgttgaaattagtttcaatcctagtaaatgtttctatatcatttttattcgagaaattgtactttttgataaaatttagaattcttgtttgtttcaacggatcgttggaatatgaagtaggaaagaaatttgctagattattattatatagcttcctagcgtatgagttataacaacggtaaaatttcacaaagatttttttagaattttgagcagtgaaagatttgtatatttcgaagatgcgaagggaattttgattatcattttcatccagcaacgtaatttcttcttcttcatttgaatgcacctgttggagacccattctagtcaatttcaatgaccaatactttgaatcatttttgccgttaatgattgcataaacccgtttattcacttgttgaaaactcagataatctacagtagataaatatgaggcaatattggttacaatctcgggaacttttagcagatcatccattttaccgatttcctcaaaagcttttgttttcttttggtttttctattgtttgtctgttgaccattttttgataaaataagaaccttccttcaacgaaatatttcggcaaaagttagccttgaaacacttaaatacaggaagaaataaggtaaagcgtaaaactaacagcaataatttgcagttgtataaatggaaccagaagatacccagctgaaagaggacattaaaaccacagtaaattacataaagcagcatggtgttgagtttgagaacaaactgctagaagatgagagattctcattcatcaagaaagatgacccactccatgaatactacaccaaactcatgaatgagccaacagacactgtcagcggtgaagataatgacagaaagagtgagcgagagatagcaaggccgccggattttctgttctctcaatatgatactggaatatcccgaagagacatggaagtaatcaaattgacagcacgctactatgcaaaggataaaagtattgttgaacagatgatttcaaaggatggtgaagccagattaaactttatgaacagctcacatccgctacataagacattcactgattttgtcgcccagtacaagcgagtatattcttttactggtcaagaaatcaagaaaagtaagagaaccattttagataattgttttgagagaacacagtattgggaatttgagaaagataaagaccgggaacatgataagctcgtagagttgtgcaaaatacaatttgcagccattccatgggataaatttactcaagtggcaaaattttctatccctgaagacacagaaatcttcgaaggctctctagatttagaacagatgaggctgcgaagagtacaaactggtattaagttattcgatagtatcaagccgacaaatgaagaagaaaagatagtatccgaccaaggtaagcaaaaaggaggagatagtaagggcaaaaagcgtaaaattagagctgtgggagagacaaggttaaagaaaagtaaaaaataagcctcatgaaaatcaaagttagctagaagtatgtaaaggttgatgatgcaccgtaattgagcacatgtatcactattaacggcgtacgtattttggcgttttttcatgttgatgttattttgtatatagaaagtgaaattctcgaggatatggccctactggataatactattggtagcgtgaaagaaggccaggatgatagatatcaacgttaataacatattttttagatcttattcagttgatcctaactctggtcacgcaatttatgtctttgattcgacttatttgccagcatctgatgaaattggcgataagcaagtttatgacttgcttattaatgccctcatggatcgattggtaatgaaattgccacaggcaccatattcactggtgattttttcatctgggttttcccagagaaaaataagctgggtttacggtattaaaatgtttgcaaagttacccaaagagaccaagttctatttacaaaagatttttattgttcatgagtcattcttcgttaggtcggtctatcaagtaatttcaaacgctatgaactttaacttcttggactcaaaagatagtcagcatgattttccaagtttagttcatgtcttggacctgacttctttatccgagctaatagatattacgcgacttagaatatcgttgaacgtgtacttatatgattaccagatacgcgaacatataaatgtcccggaggaatattataacagattgacccctctggcaataagacagtataggcagttagtattcgataaaattttcaagaaattacagaatgacgctctgttgtgtgaattgatattccagaagccgggaaactataaaaaggtaaacatttttttggatattatcaaaagaaacaactacattgatttatctcaatgggatatttattctttggcatccgtgtggttgaattacttcattaagaataaagccaaacctctaatcccaattgaattaattccgttaccaattgttgatgatctaaagttcacaagtgaaacattccgcaaaattattaaattcaaccaataccaggacctctttatggtcataattcctttttttaataggatcatagcgcatggtgaatcgactaaacatgattcaaggaccctaagtaaagctttaactccggcgttatgtaaggaaaaactttccatgatgactaatgatcgtttagctattgggtcgagatatattaaaaatttactggactttttccccgaaatcgcgaaggaaatatcatcacctccttcatccgtatcatcgtcttctactatccctgttttgcctaagccaaggaagtcgtcgccaaccagatacagtgaactaggctgcttaacccttcctagaagtcgaagccctagtccacaaagatctgttacgtctccaacgtacacacctgtcgcattacaaaatacaccagtcttgaaacctaagtcttcaagcagaaatgtttcatccccatcattcaatgccaaacctccacttcctattaaggcagttacacgaccacaactgtctctaacttccaattctaatacagatttggcattagcttcttcttctacagatacattatcctcaccgacgaagactccatcagcagactcgcttccattgagtaacagcagcaccgatttaacgatatcagataatatcaaagaaatggttaaggacgagccagcaaaggataaaaattctgtggaaacagatatattcgtacaacagtttgaaagtttaaccctcgtccaaaacgcgaagattaagaagttcgacaaagaactacaagaaaagaagaagaaaaatgaaactacttcaaagacagcagataaattctctcaaaagggatattcagatattaaagcaagcaacaaggttagcaggctagctgcattgtacgaagaacgtttacaaggtttacaagtaatgaatgaaatgaaacaaaggtggtaacttacataattgtatctttttaacacatacatattgcatatacgacaacaaaataccccccacccttgagttaagccgtagttgaagcagtcgagatctcgtgtataatattatatatcaaacaatattacgttttttatagtaaataaataaataaataggtaggttatttgcaccgtctatatgcagagtctatagaattgtgtaaactagcttatgactattaaatcggactcttaatttttagctaatatctcttcagaatttattcgtttcttcgtatattaccaatataattgattgctgaaccagctttgaaaaaatcgatttgatctttagacatagtatgttttgccttgatggtgaacgattcaccgtttggtttagtaattttaacatcaatttcaccaccgttattaccatccttagcaatcatgtcaactaggttcaacgtttctaaaacatctccgcttgatattttatcatagtcagattcgttggcaaaagtcaatggcaacacaccttgtttcttcaagtttgtctcatgaattcttgcaaaagacttaactaaaagaatctctccgcctaaaaatcttggtgacaaagcagcatgctctcttgcggaaccttcaccatagttatgttccgctatcacggtccatggtctaccgtctgatttccatttcatcatcaaaccaggaatatcatattcagttccgtcaaggtcataagccttgttgacttcaccggtttctttgttttgtgcaccaatcaatgtattgtaagaaatgttttctagatggcctttatatttcaaccagacgcccgcagcggaaatatgatctgttgtacatttaccttcaactttcaaaagcacgtttgtcttcaattccttcccgttccaaggtttgaatggctctaataattgcaaacgatcagaattagggtctaccttaatctctacattgctatctggctttggatccatttcaggataaaatttgtctctaccgtgttcaaatcctctttttggtaactcatcaccctttggtggttggaatttgaaatccttcccatttggcaatttaattgagtcagttagcggattgaactgagcatctccagaataactcatcgctgttactatttctggggatgttaagaaattcattgtattcctattaccatcgtttctagctctgaaatttctattgaatgatgtaaaaatagtgttcgtttcttttgatgttttcgagacatcttccctattccattgtccgatacaagggccgcatgcatttgctaaaactttggcaccattttcttggaaaatatcgatgattccatctctttccaaggtagctctaatttgttctgaaccaggggtgacaaagaaggggatacgtggtttcaagccggctttggaagcttgcttgaccaagtcgacaacacgactcatgtcttgataagatgaattggtacatgatccaatcaaaccagcgctaactttttggggccagttttccttcaaacttttttcggcatattgagatattggggttgaaaggtctggtgtaaatggaccattaacgtgaggttcaattgcggataagtcaatttcaataactttatcgtattgagcatctttgtcggctcttaagaagttaaacttgtttaaagcaacatcagctgcttcagcgacctctgctctattagttgcttgcaaataacgcttgtgagcttcttggtaagggaaagttgacgttgtagcaccgatttcagctcccatattacagatggttgccatacctgtgcaagatagagtggatacaccttcgccgaagtactcgacgatataaccagtaccacctctgacagttagtaaaccagcgagctttgtgattacatctttaggagtggaccatccgtttaactttccggtcaatttaacacctaaaatttttggtgcttttaattcccatggagtgcctgtgagggcatcaactgcatccgcaccaccaaccccgatggcaatagctcccagaccgcctgcatttggtgtatgggaatcagtacctagcatcattagacctggagctgagaaattttccaaaacaatctggtgaatgataccagaacctgggccccagaattgaattccatatctctttgcgcaactctccaagaaatcgaaaacttcttggttggtagctatggaagagggtaaatctttagtttcaccgtccttacctacaattaaatgatcacaatgtatggatgctgggacagatgtttgatttagaccggtggtcatgaattgtagaagcgccatttgggcagaagcgtcctgcatagctacacggtctgggtttagcttcaagtatttattaccacggatggtggacagatcagaagaagtaatcgattcttcaggatcgcaaagatgcgagtataaaattttttctgctagtgtcaatggagcattgtttgttatttgtttaatcttgtctaggttggtcaaaagttttgcataaggtggcacttttgtttgaaaatttttagatacagaggggaacatattggcatgtgttgccaaatgcctctttatataaaacctattagctgaagatagcatcgaatctcttgcttattgctcttagagttttatgtttaaagaaagtcgaaaattcttatttttgcaagtgcgcaaatcgaataatacgaaaagatgaaaatattttagtttatatacatgtttgatgccataccatctattgacataatctacgatgtgagagctgtatgatattgtggaactttgtatatattgaaaaaattttccagtggaattttactcgcgatgactcaagagcgtgaaaaaaaaaaaaaaaaaaaaattaattgctaaaaaatcaaatatatgcttccaatcggatttgaaccgatgatctccacattactagtgtggcgccttaccaacttggccatagaagcttctattttatatttgcctgacctattttaacggttatattccacaaacattttaatcatgaagcaatttttttgatgttgatgtgagagtaataagcactgtgctgagaagaggatcaacaacatgatattctacggaacgtaaaggatacaatgttattggactaagaatcgtctatcatcttaagaaatgggtggatgatcggacaattattgagaaggtttcattgtggagaacaaatcgcaatattgtgcaatcctttagatatgtcaagataaaatactagggaggcttcgccattcattaaagagtatagctaccgcatactgtttagtagtatactatcacatgtggtgtaaaaagataacataaagattgagaatcagtcatcaaatgtaatggaagctgaaaatgcaaggattgatagtgtaataggaacgaaacatatgaaaacggaatgaggaatagtcgtattattagtatgtatagattccatttgagaattcttatatcctcgaggggaacttctagtatattctgtatacataatattgtagcctctatcaacaacggaatcccaacaattatctcaaaactcacttatatctcacaaaacactcaatagcgacccttaaatgttactgaacctcatattgtttcgctctgctcccttatatattgttaatgcaatcgggacagctcactgactgaacggtgaatagtggctcccggaaagctgagagttgtgaactcgccacctctgttaagtaagtcgtaagctgttaaagctgcgtcacgagtaatgagctgccagttcggcctctgatcgctgtactttatggtaaaaagatagttcctagtagaagacgagtcatactcgtaaacaagcaccgctggatactcttctctatcaagacgtaaagcgtacttgtaatctctaagttcgccaatccaaatttctgatatgccactcattatcctcaccccacatgctgacaccttatacattcaatatctcccttctcctacttaaccttatgttaccctttttttttggcttgcatttatatttggtttacatagcaacaaccgatagcgggtaacagcattaagcttcccatctcccgttcactgttattacctttggcacgtaaagggccggctaataatgtcgtatttccactgatttggatgtatgttgcatggtgctagattgtgaataaatcatttccactggtttctagcagaggtaagaaaatcagtagtagcggcagcagccaagaaaaatggcagcctggcaagcagcgaaggccatctgtgctgcatttccacactccttgtatgactgcatacgcataaagaggtgccttgctgtaggcgtatatgatcctaagcaacagagaaaccacggttctcttctcttcttatttcgttattgtcttccctttttactatgggtaaagtcgccctaaagcggggcgctcacaatatcgccgcagctacagccgttttttttttttttgtttttttttgcgctgcttctcgaagaatgaatggctcactgaaaaattttgattcatcgatataaagaacactgttcacttcgatgtcatccggccaataaagttgtttttaggataaacgagtaagtggtagctggtacaggatcatgagattttcacacttcttgaagtacaatgctgtcccagaatggcaaaaccattatatggactacagcgagctgaaaaatcttatttacacgctacaaacagatgaacttcaggttggtgataacgaagaaggatttggcgcaggaaagagctctaacattacagataggttcaaaaacaagttttcttttaaaaatgcgaaggaagatacgtcttccggtatgaacaaagatgcaggcatcgttgaggaaaccatcgagttgcgagagttgcctactgctcagacggtcgctgccaaaccttctcctttcagaagaatgaaggaaaagatattttacaaaagaaggtcgtcttccgcatcgtccgtctcctccacggccaacgaaaatctgcaattagacacttatgatacgtttgttggtgatttaacagctgaaaaacagaaagtagatgatttttataagaggacagaagcgaagttctacgacaaatttgacgcgctggtgaaggacctgaagaaaatcggagttatagaatacgatatcgacgatgatactctgtttaacgaaccgattgccagcacaaatgacgaagttcccccactagacttggatgatgacgaagacgacgacgaattttacgatgatcaatctaatattgaagataatactgctttgctgcatcattcgcagtataacattaagtctcagaaaaaatcgctgttgaagaagtcgatcgtaaacctatatatcgatctttgccagttgaagtcgttcatcgaattgaaccgcattgggtttgcaaaaattacaaagaaatcagacaaagttcttcacttgaatacaagaaccgaactgatcgaatcggagcagtttttcaaagacacatatgcattccaggcagaaacgatcgaattgctaaattccaaaatttcccagctagtcacattttatgcgcgcatcactgaccggcctcataatatctcgcatagcaagcaagagttgaaatcctacctgcatgaccacattgtttgggaaagaagtaacacttggaaagacatgttgggactgctatcgcaagctgacgagttgacaccaaaggaaacagaatataatgcaaataagctggtaggcaagttagatttggaatactacagatggccactacccagaccgataaacttaaaattcactagtataaacaacgttgcactaccgaaattatttttcaccaagaaagcatacaagatttactttattattctagtcactggactcttgttaggaataaagaccttcaacgacgctgctcagcaccgctgcatggcccttgtcgagtgtgtcgcctttttgtgggctagtgaggccatcccattacacattacagcattccttgtaccactacttgtagtccttttcaaagtcctaaaaacctccgacggggctataatgagtgctgcaagcgcttcatcagaaattttggccgccatgtggtcttctacaattatgattctgctggcaggttttactttgggtgaagtacttgcacaatataacatcgccaaagttcttgcctcgtggttgttggccttcgctggttgtaaacccagaaacgttcttttaatggcaatgtgtgtcgtgttcttcctatcaatgtggatttccaatgtcgcagcacctgttctaacatattcgttgttatctcccctattggatgccatggatgcagatagcccatttgcgcaagcattggtgttaggtgtagcgttggctgcaaatatcggtggtatgtcttcaccaatctcttcacctcaaaacatcatttccatgtcgtacttgaaaccctatggtattggctggggccaattctttgctgttgcattgccatctggtatcctggccatgcttttggtttggattttattgttcactactttcaagatgaataagaccaaattggaaaaatttaagcctattaagacgaaattcacagttaagcagtattatatcattactgtcactgtggccactattttgttgtggtgtgtggaaagccagattgaaggtgcttttgggtcatcaggtcaaattgcaatcattcccatcgttttgttttttggtaccggattactatcaacacaagatttaaatgcctttccgtggtcaatcgttattttggcaatgggaggtattgctttggggaaggccgtctcatcctcgggtttgctatcaaccattgcaaaagcattacaaaagaaaattgagaatgatggtgtttttgccattctatgtattttcggtatcctgatgttggttgtgggtactttcgtctcgcatacagtatccgctattatcatcattcccttggtgcaagaagttggtgacaagcttggcaaccccaaagctgctcctatccttgttttcggttgtgcattattgtcatcctgtggtatgggactagcttcttcggggttccccaatgtcactgccatctctaaagtagatagaaagggcgatcgctatttaagtgtcatgactttcttaacgagaggtgttccagcttctattttggctttcctatgtgtcattactctaggttatggtatcatggcatctgttgtcaagggtaacgcaacctctgcgtaagagatacgtctacgatagcatgtaacagcgtatatataatctatatgtattcgattaatccaacacttctgttgtgtagtctaatgttcgaaaaaaaggtacgcttccctgttataatcaggtatatttcgttattcttataagctaaaagattaaaaatttttccactttccttgaaatttggtcggttcgtggaaaaatattattacgtattgaagaagtgcatgaagataaaagatgggattactggaaaaataaagggaggaaaatcctgcagaacgttgttgtttcaatcgaaggtttcttcattcgaaaatgggttcttcagatgtttcaagtcgtgaatgttcattggtttataatgaagatcccgatttcaccgatggcacaacaccatgtgatcggttgggagtggacttgatgaatgttctagatgacaaggatgaaataaagcaagagtctgtcccagtctcagatcgtgaaattgaggatacggaatccgatgcttccgctgtttcttcatttgctagcgctaatgagttaatagctgagccacacgctgcaagtgaaactaatcttggaactaatggtcaagatggaagaaatgtcttagaacaacaaagagacgtggttgctagactaatagaagaaaacaaggaaacgcaaaaagagggtgataaagtctgtattgtccccaaggtttggtacgataaatttttcgaccccgatgttaccgatcctgaagatataggccctattaatacacgcatgatttgcagagactttgaaaattttgtgcttgaggattacaatagatgtccgtatctgtctattgcagagcctgttttcaattttctatcagaaatttacggcatgacaagtggctcttacccagtggtaactaatttggttatcaaccaaaccacaggggagttagagacagaatacaataaatggtttttcagactacattacctgaccgaaaaacaagacgggaggaaaaggaggcatggccaggacgattcaataatgtacctctcgatgtctgcgttgaatttagtacgtgatttggttgaaaagagtatgaatctgttttttgagaaagctgatcatctagacgtgaatgcggtggattttaaaatttggtttgtgtcagagggatctgatattgccacagatagcaatgttagtacttttttgaattcttcatatgaaataactccgcttcaatttctcgaactaccgataaagaaactactaataccagacatgtttgaaaaccgtttagacaagataacttcaaatccgagtgaccttgtcatagaaattaaacctatagaagggaatcaccattggccttcaaactattttgcttataataaactcgaaccagcatcaggtactactggtttggtcaatttgggaaatacatgttacatgaattctgcgttgcaatgcctggtacacattccgcagttgcgtgattatttcctttatgatggttatgaagacgaaatcaatgaagaaaatcctcttgggtaccacggctatgtggctagggcatttagtgacttggttcagaagttgtttcaaaacaggatgagcataatgcaaagaaatgctgctttccccccttcaatgttcaaatccactatcgggcactttaattcgatgttttctggttatatgcaacaggattctcaagaatttttagccttcctgttagacagtttacatgaagatttgaacaggataataaagaaagaatacacagaaaaaccatcattatctcctggtgatgacgtgaatgattggaatgtagtcaagaaactggcagacgatacttgggagatgcatttaaagagaaattgttccgttataacggatttatttgtcgggatgtacaaatcaacgctatattgtcccgaatgtcaaaatgtttctataacgtttgacccgtataatgatgttacattgccgcttccggttgatacagtgtgggataaaactataaaaatttttcccatgaactctccaccacttcttcttgaagttgagttaagcaaatcgtccacttatatggacttgaagaattatgttggtaaaatgtcgggcctagatccaaatacactatttggctgtgagattttcagtaatcaaatctatgttaactatgagtcaacagagtcgaatgctcaatttttaaccttgcaggaattgatcaaacctgctgatgacgttattttttatgaattaccagtaacaaatgacaatgaagtaattgttcccgtattgaatactagaattgaaaaaggctacaaaaatgcaatgttatttggagtccctttctttattacgttaaaagaagatgaattgaataatccaggtgcaataagaatgaaattgcaaaacaggtttgtccatttaagtggtgggtatatcccatttcctgaacctgtaggaaatcgaaccgattttgctgatgcttttccattattagtagaaaaatatccagatgttgaatttgaacaatataaagatatactacagtatacgtctattaaggtgactgacaaggataaatcctttttttccatcaagattctgtctgtagaaaaagagcagcaatttgctagtaataaccgaacagggcctaatttctggacccctatctcccagttaaaccttgacaaagctacagatatagacgataaacttgaagatgtggtgaaggatatctacaattattcatccttagtagattgtgctgaaggggtccttatgcaagtggatgatgagggagataccgagggtagtgaagcaaagaatttttccaagcccttccaatcgggagatgatgaagaaaataaagaaactgtaacaaataatgaaaatgtaaataatactaatgatcgggatgaagatatggaactaacagatgatgttgaagaagatgcaagtacagagccagaattaacagataagccagaggcgttagataaaattaaggatagcttgacttccactccgtttgcgattctttctatgaatgatattattgtttgtgagtggagcgaattgggttcaaatgaggcattttccgatgataaaatatataactgggaaaatccagctactttgcctaacaaagagttggagaacgctaagttggaaagatctaacgctaaggaaagaaccataaccttggacgattgtctccaattattttccaaaccagaaatactaggattaaccgattcgtggtactgccctacatgcaaggaacatcgtcaggctaccaaacaaatacaactttggaatacaccagatattctgctaattcaccttaaaaggtttgaaagtcaaaggtcttttagcgataaaattgatgccacggttaatttccccattacagatttggatctgtcgaggtacgttgtctataaagatgatcccagaggtttaatctatgacctgtatgcagtagataaccactatggtggtttgggtggtgggcactataccgcgtacgtaaagaattttgccgacaataaatggtactattttgatgattctcgagtaactgaaactgcgccagaaaatagtatagctggatcggcttatttgctattttacattcgccgtcataaagatggcaatggattaggcagctctaaactacaggaaataatccaaaagtcacgccacggatatgatgagcgtatcaaaaagatatacgatgaacagatgaagttgtatgaatttaataagactgacgaggaggaagatgtttctgatgatatgatagaatgtaatgaagatgtgcaggcccctgaatatagtaatcgtagtttggaggttgggcatattgaaactcaggactgcaacgacgaagatgacaatgatgatggtgagaggacaaattcaggtaggagaaagttaagattgttgaaaaaagtctacaagaataattcaggcttgggttcatcgagtacgtctgaaatatctgagggatgcccagaaaacgaagtcgctgatttgaatttaaaaaatggtgtgacactagaatcgccagaataatgacatgagtttatatgatagataaaattaataaatttccacatgtataatacttttcaatctttttcgcctactatttactgcctaggctaataaattatatgtttttgtcctgggcgcgacattccaaaaaaaaaataaaaaagaagagaaaatactggcttatgaatacaaaaattacataaacgaagcaaaatgattatttcgaataaaacagtctatatataagtcaaatacaagataggaagaaaaacagaaaaaaacaaaacagaaggactggttaattgtttttgttgatcttcttcttaccactagcacttccacgtttgtaaacctcaatatagaaagagatgaacaaaaacaagtaggatgtaagaatggctgcaccagcagcaatagccgtcattgaacctaagcaatcctcacactgtggagtacaagcatttttgaaatatgcagcaacaatcttctgataaagcacgtaataaacgacaatgagatcaagcatgaactgcacaatttgtagtcttgtaacccaggctttccaccaaacacgaattccgctagcagaaaggaaataataccaatacataagaacgtgaacagctaagtttaaggtgacaggaacccatgtaactgctgtgtaaccaaccaattgattatagcacagtaaagctgtagcaccatgatggtatgtatgtaggaaagtcaactttctatgtttcaacaccatcaagacagtgtctgcgaactccacaaactttgtcatatagttgagataatataatgtctccatcggttgcgtccacgattcaacattacaaacagcaaaatacagcccatggcgatacactatgggtagcatctgttccaccatcaaaatcaaccataaaaaggaaacagaagtcaacatcaagttatggacttgagaaataaatctcaacttgagaggtttacatgactttaccagggacctcccgccaaatataaccacataatacatggcaataaaaagcagtaccggacgaggttcactcaaaggctgcttcccaacggtaaactcaaaatcctttggctggaagcgacctgcagtggcccacccaaccgcacgattgaaatagtcccacaaataaatattaaaaaaaggcctatctattgttgggcgaaacctagaggctttctcgaggcaaaaatttttccaatcacttaccatacttgcttgcaaatttagctctcaagttccttaaaattgataaggtatcctaccttaatattcatatcagttagtcttatatacttctacctctttttctggcttcctttctttcccttatgtccttcggtttactaatccgtaaagccgacgcgggtaagccaagaccctgagtttagaactaatatttcgtcacgtcacgtaagtgcaaggtaataaaagcagcagaaatatctgtagtttcaacaaaatatgtctggcttgcgatttgttgtgttttgaaactagttgctagtctgcattcctttgttttccctgaattacccaaagaagaaagcgacgcgaggcctcacgcgtcggagtttccagatcaggaaattacccacttaggaaattgagttggctggcagaaaagatataacgccatcttgaaaaatagtattagttagtctattttttcatttatatagtagaggtatattctctggaagaacaattttggaatattcagaacactgcgctgcactattttcatcaatagtaccatatacgttcatgtcagctataccaataactccaactaagcgtatcagaagaaatctatttgacgatgctccagcaacgcctccacgacctttgaaaagaaaaaagttgcagttcacagatgttacaccagaatcatccccagaaaaactgcagtttggctcacagtctatttttttgaggacaaaggcacttttgcagaagtcatctgagctagtcaacttgaatagcagcgatggtgcattgccagcaagaacagcagagtacgaacaagttatgaattttttggcgaaggcaatttctgaacacaggtccgattcactgtacatcacgggtccgcctggcactggcaagactgcccagcttgatatgattataagacagaagttccagtccctcccattgtcgctctccacgccacgctcgaaggacgtgctgagacatacgaatccgaacttgcagaatttgtcctggtttgaattgcccgatggaaggctagaatccgtggcggtaaccagtattaattgtatatcgttgggagagccgtcctccattttccagaagattttcgattccttccaagatctgaatggcccaacattgcaaataaaaaacatgcagcatctacagaagttcttagagccttatcataagaaaactacgtttgtggttgtgttggacgagatggacaggctattgcatgctaacacgagcgagacacaatcagttagaactattcttgaattattccttttggcgaaattgcctactgtgagttttgtgttaatcggtatggctaatagtctagatatgaaagataggtttctttccaggttaaatttggacagagggttgttaccgcaaactatagtttttcagccatacactgctgagcaaatgtatgaaatcgtcattcaaaaaatgagtagtctgcccactattatcttccaaccgatggccatcaaattcgcagcaaagaagtgtgctggaaatacgggtgaccttcgaaaactttttgatgtcttaaggggaagtatcgaaatctatgagttagaaaagcggtttctgctttcaccaacaagaggatcattgaactctgcgcaagttcctttgacgccaactacttctccggtaaagaaatcgtatccagaaccacaaggtaaaataggcttgaactacatagccaaggtcttctcaaaattcgtgaacaataattctacgagaacgaggatagccaaactaaacatccagcaaaaattaattctttgcaccataattcaatcactgaagctaaattccgatgctacaatcgacgaatcgtttgatcattatatcaaagcgataacaaaaactgatactttagcaccattgcagagaaatgaatttttggaaatctgtacaattttagaaacttgtgggctggtttcaatcaaaaagacaaagtgtaaagggaaaaccaagagatttgttgataagattgatgttgatctcgacatgcgagaattttatgatgagatgaccaaaatttcaattttgaaacctttccttcactagtcagctaatagatttattttttcttttttttttacagttccacttgcatccctcatttttcacattcctttttttatagaaaagcatatcactatataaaaattctattatagttgtaacagcatagcatattatagactttttttttctggaaacggttaaaccgtttggctgagatgcaatgatatacgcaacattgcattcaaagaaattgcaaaaaagacacaataaaacgtaatttgtacaaatattttactatcattagctactggatgcagaatggatgattgttagggggaggtggggtacaattgtttgtttttgatacattttctctttcaaatcgcaaccaattcactctgctaatgtgataacaatggcgcctgtcggaaaggtgaaaaaaaaaaaatgcaaacaaataaattggcacggtgtgacatatgccttctataataatgaaggaactcgaagaaaaaggggaaaacgatgtttcaacagctgtcggcatccattaggcacaatgcacacataatttttttatgcataagttggtattttatttcatcgttggcatctcaggtaacgaagcaggtactaacggtttgcccattaccactttttttgggtgagtttcagttcatttatactgctgtgctagcatggtttacgtgttatattgcatatagtttcccaggattctatcgcatatttcctaatggtacttttccggaatattatatcgacgacagagaaactagccgtgcagctaggaaagaatcaaaactatcctccctcattataccgccctctaaaccaatcctgcaaacagttctacctttaggtcttttccaatttgtagggaaatattttgggcatacagctacctctttggtgcctgtttccacggttgcaagtataaaaacgctatcccccatgtttatccttttgctccaaaagattttgaaaatatccactttgaaaattactttaactcttatctttagtttatgcactttagttcttggagtttggattatagttcaagaagataatcgttcaccggcctcttccaatgagctgagagaattctctaaatacggcgtaatatgcgctatgatatcaatgttcatttttgtcttgcaaaatatatatggcaagaccgtgttcacgtacagatctcaaacagatgaatctcaaagtaattctggattctcacggcaagaatcacctttacccttatatgaaaagttggatgagaaacttgttgcgaaaaagaaacctaaatcatatgacaaattgactttaatgatttatatttcccttgttggattttgtttatcgtttggctggtttatcactctagaatttcctgtactatttaggtatttttttcaaattaacagctcttctacagtaataaaagcttttccagtctctttatttttactgaacgggacattccacttcattcaggcaatgattacatttcatttactgggtgaggtctcaactttaacatattcaatagcgaatctgatgaagcgctttgccattattgcggttagttgggtctttattggaagaagaattacttggctgcaagtgttcggtttggttctgaacacattagggttattcctttatgaaagatgcacatcacaatcgaaaataaaagcgaaaatacgtcctgagtagtttaacatgatagaatataaatgcaaataatatttattccctttaggaaatacgggtgttttgaatttacttatctgtaccatacataaaatttacatataataatagaatctttatcaacacataatagtcactctactttgaggcaacggcagcatacttttctctttgttttctttttgcctcctctctgatggctcgagctgtttcggggtccaacttttctactatgattgggaaaacgacaagggcaattaaggtaataacgcccgccagtttccaacgtgagttcaaaatattacccacaatacctgtagaaaagatactgacgtttctagcctgtaaataagatctaatcggggccttatgtaaaagctccactgtaatataagggtgcaccttcatagattgtaatttttctgggtacgttatatctttggatgggaaatattctcttccaaaaaagttcttgaacgcgttcaattgtaaggtgccattctctaaattcttgaattcaataagaattctgtttggcttcagattgaagtccatagatgctgggtacatcacatagtatgtcgtttcattaacaccgtcgtttaaagggagattagcgaattcaaagttgccttcgtcatcttgaaacatggtcgtagatgtgtaaggatattctgtcgaaaaattgccgatctgataaagtttgaaacttgttctagttgaaacaaagccggtgatgttacttgctgctaagtctaagcgacccttaatggtccctctcctggccgtagcactggcgacataaataaatgcactgagtaaaagaacaatctgtgaaaacatcgtcacactgctctttcacttgttgatcaaatttactttgatgatatttaatggcttgacaaattcgttcatcttaatttcatacataatttcatcctgaaatcctcgatcattttcgagactgtttttcgagcttgattttatatgtggtgtaaacacatcattgtacatccttgcaccacactgaaaagaatatggaaaaaatttcaaactttttaatgggtgatagacttgaaaaacaaaacggaataaaagatatagtcgcaagaacttgccttctacgagtataaaagcggtactattccttctgtatgcatcttcatcgcaagagagaaaaagactgaaatcaacaactcccaataacaattaagaatggctaacggtacgtgaaaggggtgatatcctgtttaaaaccatttagttattctttttttcagatggagactgtgatcgggtagcgcatgatgttattattggaattttattttttttgcaactttgaagcactcctaactatattgcaatagtgttatgagatgctacttatgtttgtaaggccatgaaattctgtaatacggagttaaaatttctgcaataaagcacttcaatgctattgtgttatagaggctctgcgctcacccttaatactgtatcatctgtaataaagaatgtttatcttaaaaggattgtaactaaatggttgttagatagtgactcattcgtttattttttaataatcgaaaaagcagaagttctgtttactaacaactatacctcttatcatgtatagaccttgttcaagctcgcgataactctcaagtctttggtgttgccagaatctacgcctcctttaacgatacctttgtacatgttaccgatttatctggtaaggaaactatcgccagagttactggtggtatgaaagtcaaggccgacagagacgaatcatctccatacgctgctatgttggctgcccaagatgttgccgctaagtgtaaggaagtcggtatcactgccgttcacgttaagatcagagctactggtggtaccagaaccaagaccccaggaccaggtggtcaagccgctttgagagctttggccagatctggtttgaggattggccgtatcgaagacgttactccagtcccatcagactccaccagaaagaagggtggtagaagaggtagaagattatgatttcttttttttttactctattaacgcatggaaatacggctttaccttctcacataaatatagtttgtttaattaataaagccaatataaacatttgcatattcgacttcgtgcatgcagaaatgcggcagataaattcatttctgtctaatcttttgaacagttttaaagtacaaatatattagtatttaacaggaaaactaaaaaaatgtataataagaaatgagtaaagttatgaggctatcttgtgtttattatagtatataaagctaccgaaaaggttgttgtaacaagtagcttagtaaacgaaacccaaaatcttaccagaaacgtgctttcttctggcttcttcatggtccatgataccagcagaggtggtcaagatgacgtaaccgaattgtctggctggcaacaagttggcagtccatttttcaatgtcaccaatcttaacgttgaatcttggggaaataacaccacacttgttcaatctaccgttcaattgaacaacaatcttaccagatctgtggtcatcgatgtattcaaattcaccaatgtaaccgtgcttttgcataacttgcaaaaacttgataatgaccttggaggatggtctgattaaaacttgacgcttaccggtcttttcagcgttgttaatggcattcaaagcatcagctaaaacggaagatctggtcatcttggatatgtatgttggtcttgttttataaaaaatactagaactgaaaggccattaaaaaaccttacaatttaagaattgaatagtcgattaagattatttagattgaaattgactaactgcaaacccatattcaagaattatttcacatcttccagcgagtaaacatgccgctggtaatcgcgcgtcctcaatatttgagtttttcaaatagtgaggtgtggatgtatagaggaattacacacttttaagtatgtgatgtatgggcgcacagtaccaatttaactttttttttttttcattttttagcttgattttcaaaaaacttatgggcgttttaggctccggctcaaactaccaccaccacgcggcaggccgaggcaaacagtacgccttggcggggacgccgaagcgactccttctgttccaagctcaatggtccttgcgtttacgctcgcgcgtgggctaactaacgcaattcggcttttgggctgtcgagaaccgagaattattcttcgccttgatagatactttaaaacttctacttaatatactttctacaatttttggtacattcatattatactgaaaattcgaaaaagacaagcaaataaacacagatagatcaacatggctgtatgttagaaagatattataaatcccagttagatgctgaactgatcaatagcaaattataaaccacatccatctaaatgaccttaccacctacaatttggatttgaaatagaagcaatgtgtaaaatatagggaaaggattaggagtgttaaccatactaaaatttttcttatccgaaacagaaatctaaagtcgccactacgcagattaaaatatggtcataaactgcttattctgagaacttttggtggtccagcgtggtttatgtcaggtggtattgccttggatccgtgaatgcatcatattgatgagtttgaacattgttactaacattttttacaattgtacacttcgtatgtgcacgatatgtttcccttttaattaggctcaaaagtctttcagaatcaagcaaaaaatggctaaggctaagaagcaaaacagaccattgccacaatggatcagattgagaaccaacaacactatccgttacaacgctaagagaagaaactggagaagaaccaagatgaacatctaagcgaagaacatatttatgcttcaaactttttgtcatttgtcttccatccttcccttattctcaatatatatgtaatacgtcgtatttgatatatatatatatatatatataatataatttaacggttgttatctgctacatctgtaaaataaaaataaaaatgcttgaagcggctgtacttaaaataaactcatctaaggttttacatggtattactaccggactgcaattacactctttttcgttattggattatttatacaatgcggcccataagcacgtgtgggaaaaaagtatgtaaataaaacaaggttttttgttccatttatcatataaaaaattttggcttaggtccaaagtcgtcttcctggataatagcacctgcattgcgtgtcatttctacatacaggcattcctcagtttgtaagatttgatttgccgtgggccttctctcataattgggctctatcatccatcgtactattctctcaagtgattcaccatcaataagaaatttcggtacccatgcgggaattttagaacttttatgcaaaataagacgattcttggtagcggcagtattgacattattattatcgttgccattattcatattagggttgttgatattactattgttatgaacagtggaggtgccagcgttgttactattaccactgatattgtctctttcaaaatcaaataaatcatttgtatctactttcgtaatgtctgaaaataatgattcagaatgaatatctgtggaacttaatcttcctgcatccgataaatcacccgatctcaacttatgccatgcgttgccattgtcaggtaacacaacgttcgctgcaatttcaacaatcatcagacccagggaaaaaatatctgccttgtaatcgtacgtacaatcagaaatgatttctggtgcaatatattctctgtcaccttcattttcaaaacttttatcctccaacggtaaatgagtagccattccaaagtcacctagttttaggttaccttcaaatgtgatcatgacgtttgcgggtttcaagtccagatgcacaatgtgacaagaatcatggatgaatcgtaaagccaggcttaattccacgatgattttccaaattctccaatcttccaacctttttttctttgcgataacttgctcttgtaaaaatccatccaaattaccattttcgcacaattctgtcataatatagtatgaattttgaaacttccaggaactgatgtaatcgatgatgtattccttcccttcttgatccattgtaatttggtttgttacctcgtttagtattttaatttccagtaatatgcgtttcaaggaattatatttgtttggtttaatggctttgattgcatactttttgtttgtttgggcaaacgtaacctggtagaccgtggaaaactggcctttaccaatggaatgcacattcgtaaatttttcgaaaagatgggaatctggatttgctgataacttatttgaagagattagacgccttttggaatttaacggcgaagaatcggtggaagatatggaatgcgtctctgcacttgttgtgtttgtcacgatggcagaggagagtgacaatggtctgctttctctatgtgtttgagatgttgccccaataatagattttcgtcttgttggagtggagatctcttcgtcagtgtcattgtcatagcgtccacgaaattgataaggttgagggttctttctagttgaatgatgacttgatattatgattggaggtgggaaattctcgtccgtgccgtataaatcatctttgaattgttgtaaactgtttgttagctctctatttttcaaaataaccgaattccttgctcttttgatttttttgaacttgttagaatgcaatgtttgtggagagctgttggtaaccaagctattagtgggagacaggatgtttgtctggttattgtgacgatcatgtgcatgatattttgcctcgctcagtggggatgagtctatggttggtacatggatggaaggtaaagctttcgaagacggagaatctgaaaataaaaggtcttcttgtaaattattgtcttcaacaaaatttaaaggggaaacacttagagaagacgatgcatttttcgaactcgaaaggtggacatgcttatggtctcttccctccactaagggtgattttttcactggtgtttctggtatcctcaatttcgcagggtataacgaagtgtccatagacattttagatacgaggcccgaagacgtaaaggctgattggttaggtttagcgacgctatatgaagaggatgaggatgtattttcagtgcgagcatcatttttcggaaaccatcgctggttccattgtttgagagaaataggactgttcgttttttccgcagatctttttgtaataggagtagtaacactttcattttcatggaacggagaccaccttttaatacgagaatccacgctttcctcatccttgccttcttcctcctcttcttcctcttcttcaattttcccaagaaatttggagttagcctctgacaaagctgtattacttaatgacaggttcaaggtccccgtacttcttgtcaatttgttgttcgaatatggataaaatttcagtttattggtcggggtgctaccccctatagcaaaatcatcactctcgtcttcgccggcctgtttgccaaacatcttcttccccataaactggaggttctccgtgtccagcatttcgaagtcctcttcatcctcgtccaaagaactcatctgttctcgtgtgcgcctgtgtgtgtttacttttccccagcactacgcaatcaaaaatagtaagacctgttcagtagtaatccttttttattggactaactgcgcaagatgatgtgcaggatagttaacacacgcatacatacaaaaaagagcctcttggacaacctttacttaatacacaggggcacgccaatgttcaactgtgttgttgatttcttatccagcattcttttacttctctgcatttttttcgcgtcgcgtcgcaaattgtgatggttaaaagaaaaatgaaaaaatatttttcgcgtcgttatcacccggaggaataaaaaaaagaaacatacacatcacgtgaccacaagaatgttagaaaggcttaccagtactagagacgttaataaattgcgaatagccccctatctcccacatgttggcatctgtgaggtggaacctatttaaaggtgccacatttctttccttagaggacgatggttgcaagatcagcacaaatccatagtttgatgcatggaaagcgaagcactctaacagaagtaagataataaacaatctcacgattctactgatttaagtgcaactagctcttgggcttcttttggttgccaagtcggaatagacgacagatgcatgtttcggtgcagagttcagagagataagtgccttcttttatctttttccccgttcttgcggattttttttttcactttctcatcggcggggaaaaaaaagtgtaacaactaaaggatcaacacggctttaaagtgttttatatatacgcagatatgaaaaaagcattttcacggttattggaaatttttattttacgactggttcctagcacaacaagaggatatactaatagttcaggttacaatgctgattaggttaaagaagagaaaaatcctgcaggtcatcgtgagcgcagtagtgctaattttatttttttgttctgtgcataatgatgtgtcttctagttggttatacggtaaaaagcttagattgccggttctaacaaggtcgaaccttaaaaacaatttttacacaacactggtacaagccatcgtggaaaacaagccggcagattcgtctccggacttgagtaagttgcatggggcggaagggtgtagctttgcaaataacgttgctgcacacgactctggacacgatagtgacttaagttacgagagcttgagtaaatgctataatttgaataaaacagtacaagaaagcctacgagaagtgcacagtaagtttacagacaccttatcagggaaactgaatttttccatcccacaaagagaggcacttttctcaggttctgagggcattgtcaccattggaggtggaaagtattctgtgctcgcgtatacgatgatcaaaaagttgagggacacgggtactacattgcctattgaagtcatcattccgcctcaggacgaaggcgaggatgatttttgtaagaactggttgccgaaattcaatggtaagtgcatttatttctcagatatcgttccttcaaagccattaagcgatttaaaactcacgcacttccagttgaaagtctttgggttgataatttccagtttcaagcgtattatcttcttggacgcagataactatgcggtgaaaaaccttgaccttgcttttaacactacatccttcaacgatactggcctgatattgtggcccgatttttggagacgtgtcacccctcccgccttttacaacattataggatctagcattaacatcggcaaaagagtccgttttgttagtgacgatatttcccccgtgtcacgttatgatccatttgttagtaactcaaacgattacactccaaaggagagacaggagcatttcctgaaacatgttcccttacatgatctggacggcacgatgccagacttgagctctgaatcaggccagatggtgattgataagattcgccatttcaacactctattactggcgctatactataatgtttatgggcctacctggtattataagatgatttctcaaggcactgccggtgaaggtgacaaagacactttcttcgctgctgcccatgccttgaatatgccatactatcaagtgaggactaactttgaatttgatggtttcttctatcaaaaagatgattacaagggtctcgccttgctccagcatgattttgaacaagattacaagcaataccaaaaggcgcagcagaaagttaaagccaacattgaggaattttccaaactggatccagattatactttggacaatggtttcttgaaaactttgatggttaatgatgacggttctgatttggatatcatgttcattcatgccagtttctacaaggcagatccatggactctttatcatgaaaacagatttatcggtccaaatggcgaacaagtacggggcttcaggaagccgcatcgctatggaatggattttgaattgtttttattcaatgatatgagggggtccttctgtaccactccgaaaagccaagttattaaattcaagtattttaccgataaagttaataccccagaatgggatgcaatgtgtgagtatttgaccaatcatgttaattatctggagagcacacacaaagaagctatgggggagaaaaactaatgaagtgattaacaataataatttaataataactcgccatccgaccttgtataatataatgtagcatatatgtgcacggatatatatacatcttagaaaaaaatgaaaaaatgaaaccaagaaaaaactaactgatggtgttcggacaacgttttagaatgagggtatctaactttcttctaccattctctgtccaaaaacctagaaagtaaagtccagccaaaccaagatgtgttttccaacgacgaagacgctgcgcttggtgaacggtttaatgtttctccagtgctctcatctgtaaatcgtgaccgcgatgacgaatctatatctacgtctgacaacctgtcgaattcaagaggcatcgagtagtaattgaaaataaagtcacgctgggggaaaaaagatggtatatcgtcaaatattctttcatgatggtatgtcaataattgccggcgagttttctcgcggtagcatgttcttagaattggatacaagtctcttgatagtttctgcacagcaattctttgggcatttgtaagtttctttaatttcgcagaggtataaagttctctttccttaaaggaataaacgggaaatccatgattgacaccgtcgcttgattgagggacattttgatgcagctcattaaataaatggctgcccaaacaccactcatcgatccggtcagagttactagacgatcgaatgttacgaagagcgggcgccggctgctctgagggcggagaatttttattgctgtcactggatatcgacagtatagcaatttcgtcagaaggaacttcgaaggcactacttgcagattccagtgtctcatcgcgactaatggcagtatttgtacattctggagataaatctgggttattgataacccttacatcattgaatgactttaatctatggaagtctagctcaaattcctcttctgagagttccaggacttcaaatagcgattcttcatcgtgaatgccgttattaattctgggttgaatgcgagcagaccttgacccgcaatcaacctggtaattgttcacagatgccattaatgagctgtactgaccaccaaattttagtattttaagccctgaatacaacctttgctccttgtcgacattcgtaagtatatagaaatctatcccttcaaaagatttgtattattcgggattacgctacagccgcacgtagatcgtacgtgtataacgatgtttatcttggtgaaagtatcttaacgcgaatgctctagtgatggcacaatagaatagtgtcttagcaccacagagcgtgattttttaaagctctatattagcaactacgataggtgtttatttagtttctttgttgatcttcctgtttccagtgttacggccttgtcaggtcaaaaattttacccggatctctagtaatgagtaacttaagaatatcccatctgattattggtagttttactgaaccaagttagagctaaataaatatatacagccgatagtgcactggaaccttatcctaatatctcaatgaaactaccggtagcacagtacagtgcaccagatggtgtggaaaaaagttttgcaccaatacgcgatgaccctcgatacatgaccacagagggaaggacaactgggcccagtgaccatgtgctaaacgctggccaaatcgatagagacaaaccttcagaaccggaacgcacgaaagatggctcacaactgacatacttaggccagctgcgcacgcagctgacggggctacaggacgatattaacgagtttttgacaggaagaatggaattggcaaaaaataagaagaaagccggcgcagacgagaagcggatccaggaagagattaaccagctattagatggtggtgacggtgacgaagatgctgtttaggcaacgatatgtagcgctagagagtgtatatacaaacagaaaagagtctaatgataaatgacaaatatttcgttacaagtgataattgttgaactaggaagagttgatataaaaaaataataaacacacgatgggatacagttaagaaggattgatcgactcctaaatgatgcgaagaaagccaattttcaacttggaatcatcctgccggtttgttgttggtgttagctgtgttaggactcgttaaaatggcaatcaaaccaagaacgaagggcaaaacgtactcctcaagatcggtgggttcgcagtggttcaacaggcttggtttcaagcagaacaagtacggaacttgtaaatttttgtcgataataacggcctttgtttttatcctctatttcttctccaatcgcttctatccaatttctcgttccgccggtgcatcatattctccatcccatgggctgtatattaacgaaattcctgcctccagccggttgatttatccacatgtagaacatgtgcctgtgttaaaacaaatgaccgttaggggcctgtatattacgaggctagaagtggatggcagtaaaagattaattttgaaaccagaagagaatgctttgacagatgaagaaaaaaagaagactactgatcaaattctattagtgaagcactcgttcttagaccatggtaaattagtgtatcggaagagcaatgatgcacctgaagtggtcgtagtaaccctgatagattttgaaaactacgaattagaaacaattattcaaattgttcaaaatagggttgattacgctcaaaagcaccaatatggtgtatacattcgttggatacaggagtttttgcctgttcttgaaaatcagaatttggctgaaagctacgaattcattaagccattggtgataagagccgccatgcatgctttcccaactgccaagtatattcattttgttgatcaagatgctttattgatgaatctcgatctttctttacaaaaatacctgttagatccaaagattatggatttggctctattaaagaacgtccctgttgtggcgaattcaaacatcaagacatacaatcattttgaatatagttcggcaaagattatcattccacatgatgcgggtggtaatattgatgcgtcctcatttgttattgccaatgacttttatggtaaagctctgatagactacttgaatgatccgttactgagaaatttcccatgggataataccggtgataagttgagtgctgctatcggtcatattttacagtggcatcctacattactgggtaagacggcaatcgtcataccaaaagttttggcaagtcagtacgatgcatccttggatcaagaaggtgagtctggaaacggtgcttctaatggcgatgtttaccattataatgaaggggacttggctgcctccttcaagggatgtagatcaagaggtacgtgtgctagtgaaataggtcacatgtaccagaaaatcaagaaatcttagatgtgtgtaatcttgcaatttagtttcaaacaagatccttgtatttatataaacaaagatataatttttaaaaaaaaattagaaaaagcaaatataattcaggtcccacttggaataatggcactgtattgatgcattttccttatgcttagtgacgcgttttcgcgcgtcagtttcaagtttttcttggctttttttttttcattttcgtaaagggtcttaaaaggattaaaaaatgcagtattgaaataaagaacaattacgaacggtgaagctgctattttggttattatacccttccaggacagtacgcgcaaactattatggagatattcaaggaagaagaagaagaagctttttcggcgatagaaggtataatatatgcctgtgaggtgtatgaccctgtaccccgtcatttacataaaagcaaaacaaagatcatcaatgctgctaaattaattatagaaacgcatctttcatattatacaatactcaataacatttcagatatacaagcctatctttctacttggcttagggatcttggaacgacaggtccataccaaacaattctttcagaaagtatttctctcatgtttgaccgcactgtatctatcttcaggaaatgtacgatagagggaggttttccacatttgatcgcacgtctttatctcagattgaaaagctaccagaagctcttaaacgatgcaggattaaagaattttttttcaagctacgattatgctttcggggttgcatacaaccttgtaaattgctctgaatacaggtatgacgaagttcattacatatcgaacggcacttactcattagttgcatcgatgaagatagatcctgctgaagtcattaaaagggaacattttaggcttacaattccgaaatttaacatatctaatatattaattgaaatttttcatttgctcgatggattagcattttttaaggtgaaccctgatagtttatctatatctacagcttcagcagaaacaatctttcgcagtatctccgaaggtaatcatcaggtcctagaattggggagaagtttaatgtttccattgttgaggactggagattttgaaatctgtcgtattgacgacgcgggagctgtcataacatttacagaagcgaaggatgtaaaactagaaataatcagtctggatgaagtttcctgggtaatgcagtggaaatcttgtcttcaaaattatgagagaagggcagcaaatgacagttcatttatcaaaacacacctacaatttaagaaggccaacaatttcaatgaagataataatgggctaggactaattgtagacagaaatattccaacagatgattttacgctagcttctacaaaccgtcaaagtcccccgccttcaaatactggttgttcattacacaggtctaaacccttgcatatccctttatcatctgttattcgtgaagacttttatgatagctctctaaatgagcgtatatctaaagacggagatagcagttgtgaatccttcagtggcgccgaaagtatcttatcagactacgattttcatgataatgaattttttaacaaccagtcacctcattatttttcagaacacatagacaataactcgagagaggtggtaataacagatgaaaatacgataatatctttggaaaatacccaagtaagtcggtggtcaaattactcatggcaaaaaatttcaccgcatcaattacaggtctctattatccaactgcgcatgggaaacttcattgtggcttatgattctgattataaccttcatcagttcaaaattcgtttgtgtgacgatataaaatgtatacaatccacagagcaagacatacaaatacgtgtcccgctcggcgcaataatgtgcagcgtcactggtatcttgaatattaggacgaaggacgctgacaagttgcttcgggtattaagcttttataccactgaccacacggaagctgtatcgcactcaaacaatcaagatgctactgcaagtccactttcgtcagtttcatcagcaatggatctcaagcattcattacagaaatgttcctctacaataatgccccaagagttgacgcaggacgtcatcggttcaaaatcagacctaatcagtaatattcgtcaaaaaatataatcatgtttatttacagaaattttcgaatatatgcttgtatatatatcatagaaaagtagtaatagaacaacaattgaatcaaccatattattgcttaaaagcagcaatcgcagcagtatgaatttttcttctgatgtctcttttgtcaacgtcatgagtatcttcaacctctccccacttttcaacttggaagattgtttctaaggtggcggcacgtacaatattatccatatcagttttcaaggcgggaattaagttcgcagtatcttttttattttctaataatagcacgccgcaaatgaaggactttgtggttaatacagttttttcaagaattgcaagatcccatggtgataagctgctcatatatttttttgctgcattcttaacgatatccgactgctgattgcctcgtaacccatggatgtcggcatctaaaatttgtagtcgaatattagactcggatgaaaagttgcgtaaaaactcttccattcctttgatgatgggtatatataactcattttgcgcattgcgtaatcttccttcaaactcattcataggggaaaagaccaataaagtatcggtatctaaatatcttaacaactgattttttataacatcactgttgcctccaatctttgcaactaattgagggtcacagccaggctcatttgtcatttgtaaatctatgcatcttgccactaatgaagttagtggcaaagagtgagttttgatggaaagactggatagggacgaccactccagttttaataggtatgctaagagagactttgcattatcaactataattccatttcctagaggagtttttatagtcctgccatctaattgtagagcaatctttcctttctcaacatccctatttagtgacaccttttcccaaaacttctgtgaagttttgctcaatctatttgtttccgtaggagtgttattctcaatcgtgttgtctgtccccagtggctgggcatttaatgagtagaatcggggcagtttcaatcttatggaattcacaatgaagcatcccttccttaatgatggcagcattccgtattctcttttgtagggtttcgtttgccttcaagtgttttgttcttatttagccttttcctttaccttaatttttttcttttctctgaagaaaatgaatgagtttaaagatatagcaattaaaaagtaacagtgaagaaatttctcagatgagcagatgggaattaaagaactatctacagagctctttactaaattgaatcaataatacatacttacaaacatgtcacagatagcacaagaaatgacagtgagcttaagaaacgccaggacacaattggatatggtcaatcagcagctagcatatttggacagacaagaaaagcttgctgaattgacaaagaaagaactagagtcttatccaacggacaaagtatggagatcttgcggtaaatcgtttatcttacaggataaatccaaatacgttaatgatttatcacatgccgaaactgttcttctggatcaaagaaaaacattaaagataaagaagaactatttagaaactactgttgaaaaaacaatagacaatctaaaggcattgatgaagaattaaaagaaagcggcaatagcctttcctttcttagccggaaaacttactacgggaacaagttttttttattagtataatgtagatataaaagcttagagtttatataaatataataaaaggttagcactgctgttgcaaaaatatcgaattgtaagccagtaaacttatttaaacggcgctataaccgcctctttgggcggtacttctgcctaagattctcgaaaccacttccttgcagaattcaggtaaggaagtgagaaattgagtagaacgttgaatgaactcagcacggaaatcttgaaaagagcctcctctggtattcaagaatgatacaaccatcaggtatatcaatgtaaacagtagagcgtataggaataaccaagtgaaccacgaagtcccgcctgccttcttagctggctttttcccctcgctgtcaccatccttaccattatcgccgtcgccattttttttgtcatcatctttgctcttcaaacagccagatggcccttttagggtcaattggatacttttatcggcccatgtgtgactagtcagctcgtcttgtttcatattgtcattacactgaaattctagttttgcgtcaaaagaattggcgccccacgtagcgccttttagtgtcaatgtaagcgcactctcagtttcctcgacattgaagccaatgtttttgtcaaaatctataatttgagtggtgatagcatccttaccgggcaagatgacatctgttaaaccacatagcatgtcattttttttacattcttcagaggttctacgttatgctcttcgcaaacgtttatccaccacttttcaatagttgtgcttggcggagtatccctttccgtagaagttagtgagctaaattttcccacctgatactttttcaatacatcatgcttctcgcaggacaaggcctgtaccactgtaattatactgatgaagccacatatccaagtcttcgataccatcgtgaaagctttccttacctttatctatcgcatcgattgaagatctcagatataaatctacagcagactaatatgccactaacctcttgaaaacccgtcgcttacgaaaaagaaggaagacggaaaaaggacggcatccttttcaatttgcacctggacattctcacccatacatggccttgttttttttttaactgaaacttttttggccgtttttgaggatatgatatttctatgtcggagaacaaaagtaggcgtgggaagtgaagatctttcgctctttctgtgatgatctccttccagctaggctcggttcgaccctgaggtctgcccctagctccttcctattccaaacggaataccaaatgtccagcccgtgacaatgcagcagggtggctaatttttcatccagagtttgcagaatgttggttctcacaaactcagagagaattggcggatgatgggtaactgtgagaggaagtgtctggatttgatcgtatttgttaaattcatcaacaccttttatgcagaggtgtagtagtgtaggtagcccttagtaattggtgtttattattgtctatatagaaatttctttttagtgtagcttgtactctttccctgcattatttttgttttattgacttttgtcttggtgaatcaaaaaattaacgaaacgaacaaatttaaaatggcaagatacggtgctacttcaaccaacccagctaaatctgcgtcagctcgtggttcttatttgcgtgtttctttcaagaacaccagggaaactgctcaagccattaatggttgggaattgactaaggctcaaaaatacttggaccaagttttggaccaccaaagagccatcccattcagaagatttaactcctctattggtagaactgcccaaggtaaggaatttggtgtcaccaaggctagatggccagctaaatctgttaagttcgttcaaggtttgttgcaaaacgccgctgccaatgctgaagtatgtttaaaatgaaaatatgaaaaataagattgaaaaataataatgatgtgttgacgggagatgataaagtattagaatatgttcatatgtgttgcatcctattttctgcatgaatgcacgattcgaaagagctaaaattaacagttttccaaatgaaagagaaaagaaataaagaagaaatgggacatgcaaaaaggaactatggatacctattaagcgtatagcatagtgttttctaatcttattttttcttacactacgactttaaaatttttactaacaatgaattactattaattttctttttaaaacaggctaagggtctagatgctaccaagttgtacgtttctcacatccaagttaaccaagcaccaaagcaaagaagaagaacttacagagcccacggtagaatcaacaagtacgaatcttctccatctcacattgaattggttgttaccgaaaaggaagaagctgtcgccaaggctgctgaaaagaaggttgtcagattgacttctagacaaagaggtagaattgctgcccaaaaacgtatctctgcttaaatgcttttttaattttaaaatcttttaaagtgaatatttgatttatatactactatatactaatttgtttaggccaatacacagaatcaaaatcaaactaagaacaacacagaacaagaaaaataacttttgataaaggctcttttaaataaaaaaaatagaaaaaatagaaaataacacaattatagatatatatctacatgtacataacatgtctagtcgaatctagagaaatgggataaaaatcagagagaagccaagtcaagtgacgcaccattaaagaaatgaacctagaagaaagaaaataagcaaaaatatagagcgaaacaaaatagaaagtgttactaatgaagaataattacaacaaaaacaaaaatgatctccatgtgtcattgttatgccgaccaatacctgtaaaattgaggtgcttcaatagaaatgggtttgacatcattctcgttagatatactttggccattatggttttcacctgtttcaatattaggtttgttaaatggattctttccaatacttaaagtttcaggtttcgatagcatacttttgaaatggtctatctgcgacctgatttcctccttctccgccactgaactattattgatattgctgtcggatattaaattcaagcatttgcttaaaacgtttacaatcttgctggagttttggttgaagttcaatctctgaattagtaagttttcctgttgtctttctagggttttcctttctagctccataaatttttctagtttctttaaatgatttaatttagcgtccaatttttccatttgaagtcttattagctcgttagtcaaaaaattcatttgcctttcctcgttggtagcgaaaatatgactcctataacccaatgatgatatggcaatttctgaaccttctttaatatgttcaattggcttttggtcagagatttcctctttttgtgattttattgattctgcggactgaatggctctctgggtcatcgactgtacagtcttcggattgaccaaacccaccaagaatgctattgttgataaaacggggttttcgctcttcgaaaatggcaagtgaggagcatatttcaaaggtcctaacccgttgtcattatcacccttgccattgccgtcaccgtataaaaatttatcttcaatgggcaattgaaggaaacgtaagatacactgttcaggcgacttattgccaacgtttttggccactttgtaccagtcagcgccgaattcttgtattccctttaatagcttttgcaaatcttcttttgaccaattttcatcaatttgttctagaattttgacttttttcagaggacgtgaagtttcgccttcttccaatagattggcatcaccagtcatgcttgttgacgtacttacttcattgttcattttaccaccattatcatttttgtcaccattttcatcatcagtggtactgggggggtgagttatttcatcatattttcttttgctttctttcaaatatttatataaagtactctccgaatcactagtgttcatcatttttttaagctttgccatatccggcagttgtacagatggtttgtaactttcgaatgggaatagtcctctgggggcatcatgccttgtggaatattgagacgttagtgggggttcgatgttcttaggtaatagtttggagtcaacctgatagtttattagcccccattttgttaagaatttatgcaatctgaataatgcagcagcatcaccagagacgtttctcctcgccgtagtgacactgaaatattcgttggggttcagcctgtaagaatttaccatgaagtttctgtatctcatgtaaacttcaggtgtctttgatggaatcctattggtgaaaaattcaggtaacgattgaacttcaatggaatgaattttttctagattgaaccatttagaataacttggaataacaatttcatgtgcttgcggtatctcaaaagtttcgggttctactctggtgatagtggttttctttggattggcacttttggagtgatcgttcatgatttcacgttcctgttcgtttctctcttcgccactatctaccttcttatctacactttccgtcttttctatgatatcctcctgttcagctttatgcgcatctggaatttcagatggagtattagcaaccgacgaagtgttgcctagttgtttagactcactctttgtgtctccaaaaatggaattatcaggactaatcatcggttgatcgtcatcctcatcatcttcttccacttcatccatttcctttgtgttctcatctggctgactttcttctttgacaccttcaataacagtgttattctctggttcttcctctttttgtattttgacgtcctccatgtttttaacgtcaccatttgaatcctgtattgtgctgtcttccttaatagcaggcttattgttttcattgtctaccgggttcgtaggtatactaggagtgtttgcctcattgttcgaaacagaactctcggtttcgccaaagagattatcactatcctcattatcttggccaaagacgttctgggccctgctttcttctgtagaaggtgtttcctgggaatctagcttattcgcttgcatagtcggctgctgctttgccgttaccgttatcgcctcactttctgcatcgcgtgtgttcggaacagttgcttcatccttcagagactcatcttgttgctgcgattcttcaccagcagtatctgtattggcaacccctgccacagctgcattagcgttgctatcactattgttgtcattgccatgttggtccacgtccacggaagcgtttaccgtggacccctcacccagtgtattctccatgcttgcaaaccgtatcacaattggtctctgaacgcgcctcgatgtaccaatatatcgcgccttgcatggcctttacacattcctcttgcgtatctgatatagtttgttttcgtcttttcgccaatggcctaaacgccaaacgtccggcctcgttattcgtgatgcctacttaatggctcttaaatcgaatttaaactagctcaaaagtaatcaattcaaactaaaataacatcattggccatcctgaattgttggatgccatctaaactgcgtattgaccattattccatcgtaaccacggcggttcaatataatatcacttttgacgattaggtgttttatttacatttctttttttttttcctcgaaaaagatcttcaaggataatacaggaatagaacaggagtctcaaagcattcttgaagccagatttgctccagtttgatagttccaagaagcgctaaaagtggcagttcacactttgttttgattactaggaatctactctttcgctttttacttccttctcagagaatcagcaactgtgacatattatagataatgcgtttacaaagaaattccatcatatgtgctttggtgtttttagtctcatttgtgctgggagatgtgaatattgtttcccccagctccaaggcaacattcagtccaagtggtggtactgtctctgttcccgttgaatggatggataatggggcatatccctcgttaagcaagatttcaactttcacgttcagtctttgtactggtcctaataacaacattgactgtgtggccgtacttgccagtaaaattactccaagtgagctaacacaagatgataaagtttactcttacacagctgagtttgcttcgaccttaactgggaacggtcaatattacattcaagtttttgcccaggtggacggtcaaggttacactatccattatacaccaagattccagttgacttccatgggcggtgttacggcttatacatatagtgccacaactgaacctactccccagacttctattcaaacaaccactacaaacaacgcccaagccactactattgacagtcgttcatttactgttccgtacaccaagcagactggtacgtcgcgtttcgctccaatgcaaatgcagccaaatactaaagtgaccgctaccacatggacaaggaaatttgccactagtgctgtgacatattactctacctttgggtcattgccagagcaagcaactacgataactcctggctggtcttatacgatatcatcgggagtaaactacgctactcctgcatctatgccttcagataatggtggttggtacaaaccatccaagagattgtctttgtctgcaaggaaaatcaacatgagaaaagtatgaaaaatagacggcttctactatcatcattacagtaagggttgaagtcaggaaaggttaaaaataaaataaatatcaaaaagtttttagcggaaggcgttaaggcagcaagtacacattcatttatctatctatacatgtataaacacaactacaatttttttagaaatggaatttattatatgaagggaagacatatagaggcaacagtacataaaggtaagaataaaagcgattttagctagtatatttctgggtatttcttacatagtctctgtaaagcaaccacaccgtttaagcttaaatcttcgttctccttgaatttgcatagtacagcgtctagaatcaaaaatcctagctcgccgtcatcattgttcctgcaaacaaactcataccacgagtcgatctcaaatgttttattcatagatacacgaatattgttcaacgtaatcatttcaacctcgctgccgtttttcgatgatatggttggcgattgtaaaatcaactgagattcagtgggttgtgatttgatttgcgctattatcctaaacacaggagcattgacgttggagatttctgtggggtcaactcttggtgtttcgctggccatttttacttgtgttactggtagacgatgttctacaagaatggtgaagggtgtgttatattgctctttatttaaacacgaacgaaaaaaatatcgcgtattgccacatttggcgcgtcaatattaaagaacgaaggcattatatagggcgacttgtcatgattccaaccatggcatgggcggtggatgcttctcagcagtggcccattacgttagtcaacgactgttggctgtcatctgttcttgttgggtgcttgcagctgcatcgacaaacatggatggatgcctctacatatatatatatatttatgtaatggacctctgaatattttactatgtaactgactataggagataccactggtgctgtagtacaatttagcacttgcaagcgttgacacagttgttgcgaaggcctctttcttgtagcacttaattggagtatgactgccatcatgtagggaaattatgaaagcataggatcaatcttgacgttgcaaagaagaagagacttgctgttccctattgatcacttaccgttattggagttcatatggtacttttttcataattttacgagtaatccctagtggtagttaatattcagcaaataaaataccagtttgagaccaaaggtaagataagagtttactgataaagacaaagaattgggatgacctagtccaagggattatagtaccttcgcgagtattgcatataagctttagcatacacaaacaaagcgacaccgggatttgcatatcgcttgttcctacgacgttgtcagttccataacctctgatttcccatacggattttgaaaatcagctacgaatagatagtctttttctattttcagtaaatgtgtcattgaaaaaagtttctttagaacgacgctttttgcaggctactagaaacacccacttctagtagctttacgtgacgaattaaaccgcgtgatcttctgcactgttatcctaaatgctcaatgctcagaacatcttcttgttatctcagcctcgccacccttatcttatcatagcggccttttattttccctttgggcaaaatacgatacagccttccaaggtcgggcaagaaagtttatgacatataaaagaaacggtaccccaaatacgtctcttcccattgtaaaactaatcctgcatcatcacattaaggaatcattcatctaacaattacattatgatcgccttaccagtagagaaggcccctagaaagtccctatggcaaaggcacagagcctttattagtggaatagttgcccttattatcatcggcaccttcttcctcacttcgggtctccacccagcaccacctcatgaggcaaagcgtccacaccatggaaaaggtcccatgcactcacccaaatgtgagaagattgaaccattaagtccatcattcaaacattccgtcgacacaattcttcatgaccctgcctttagaaacagctccattgagaaactgtccaatgctgttagaatccccactgtagtccaagacaaaaaccccaaccccgcagatgatccggatttctataagcatttttatgaactacacgactattttgagaagactttccctaatattcacaagcatttgaaattggagaaagtcaatgagctgggtcttctatacacatgggaaggttctgatcctgatctaaaaccattattgttaatggcccatcaagatgttgtacctgtaaacaacgaaactttatcatcctggaagttccctccattttctggtcactatgatccagaaacagattttgtttgggggcgtggttctaacgattgtaagaacttgttaattgccgagtttgaagctatcgaacaactgttgatagatggattcaagcccaacagaactattgttatgtcgcttggttttgatgaagaagcaagcggcaccctcggtgctgccagcttagcctcatttcttcacgaaagatatggtgatgatggtatttacagtatcattgacgagggtgaaggtatcatggaagtcgacaaggatgtctttgttgccactccaatcaacgctgaaaaaggctatgtcgacttcgaagtcagtattctaggccatggtggtcattcctctgtcccacctgatcataccacaatcggtatcgcttcagaactgattactgaatttgaagccaacccatttgactacgaatttgagtttgacaatccaatctatggattgttgacatgtgctgctgaacattctaaatctttaagtaaggatgtgaagaagacaattttgggcgcaccattctgtcctagaaggaaggacaagcttgttgagtacatttccaaccaatcacatttgcgcagcttaataagaacaacacaagctgttgatatcatcaatggtggtgttaaagctaatgctctgcccgaaactaccagattcttgatcaatcacagaattaatttacattcttctgtggctgaagtctttgaaagaaacatagaatatgcgaaaaagattgctgagaagtatggctatggtttatctaagaacggtgacgattacattatccctgaaaccgagttaggtcacattgacattactctcttgagagaattggaaccagcaccactttcgccaagttcaggccctgtttgggacattttggcaggtactattcaagatgtttttgaaaacggtgttctacaaaacaacgaagagttctatgtgactactggtttattctctggtaacaccgatactaaatactactggaatttgtccaagaacatttataggtttgttggctctatcattgatattgatttactgaagacattgcattcggttaatgaacacgtggatgtcccaggtcatttatctgccattgcctttgtttacgagtatatcgttaatgttaacgaatacgcttaagcgcaatcattgaatagtcaaagattttttttttttaattttttttttttaattttttttttttcatagacttttatttaaataaatcacgtctatatatgtatcagtatataacgtaaaaaaaaaaacaccgtcagttaaacaaaacataaataaaaaaaaaaagaagtgttcaaatcaaagtgtcaaatcaaaatttaaatgatgatgataatatgaccatacaatgacttaaatcaaatcaaaaccacttgcgtaaaggcagtgaatatggccaaaatataataccatacaccgttttgcatgttcgttaaacgaacaccattcgacaacgaggtggtcgaaggcgcagtagcagaaatgctcatcaattgagaagaataggtttcgttttctggaattgcagccaataaatcgttaacagtatcagcagaaacagttccattgaatggagtggcatcagatatgaaagaaacgacatttccactagaatcgaaaacaacaccacctttcatcgttccagtagtatttcttgttatgtatccgtaagattggataccagtacccaaatcctcgataccttggaaagtgtggaaagtagaatagagatggtttttctccgtaccattcatagcttcaaaaatatcgtattccccacatccactagcccaacatgaacagttggcattggttggatattgagaagtccttgcaatgtgatcgtttagcaaccaaatagcaggcaagtcatagtacccaatagagctgctatttttctcagtttcagtaggcatttcgaattcaaacaaaaacatctttgttgtacctccgtacccatagtaagctggaatgccactacggtaaaccccacaacccttatcataacctgattttggacatgagacattcgaatagattatgtattcttgatctgaagaaatcaaagtgccatctgccaaaacggtagcttcactggcgctgccagtaccgttagaactagcgtaggacaaagcatttcctaaacaaggggaagcttcacctccatgatttagaaaggtaacgttatcagcggttttggaactggactcatagtaggcaagacggttccaatcagaagaacttctgctgttgttgacggtaaatccaggggatgtgtaaaaagcaaattgtttcaacttcaatggtccacggaaatgaacggataaatagtctgctagtggagcgttcttaccactaaaccatactctgtcacccacttcgcaagtacacgattcattgttggtgatatctttaaacttattcacatctacgtaggagcctgtaaaaccaacattagtgaaatccaacttttggtacgactgaggtccactggcagcgactgtgtgcaacataaacatgcacacggaaaggactatactctgtaacatttgtcttatttaagcttgtaatgtttgcacttgagtatgttctattatggctgcttccttcgataaggattgtttctcgaggattttcaggtttataaataacctaagctcggcaaaatagacaaaagaaaagggcggagccaagactttgaaaaaaaaaaatggaaaaaggaacccttgcagatacagcaaaaatgggaaatggaggctgtggaaaagaaagaggctgatatcattttctgtctttagatctacctaacggcttttcttacataggagaactacaaatattatgagtatagaatcgatgaggaggccaagcaaagaccgtaaattccagtcgcggaaggtcttacgtaataaatcgtgcgactccagcacatcgtgggctaccttcttcaaaaacgcgtaacgatattttttcaaggtgtcattctcgtcctcgacttgttccgtgttcacgtttaggaaagacgacggcataccgtctttgctctcgtaatattcttcgctgttgctatcactgaaattctgcatgacgcgaatctcttggaggacttcttcctttatgggtatcaccgttcttttagttatggcttcatattcataaaatcctgggtattcgtcttcttgcaagtcgtggaattccaattcatgtggttgccaatactgtaagaaccaccaggctaaaagattcaccaaccagaaaacggggcacaagattccaaaaacaaaaaaccttggcagccaaggttggacaggcacactcattttacatgatttgcattggcaacagtattttttcatccaagggttctcatcgttctcgaagggcgcgctagatgttttgttttatgctcaatacttgatgctaaagtagtcatgtttcttgtcgtcattctttgaatttttgtagtcctatgtacaagcacaatataaatgacagactagtcaacgacgctgaccctttatatgttccccgtatattccttgttttcattgcagttaacatgtaaatttcccgatgcggtaattacgtttcaaagtcatttcaacacttctattgacagcaaaaaaataaagacacttgaaacgcacgattttttcaagaataatatctgtcgagaagatgtgtcacattacctatcattacagtgctactgatagcccactaatgcggatatttaaatatatgcaccaaaaatgtataaagaaataaacggtaaagacaaaaaaaattacttattacaaatcgcaattacaattaaagtacaagacttcctttgggacagaaaacgtgaaacaagccccaaatatgcatgtctggttaattatgatgatgttgaaggtggaggagaagacatccttgttgatgctgatgataatcccaacgcctttttttgcttcttcttgaggataatcttatccatgtatgaatttatgaattctttaactttatgcctttttcctttggttaagtcatcaggcggcgctcttgaagaatcttttttaagttcctttgtagttaggattttcacgatgtctttagcacattgtttaatgttttcatgatcaaattgtttactttgtgggtttttttttattaagttgggtacaaaagatgcaaagaatttattccagttgtgctctagtctttgggactgggagaccgtttttcttttcaaccgcttagcctcttttgcttccactagttttttggactcttccttttgtaactccttctgtttgttgaactccgctataatatcctccaaaacgctttttctttcattctcaagctttagcttttgcttcaggctttccaattcttcttgtttggctctttctagcgcaattctttcgtattccagtcttttttgtttcttcctctcatattcttcgtcactcagcttatgtttcttagagtctaaagcgccaggcgtttttggtattccactgctactcggagaatttacttgtgtatttgaccttgaactaaagaccttagatgatcccgaaggtggatagtgtagtttcgttttctgttctgcattataatacaatgggcgaccgttttcgtgaatgatctcccagcctggaggtaatctcacccttctcaaatctatcattttgctggctgcgacgtttatgtctttcttcgttatccttttatatgtttcaaatttcgaccatttctccaataactcatcgcagtttggctttaaaaatggaaactttgcagggagagtttttactacattatcaatttgtgacgactcaataccgtttcgagttgtctttggtaattccaacaaaaaatctaaaattccctttataaactttatatcatcttcttcagtctcgtttccttttccatctacctgaggttgttccgtgataaacaatttaagcattttgctaaaacaggtgtaaccgtgtagtttgatagcctgatgacgaagagagtcatcatcgatagtaaaaagtctcttcaagagtttggatgcaattatcttattatcttgctgtagtaatacactcatgatcttcgtcacatccactgggctgtcgataggttggacttccaatgattgaagaaattcaatatttatgttctcgttttcattctttattattggctcaccgcttaatttctttaactttagccattttttctccatggaaacagtcactcccaaggcatcagcgatgttctggggcaataaagatgccgcatctgtttgagtcttaccaccgagaaacccaatacaatttggctcctcacagtagcatttctgagcttgagcaccataacgatccacattataatcaaaagtgatttcctcaccttttaaaatttttctttgagcaaatattcccatgcgtagcttatccttaacaacccatttattaacatatgcattggggctgcaagagtgattgcaaaatctggccaacgaaccctttattgtggcgtcaatgaattctccgttctgtaacatcataaaataaaaatgcttgaaatgacgttggtcatagtctattaacctatctctaaattccatctcctcgatcacctcacctttgtactcgtaaatgaactggttggcttctatgtcctgttcggctcttacgccataacctttatgctttgttttaaatatggctatcggagcgtactgcttcttttgaaatctctgattttgacaatcattaccacaagatgaacacaaatcgttgacacattctatcaacgtaagtctattgatacagtcagaatcctcgtcacaggcatggttgacgccatctgagaattcttcataacagtcacattccatgaaatcattattcttaaatgttccgatcctcttgttcgcatatatacagtcatccaagttttcaaatttggtcaatgcttcctctgtgagatcaggctcttgatcaaaaagcctttgaggtttatggccctcagcgttgttattcagtatttctttttcatcttccgacgcactcacactttggttcttcgacatgatcacgtaaaacaacaaccaggaaaggagaaaggtttgacagcacgactatgcagttttctatcacacgttcgaaagcccctttgaaaagctgccaacgtgaccttacgttctgataaataaccaccaaattaccaataattctaatagtttcttggaatttttcacatgtttgcagtgaataaaaaaaaaaaaacgttaaaggtgatattgatcacgtgacaaatctgtaaaagtacggatactgtccttattactgcgatatacagtgtgaggtattctaagcggtatattcaccgtcctctacacatattttaaatactgatgaagtgacaagcaatatcattgagcattcttttttcaatagtcgaagtcagcttcttctcgtcggttctaaacgaaacgccttgttgaaaaagaccgataaatagaggaagcaacggcaggaaatatatataaacgcatgtcgaaactaatactttatgatagattgttcttctatcagttttcattttaactttaaaaactcaaccaacaggtattggactgacataggcacaataaactcaaaaatattacgtagaaatggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttacttcttggtcgccgatgatatgatggacaagtccattaccagaagaggccaaccatgttggtacaaggttcctgaagttggggaaattgccatcaatgacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatagaactaacgctaatcgataaaacattagatttcaaactagataaggaccatgtataagaactatatacttccaatataatatagtataagctttaagatagtatctctcgatctaccgttccacgtgactagtccaaggattttttttaagccaatgaaaatgaagaaatgcgtgatcggaaattacgggtagtacgagaaggaaacttgagccaccccccaaattttattcatataataataggaaaagcaacgacctcatctctcgaacattgtttacttgagcaagtccgattaagagtaagttgtcgtacgttaaatacaaataatcaacaaaacactacacaaaaacttctacgataatgggtcctccaagcggtaaaacttacatgggatggtggggtcacatgggtggtccaaagcaaaaaggtataacctcatatgctgtgtctccatatgctcaaaagccattacaaggtattttccataacgctgtattcaatagttttagaagatttaagtctcaatttctatatgtattaatacctgcgggaatttattggtactggtggaagaacggtaacgagtataatgaatttctgtacagcaaagctggtagagaagagctggaaagagttaatgtttaatattgtttccatgcctctacattacatcgatcttttgatcttctaaaaacttacatatatattctgtttataaaacaagagcaaataacccccatatatttattcagtcagtctatttatttacttacagtatcagtaataataaatacttaagcattttttgttttgtatatctttatttactaaccttggtatgtaagtgtctataaactacacagcattttgttttcctcatccaggagctttgtagtaattgttcaatggtgattctcttcgtggggtcgacctggaacgttctatatagtgcaattttcctcaacctattcagttcgctactaacatgtcttaattcctcaaatagataaaactgtccatcatctttaatttcactgagaaatgatttaaaaagagaatccttttcaggaatggcgattttccaaagatactgtcccatgaccattgtacagtaaacaataccacaactccaacaatctaccagacgcggatcgtattctgcatcccttataaattcttcaggtgccacatatggctctgaacccatggctccactctggaagtggacgtgtttctcccaggcagtctgaaaaactgaactagtaccaaaatcacaaatttttaacaacccattaggttggaaaaggatattttcgggtttcaaatcacagtgtgctataccatgatcatgcatgtattgaacaccattcaaaagctgtttcataaaacagtctgcttctaatgggtgcaacggactcccagaaccttctttaacagtttggatcaatcttgaactcccgttattcgattcatttgagatgttattccttgttagcaacgaatataaatcacctgaagcacaaaattccatcacttctacgaaggaattgctatattccattaggtccaaaattttcaaaatgtttggggcattgaagacatgttttggtggagtggttcttgaaacatttcctgctatcatcgcatttgcctcaaaatgcggatggctcagtgagtgtccaataatgaactcagaggttaatctcgtgcaaaatttatcaatttggtcacctggcttgggcttcagctctttgacggcaaagaatagtttttttccattagagtaggtactgtatggtaggacatctttagcagtcttgcaccttgcgcaaattttgaccaccccgtatgcacctgcaccgacgaccccaatagattttccgtatttttgtgaacaaggtttatgagatgtatcgtcattggttgttcctgccttgccctctgtgtcatcagaatcctcctgtttattgctattgcttctgccttcgccattgttgccttttgtattttcacttttaaggccctttcgtattttttccgataatgcattgattagcttcaactcttcaacacctacagcagcgttaggattcacgatttgcggaatatttttaccatcgtttttcatcaattcatcattattgccatttttaaggttactcgttctcgatttctttaaagtctgcgatttgatgaatctctgggatggtattattgaaaatgctttttctagattgatttgttcgccgttttcttcttgttgctgctgttgctgctgttgttggtttccatccttatgagatttgaataatccacttaaagaaaacacagatttttgtttatgcatatttgcctcactgtcattgtcaccatcatcgccgctgtttacagaagcgtcagcatccttttcatcgccactatccacatttttattgtttgtaataattggcagcactctcaaagaatgttcgtggtatccgttttcaaagactttgaaatgacctaaatccaaaatacatttacattcgatttcttgaaatttcggtaagctggaagcactgatagagtctgagtgatttcttcccctcatgtatattctatttcctgtaccattaccaacattgttggtggcatttgaattcattccaccatttccatttttcattggtggtgaccttggtgtggacaaactgttcttcctacttcttgtgcgattgctatgattacgtacgcccagactgtttctccttctaagttttgattcttcgtcataatcaagcatagcatcaatagaaaagttattttcctgatccaaaacatggttggcattactatttgcagggtttgaagaacctgcgttttgtgggaagtttttcagccgttcccttggttgtctttcaacctcatcgctaccaactgtatagcggtgatgaggcacataagcttccttggaacgtacatgttttgcacgagctttctcttcctttttattttgaagatcctctctctctaacaaattggcttcatcttcatctttttcacttatgaaagattcttgtgaaaacatttcattttctgaattcaaagatggttccctactaggtgacaacgagagttttgcaatattagggacgcccagtttgtgatgcttaggagccgcttgtagaacagggctatgtacgggggatatagacggggaagatacgttgctagttattattcttgctgtttgatgagaatgtgcttggtcctgaccgggacgagatgaaggagccgcagcattattactgcctgatatccctgaaggcttaaatagacccttaatggattcggagagcgatctggccctcttcaaagatgtgtggcgtgaaagcttctcatctcccattgtttttattttttcaaaattttttttttatttagcaagtttctctatctcctttgtattctaaaagtaaatggatggaaagaatggatcttttcgtagactataatgcttcctaaaatatacacgtatagaatggagattccgacttgtttggagccaccaattgccctttatttggtttataccaaggggctcacgtaaaaaaaaaatcgatatgcaaaatccttcatttcatgatgcaagctttcgaaagtggcgcggcgagcaaagtagaaaatcaaagacagaagcgtagaataaaagcccttttaatggtaggaatacgcctcgataacatcatgtatgcaatctacaagaacagtgaacgccgttccatctccgtagtaactatacaggggttgaaatttcgttttcgaaggatagttgttatgtagaaaagagggaaaaaaatatgaaaaaaaaaaaatatagatacgagaggaaaatacaacaaaacattagtcattagaagtcccggaaaagatcagcatatgggtcttcaccttgaacaccgtagttgatgtcttcttccgggtacttatcgaactgtgaggtgtcaccttgtccctgttgaatgggcggttcatacggcgtttctatgtttctagataataatttttcccagacaacttctttgaaccaggggtggtttttgacatcttctgtaccattttgtaaattacctagtctttgacttaagtctcttgtgatcaatctactcaacaggtcctttacatcttcgttgaaaaatggtggaaatctcaattcggcattcaagattttctcataggttttcatcgtgttagagtcgtaaaatggcgtgtatcctgctagcatttcgtaaatcagaataccgaaactccaccaatcgatagatttattatatggtttagtactaacgacctcgggtgctatgtagtcgggagtaccgcataatgtatatgtgacgtcaggaacgtatttggcaaacccgaaatctgttatctttatatgcccgtttttatcaagcaagatattttccggtttcaaatccctataaataatgtccttgctatgcaagtactccaaagctaaacaaacttccgctgcgtaaaatttagcaactgggttgggaaatctttgggatttccttaacaaagaaaacaattctccaccttcaatataatccataatcatgaaaatttgctgagcatcttggaaagtcccccacattctaataataaacggatgtgttacgatagaaagcatcaatcgctcgtcgttggtatgctccacctgtttcaatcttaccacgatttcctttttcaaaactttcatggcgtagtatctgccattatgtcttgatctaatcaaatggaccctaccaaaagaacccgtacccagtgtccttaatatctgaaagttcttgtaaactatacttcccactgtaactctcgcttgggcaataaactgtttatactgctcctcattgtaataagtgacatgtggctgcttcggtttttcttgggtttctccaccctctttttctacagacttactttcgttaccgctctctgtggctgttgtttccctttcactagtctcacctttttgtgattcctcaccttgtctatcatctagagacttttgaccacctccattttgttcttcagtcgacatacccaaaaaaaagattctttcacacaatcagctataattcatgcactgcttaagctaagagaacactactttctgtgctacctttgaagccgattgaaaatgcaagcaagccaaacaaaaaaaaaagtataggggtcagattccttagctttatcaaattaaaactcttagatggatacaatcgcagcttctatgatgtttcgcacctaaaaattctcacgtttttctggccagagatagtagatgaatatttttcaagttttcaagtaaagggatacgatatcccccttgattattatgtcaaacttttaccagatcccgccttccctcccccctaatagcgcgaaaaaaaagatcatcatgattacgtagaaaaaaccacaacaacactatgttgaatcatgtcataagcaaagtcgttaggacactggctttgcaagaacgaatagcagcacagcttcgaacaagtaactaaaaatatgtggtgtataccggtatgtaaatgtttttaaggcccgtccagcggagggttcttgtaaattcttaggaagaatgtcaacaagatggcaacaatacttgttgagaacggtatatacataaacagactaggattaacggagacagtacttccatatagcttaaggaggatgggagggatgacaagcataacacaggaccttaccaaagccattgctccgaacatctcgcctgtatgtttcttagaggtgtactttatgataccagactgcaaagttggtgaacaaaacgcgctcaatgcctgtaaaagagcgaatattatcatggatgtgggagttttctcgccaaatcgtatcatgacaaagagactcagtgttataacaatcatagaaaactgtatgcaaaagatgtctatcttgtctatcgaatggttcaagtgttgataaatcctctttagcgtgtacagtaatgtaggtgatacgaccagtaacacaacacctcttccgatacccagtatcgatatgaaataacctagctctactgcatgccatttgtactcatatgtagaaaacaaaatcaatgctggcatacacgatgtcgttccacagacaaatagtatatcgagtacaatgagtaatattacggtatgccggggtactaaagaccctgcactgtcgggcttcagccataacttttttactggagcgagcaggtccattaacctcattatttgaaattttccataagtaacggattggtaatttcttgcatcgtcagaacccgattgtgatcttagtttctctctcctctttgtataagttgattgtgaatgggccatttgggtttcatggcgcggttccaccatgattgtctcacatattataagcgccagtataacaaacgctattgatgtgtaaataggaatgaacccgtttccatgagtccacttcaccagaaaggacccaaacattgggcctacgcccatagtggcatatatacaactcatcattattcctattgtcaccattctgtgctcagttttcactatatctgaaacgtaactatttccattcgccactagcgcaaacaagccaccgaatgatggtacgatacacgcagtaagaacaatagcccatttgtgatacttcattttcgatgatagggtaaagacgtgcgtaagaagccctatgaccctgatgccgctcatgtatttgaaaacacgcactcttcctattctatcggataattctccccacttaccagccatgaaaatactgattgcccctgctatcatcatagtggatgaagaaatgctggaaactattgtctgtacagccacggaatcataatgtccattctcatctgaaattccttccgctaccttgtccatcaccaacggtattgtagcagtcatagaaatagactccgcaatacagataatcataacaaggccgtaaaggcataatagttttctacgtccatgctctccctcaacgcttttggcaacactcaaaatactgggggagcgccggatagagtcatagctactgtcctgagctgtttcattagtatccaaatttattccagtactgtcattttgactaatgatttcttccaaggcgttgatcccagccgtttccaataaatagtccatctcatctgaagacattaaacgagttgtttcatcctcgtttgacattgttctgcgcctttgcttcgcacggtttgaagatgtatacgtgaaatgcaagaactagggtttgtattccttataagtctattagacttcttgcagatcagcccttcatcttgttggtttttaggaatcccttaccctttattttttttttttttgatttcgattaagggcgggaaatcatgataaacttccacggaacaacaataaacgctcggccaatgttagtaagatacactgtacttacctgatgataatcccatagcactttcattcacttggaagccaaaccagtttataagtacttttaaattgccaagtgcaccctttggtaatttttttttacttttaccattttctgtaagaattttctatttatttcagtagtttattgaatttccataactaaatatatatttaagatattaataattgagacatgaaatgtactgactagatacttttatatattttacattattcattcaaattatttccatcctggcgtaaggacggcgggtatatgctcattaagaagagcgttcgattatactttaccgtcacatctttcggaaaaaattttaatgacctgcatctgtctttcttgtaagatgttcaatttgtccattaaacttttatcaaattctaggtatgttttccaaaccataatactttgcttttgggttaacatatcactgaactgcgtatctgctctcaggcgctgtaatgatacttgatgtattgtttctttaagtttgttacattggttattaaacagctgcacgttaagcttcaatgtttcaaggtcagccactgcatcaaattccggaatctctggtatttccaaatcttagatctcgggtgtaattccacactgttctagtaacggtttgaattttgcacgattactttctgcttgggcaaaagttccaccttgttcgtgactctgagtggtcttcggctttttaaaaagattgattgattctaacgagtcattaattggatccatcataaaataatctttttctcttggtaaagattggaacaattcttctaaagatatatcatctttctttctccttttcatccctttaggttctttgatagataaattttctatgtcgattgagtcgctgtgatttttatcacctatttcatcccgacgaaacagcaagtctttatttcgatcgtctacattgcttatattgagtttttcaataatgtctctcaaaatgttccatccttcattggcactagttgttgcaggtatctctttaatgggagaaactgactttctaaactgattcttgcattcgaatttacttcttgcgtaatgtcgatactcatgattgtaaaaaggagattgcaaatttgaatcatgggatccactagaaaaagtactggtcttgggcaatttaaattgtttgtgtcccgtttcttcttcgccattttcctctggagagactctgctttcccttttcggttctttattattttttttttcttcatcaggactgctagacttcgacgtcattccataatgttgctgctgttgctgttgttgctgctgttgctgttgttgttttcctgcttcttcttcttcttcatgatcgcttagtgctgatcccaaacatgaatttggatcttcagagtaagatttatgtgtgtacgcatttttacccaatatttcccatatttcttggaactgagagttcgtatccattttaccggcatcagtcattcttacttttgaggctccattggtttcatggaacaaagaatcaatatcaggacttccatgtttcctttcctttttggatgaataatagtggtttcgttggtagctttttaaattgaaggacttgaatatcggaaccttactcttagagcttgaggtcatttttttgcctacaccgaaaccgtagggctgttgctcataaggtttattttgcctatgataagcttctgattgaccaagtgtgggactagccccttgtgattcctttgccttggtcttgaaaatatgacagtttttcttcggctggtaagtgtgtaaacctttgattttcaaatctcgatcatatcgaagtttttgatcttcatcagttaaaattgaatgtgcatgcaccacagctttgaataattcctcagacttatcagattttgttttatctgggtgaagtaatctggccagttttagatatgatttatgtacttcggaggaagtcgcatttgatgtcaagcctaatatggaataataggttgttctatctaattgtggttctattacctgtgacataagaatagtacagtgtacaatagcataaactgaagaagcactttgctacagtctatattgaacattccaggtctatttacgctcatgcctcaaaaaaagtttaaaggcatcgcacggtattgtattttcaagatgtccgcaccgaatcggtattgtaaaagtttcacaatattgaacatctagcacaatgatcaactgaattgaggacaaacagataattttcgtgtgatattatattttaataggataaaggtgaactactacaaactatttcaaaaaataactatttagctaatcacataaaaaatactccgatacggggagtcgaaccccggtctccacggtgaaagcgtgatgtgatagccgttacactatatcggattataaacggttaatattcaacacctaatagtactacttaccaaattaacaagaggatcatctttcccatatgataatagacaccggctctaaactcaactgttctgtactagttgttttgatagaattttttttacaaatctgcccaaagtacgttttcctagtttcatgcctgtgcaacgccgcagcgctaacctgtgcaggacagatatgtaaattggaatcttaacagcaacagagactctctcaaaaccgataccagaactcaaccgcacttcgttatccataaatgttgccttagccgaatgcaatacatcccttataaaatcaatacaatgcgaaacttaacacaatgctagtcgctaaccacgacaaatttcttgcacctccaaatctgcctttgtccctctcccacatcttaactataccagaaatgcctctctgttctgcaaaaaacctgtgttcctgctattagatgaggtaaattcaaaacattacatgccatatcttcttctagacgactacacctctaattacatcaacaaattttaaacttatatcgtctagagtgatcctttcgctagaaatggtaataactactgccattggaatcatagtttacagaatattgcgagtttgctctatattagatatttataaacgctaggatggaaccgagggctgccacgatgcttaaaaaattacagtgcagcaactccgatgccattaatctatcataaagtctggcggcgtattccttgcacaattttcatatcttcccatatgaatacctgttagtccgtatcaccaagtgtaaactgttctttacaatgagaacatctagagtctttctgatatgcgtaacttctgcctcattaatttaaaaatttcttcatagtaaatagcttatttgcttggagcagatgatcgacatgtatttttaggaacataaactgcctaaatataatagatcagcctaaaaataagaatgccaatcaacaaagttgtatttcctatcttccgatattcgcagtccaccattcagacctctggtgagatagtttgcctgcttttgctcccttccaaagtgctgataaaaacctccgtgattttttgaatactcccctgaatgtctattttaagtatattataaaattagtttaagttggtgcggataacgaaaacttgatgcaaggtaaataaatcaagtatatcatagagttctttcattcatatgctatacacaaggttgttacgtcacaactcacaattcaccaagttttcaggcacatcgcccaatcttggctcaaaacctttattttcgaagggtaatttgtacactagtcttttagtgacaacactgtatgggacaggtctggcatgcctatatctagaatcaaatagcttgaataagtccaaagagcaagaagatccccatgccatcgcagaagacgacattgtaaatatagtccatgacgctcccaatagaatattcaagccagcacttgatacctatcaagagaaagagcttgacttacaaaagagtgacctccataaagtacttcattctttgacgtacagtgatgtctctcaattttcgattgtttgggggtttctcattcaactttcgagcctaataggcaattccaccttaggcaaaaaatccattctttataagggaagtgtcgttagtgttttagggttcccaccgttgatttatatggcacttaaacttaggatgaaacagctggaaaaagctggagtgcgctttgagtaatgcagaaggcaacatctccgaaaataaaaacgatgaagtaaatgaaaactcgtttgtgaatacgtaaaattataacgcgccccatacatagtaagacagacttacttttatactattattttagttatatttttgaagtacaatcaagacctgcaagattataatgttggtgattcaacaatcgacgagaccaactgtttgtaaatgaacgggattgcactggcccccgatagactgatcgtaaaggttatagaaagtgcccgacagacattggtaaaacacgtcattatcaccaatagctaaagtgccatgcttcgttatcgaccagccgccagcgtaaatagcgcccgcctgtggaggtggaccatcaaattggaactgtctgtttgctactatcgatccaattctaccactggagtcaataagaacacctccttgtaacgttattgccaaggtgccagaacttttacaggcttgcaccttgatcactttttcattatttggtttctttgttggctcttaacttactcttggaaagcacagaactactactggctgaagaaatagtaacttgcacttgaccatcatgaatctgagaaacagcagttgcggttgaagttgctgtcgcagttacagttttacttggaacagcaattgtggactttgtgacaacatttttagctgtagttatttgtaattgaccatcgcctatttgtgacacaatatgtgacactactggaggcaccttctgcgttgtaacttgtatttggccgtctccaatttgcgaaactggatgaggtaatttttgtgtcgttacttgcacttgaccgtcattaatttgtgaaatgacgtttcttttgaccttactttcagtaacggtgaaaggtataacagcgagaccgaatgaggtccggtactctgttgtgccaccatccattttagagcttggagttaaagttgcccagggttcaggtggagcgtacgcagttagcgcaatactacttaatagagatgctagaaatgctttcttgtaatgcatattggggcggtgttcacttcttcagtaagttgtatagaattaaaaaatcgagactaaacagaaatttcgaaacaagaagataagtatatgtatacaagttattttactcttttaactgttttcgtttccccactctttcgcaaaaagaataattttgtgagtcaaaacagtcgaattttcttgcacaaaaagtcgatattcttttgtgactctgtgtaacttactttctacagcttttgttactccacttctcttatatatacccaatgattcactcgtaatatatcagaggaacgttagaatttctgtattttctcaggaatcctacaaaattagaggtgaaattgatcaggttaaggagcagaagcccactatataagtaagatgatatcaagcctagttggatgccttcaggaacggcaaataggatatgtgagcttggcaaaggggttttgatagagtaacaatagatccttgctagccaatgcgacgttcctctgtagtttttaccacagttttacttaatttcgtgctttgtccctttttggcaaaaaagtcggataatgtcttcactatatttgtgttttcgtcttttaggaaaagcgtactttagtaaactacaaatttgagctgagctaatttcggattagtaaaagatgcaaggaacagtaaaaattaaaatagcgattgaccgaaatcagtccaaaaattactacaacaagcaaatccaattaaaaacagtaaaatactttaagtgcatttaccgttacgaacaacatatgtcctagttagtatagtagtctactaagtagcaaaaaagtagaaactctgtcactataccagccatcagttcatagtaaaacagtaaaaattgtaaaaacaagcaaaaaaaaaacaagaaggaacaaatgcaccaaactgttgatctattctgcaaaaaaaagtatggtaaattttttccattatcctggccgctaatccatatggaggtgaacttagaacttgcacaaggatgcgatgaatgataggctttgtgctataattaatgcaggcaggtccgccatgtccaacacgttgctggccgcaaaacgagtcaatctcactgctttgccacgctcatttctccccccttctgcccaattaggcgaccctcacaatgcacatacacatttcccacctctattggaaggggccgtaaatggtaattcttgggagttattcatattaagtgatcttactatttcctatttcggaaattattaaagacaaaaaagctcattaatggctttccgtctgtagtgataagtcgccaactcagcctaatttttcatttctttaccagatcaggaaaactaatagtacaaatgagtgttttctcaagcggaacaccacattttgagctaaatttagattttggtcaaaataagaaagatcctaaaaaaggaatggttggtgaaaaatttattagcttgaatggtaggaatcctcgagatataaaaggaacacttgaagtctaacgacaatcaatttcgattatgtccttccttttacctcaaagctcaaaaaaatatcaataagaaactcatattccttttctaaccctagtacaataataataatataatgcaatacaaaaagactttggttgcctctgctttggccgctactacattggccgcctatgctccatctgagccttggtccactttgactccaacagccacttacagcggtggtgttaccgactacgcttccaccttcggtattgccgttcaaccaatctccactacatccagcgcatcatctgcagccaccacagcctcatctaaggccaagagagctgcttcccaaattggtgatggtcaagtccaagctgctaccactactgcttctgtctctaccaagagtaccgctgccgccgtttctcagatcggtgatggtcaaatccaagctactactaagactaccgctgctgctgtctctcgtgatggtcaaattcaagctaccaccaagactacctctgctaagactaccgccgctgccgtttctcaaatcagtgatggtcaaatccaagctaccaccactactttagccccaaagagcaccgctgctgccgtttctcaaatcggtgatggtcaagttcaagctactactaagactaccgctgctgctgtctctcaaattggtgatggtcaagttcaagctaccaccaagactactgctgccgccgtttctcaaatcggtgatggtcaagttcaagctactaccaagactaccgctgctgctgtctctcaaatcggtgatggtcaagttcaagcaactaccaaaaccactgccgcagctgtttcccaaattactgacggtcaagttcaagccactacaaaaaccactcaagcagccagccaagtaagcgatggccaagtccaagctactactgcttggctattggtgacaatgatgtcttctaccaatgtttgtccggtactttctacaacttgtacgacgaacacattggtagtcaatgtactccagtccacttggaagctatcgatttgatagactgttaagcagaaaactattagttcttttatcctgatgactttttctcatttgcattgattagaaaggaaaaaaagaagtgtccttttctactactactctagtcgcatccattcctttgcatttatcttttctgcggttggccaatccattcttccgagaatttggctagccatacttgatgttttcccattattggttcgtttggcaatgctaattttcttaattgccccttatatactcttccataaaatgttttttttataactaattttctgtatatcattatctaataatcttataaaatgttaaaaagacttggaaagcaacgagtgatcgtgaccacataattgcctcgctacacggcaaaaataagccagtcctaatgtgtatattaaaggctgcatgtggctacgtctattaaaaaaaaaatatttatctaaataaaagaaaccttcttttagagaaccttaaaaatgtaatatacaaatcattcataccaaaatctttttacaaatcataatctttttctatttcttttcccttataaaaggtagaacattagtactttgatgtagctatttaacagtcgaccaaagaaacagcttccaaatgaatggcactacattgttcggcgacgttttgatcatacaagttgtagaaattgccggatagacattggtagaaaacgtcactgtcacccaaagccaagtaaccatcttcagtaatggaccaaccggcagcgtagatggcgccggcttgtggtggtggaccgtcaaattggaattgtctgttagcaacaatagaaccaattctacccttggcatcagtcaaaacaccgtccttcaaggtcaattctaaggtaccagaattcttacatgagctatctttcaaagatggagtggcacaagaagatgatgtggcattagtagatgttttagatgcagaggaagagatcttttcggagctggttggggtagcggtagtagtagcttgggcttgactatcggtggcttgagcagtagcagcagaagtggcttggacttgaccgtcaccaatttgagagataacgtctctcttagcttttgaagaggtaatagcttgaacagcaataccaaaggtggtagtgtattcggcagcaccacaagagatggagccggttggggttaaggtggaccatggttcacctggagtgtaaccttcagcagaagcagtggcggatagagcagcaacggaggcagctagggcgacgtttttgaattgcattttagatgtaagtttagcgagtgaaatagttttatgtgtcttgatttacaattactactgccaaaaagagaaggttaagatagacccaccacaagatagattggctctctttcccgaatacttatatactgactgtttggagatgaaaccttcgagaatttttcacccactgtcaacctatttcttatttttgtttttgtttgtggacgtttagcttaaatcggcgcgaatttttttggcgcagtacacgctgacccgtttcttttgggcgaccgtgtctcgaccgtagcaaaaggggaaaaagaaaagctggaagggctaggcgggatctggcccgtggaaatcgtatggaatgcataggcggtccggtcaggcaccacggaaaaaagctgattgtcctcttttacgagccgtggatttgcaggaagaagcaacgcacgcatggaaaacacgtgacctgaaagtcaccggaacaaattagccacatcgacgtttcttttactatacagctcgaacaagctaacttgaaatgctacaaccatgttggtataattgtgtacagacacgtgcatttttggtacgaagagggttacccggctgcgagtttttttcattatgaactaattcagggaaataatcccgttcgggaaatagataaacaacgccaaacgaaaaaaaatatatagtgcatatatgacgagatttaattatcgccaataggttctttcttaggcaaaattaaagtttactcaatttctatttatacattaactgctatttacgacgcattatatatattcagtcattgcgtagtatagacgtggagaaacgaaaaaaaaaaaaggaaaagcaaaagcctcgaaatacgggcctcgattcccgaactactagaggttgggaacttccagggtctgatgaattctttgctgctttaccaggtcaaaatattctatttctatcaaactagaatgcgggtgttcatccataattagacgcgttttttgttcacccgcagccatatcccccaaatatacttgctcgaatgtagcttgtggtagacgaagagttacatctagataacgcttagtgtgcagctcctctaaaaactgcttaatgctagcgttcaatggagtcatgcggcgttgcgaaatttcgtatctccaatggtaagataactggtcaaaggccttttttaatttctgatcatgctcaatgtcaacaacgtcactcccgttgaggaccaagatttgcttggcgtatccagttgcaatatggtcatctgtatccacgtatgcacttgttgacgctaatctttcacaagtttgtaatgttaccttatactgttgcttttcatcgcggaagacgtttggattaaccacttctaaattatccaagaaagttgtccatccgtcccaatttttatttatcattccgatgaaggtgccaaatgggcctactacaccggatccatctcttccaacaacaactattcccagtaaatcgtctgtgtttaatccatccaatatttgatgaacactctttagaactctcttgcgatacagttccccatcagcatgcgacaaattcaaacatacaataagttttagcggcgtatcactgtgcaatcttttccacggtagacgagaatcatgggattgtgctgatataacatcaggcggcgctcctaaagcgcctattatattcacatgagagagttccttcactgtagaaacaatctcacttaatggtagtgtctccagtgaagaattttctagacaatacttccatttgggaagcaaccacttttcgcagttttcgttgaacctcaagtatatttcaggtatattagtgctcttcaaactacaaagtagtacgtcctcattgaacttgattacctggtaaaactggtctctaggaatcttacccaggatcttcatttcttcaaaatcaaacaaaactagaaatttggagaataatattacaaggttattgtctacccattgttcgccatcatcagaatacattagtttgtcaaacaagatcaaactgccaaattcgctatccttatccacatttgtttcgatatattgatcaattttctttttccattccttttccctttcctctagttcttcgtggtccacatgattcacatcttgcaagacccctaaatcatcactggtccgcatttcttgaaacttcacactgaccataacatgttcaccacccgttttactaaaccacacttcagcagcactttcgtctatttcatcatcacagtccagtttttcatcatcacttaaatcaaaagggtctgtagttgccattttattaacgaatggtgaatttaaaaatgggctatcaagatagctaacggcctcaaattgattgctattcgataagcgtggtgtcctgaacccatcacatgaaatatcagcagtacgaatgagctgctcctgtggtgtaaactgaggaaattcacctgtgaagcttctcgccgttttcaaatcaatccattgctgttgcatattggatgacggaccatcatcatgagcgcctgcgcccgttagaagtttggataccatttcaggaacaatgtctttatcctttggcttgctcacttcgccacatatcttacactcaggaaacttgccttggaaataaagagtttcaaatagcatcaaataacagttatagtggctagtgtgtgaacacgtagactccacaaccttttcaccggtaaatgtggaactaatactttcctcacagattaaacatttctcacctatgtacctttttggactgaattgtgaattgcatttttttatgtttctttccaggctgatcatgaaagttggtgaatcttcttcgtaatatgaatcgccgtcaatgcgataatcttcatccataaccgttaaattgatgtctgacaaagtatcacacatagttgtagaatcagaaatcgactctcggagtaaactagtagttaaatttgtagctttgatgttgtatttgttgctacttgtgatatttactggcgattgtaaagcgctaagttgtcctgttttcgaaaaaccagatgctactgatcccgctgttttcttcaaacttggtgggggagatataggcttggaaagattcagtggtttaggaatattgcctcttttggacatcattaggccaagatttggagtaaattgactctcttcaatatacccaaatgtgggcatctgttgcttcttaaattctggtgtctttctaaaaactttacccgataaacctcttagaaatttcttcggtggtgatctttcagcgtcacgatctccacttggtggagtgtgtatttttttttcaaacgaaactcttgttggtgtcttcattaatagattgccttcttacgcccacgaagctttccagtggatctatagactttgtgtaaaggatggtcaagaaatataaaagtaaatagaaattttttgaatagataagataatatacactctcaagacagagtgaacaaaaaggatagttttattttcttttaataatttgaatatattatatactgtgaaccaaggtaccttcgcatttgaaacctttacgatgtcattttattgcctatttcctttttaggtattttcggtgaaatggctgcatgttgaaaattgcatcgctgaaaaaaaaagatatgcaaacaaaagaaagttgcattctgaaacgaccgggtctctcttgcccgcctaacaaaaccaaagaggtaaatgaaagtaaacagatatttttccttacttggaaaaataaagcaacaatgaaggtgagttttatagtcgctcctacagtgatgcaagtgcaatgtcttttttttttcatcctgtaatgggttaaataacttcaaaaaggcaaatcatccatctagttgtggatcaatgtcccattgaattttagttacagtcatgtagtctctccaggatatcacctataggtgtgaacaaaccaaactgcctctgttcaccatcgtatgaatgcaacataccaacaagccccaaacctagacgatcttctaacttggtcaagatccatgcgcctgaatcccccgcactagcaaataaaggagttggagatgcaacgacaaactcgctactttgtaactttccgtcggcccaataaactaattttgtagaatttaactcgcctgaagtgtatcccgtagaagcccctattttaaatactttcatcccaggcttcattttaaaaatttttcgtttcacatgtaaattttgaaatcttaatgttggatctgggaatgattttaagccattacctagggtattctgacatttgaatgatgaattaactttgataatagcaaaatctgataatctgtgatctacgattgctctctcgccccaaactacttgaccaaatttgtttgatttctgccagttcaagttttgatctattctttgcacttcctccaaaaatgctgttttctccaccgaaccatcaggatacctatctgattctttcgttaaaactttcttgtaagaagtctgtaaaacattagaaggtaccatgacgtttggataatcttgcttctcagataatacaacgtgggcgcaagtaatggcaaatgagcagcttgcaaattgagaaaattttttatcactaccagtctgagggaatagataaccccctaaagtacctgtaattttagcgcttgtctcagtggataaagacatagaaattggcaattcaagtggattctctgaaactgcatatgggggggaaaactgaaatttagttggggctattgtatcgatagttgctgcggtatgagacggaatactgcctactgctgatgcagcttttttaatgtaatctttcacacaatacatgtgtacatctgggaacaacgaataaagaacctttatcatttcatagtgttcatgttgcaagttgggtaagccaaacattattgtaagaattgaactctttggggttatacctctaagtataggtgctataaaagcaccttcctggtcagagattattgaagaatccattttggtcaactcatctagaatcatgcctaatttatccatacttggtaagttgcaatggctgccaatacaaaagactgataagcatggtaaaacgcccgattctgatatcaaatcgtcatccgtaataaggtttagtttcttcaggaagaagtaaaatcttcgtaacagtatcgacctagaattcgaaaatgcgtcggaaaccaataaattatccagaaaatgtaatacaattttattaatttttcgtaatgaagacgatttttctaaacttatcctgtacggtatcctgtctcgtgttgtcggtaagaattctttaaaatattcgatggcttcaataaccgcttttgaaatactgatgacatcctgatgaatatcatccattatatcaaccaaattttcctctagctcagacaaacttttgtgaatgtactccaaagtgatacttcttctggaagtgaaactgttttctctcgcattttctgaagtggctaatgttgaggacgttgaagagctgacgtctaaagtattctgcgtatcctgagattcctcctccttaacaggactcaagaagctcaccgctcttaatggtttcccaacatctttgaaaccctgtaaatttttactattcttagatccactatgtccgctactgtgactacgcatttctgatgtggccatactagaagaggctcccgttccgtaagtcattcttcctctagaaaatatggatgacgattgtatggacgaaccaaaagtcgtagacgcatcatcattgtttgcattttcagggttcgtatcatgactgtttgggtctattctttcttcatttccagatacgttgctagacgacgtttctgctgcgttttgttcattgtctgcaggcaagtctgtattttccttttcttcgttctttttcttgtttaaaccaaaaaatctgaccatcggtatatcgagtttacaccagtactatgtacatgcaaaaagaaaggaggatatctagtatgtttattcaacctttattgtatatttacgttttctgtactgtataatttcattttcgaatcttacttttttttttttactcaaaaatacttccgccgcggtgttctacaatttcacttaaaattagtttgggtaataattacatacaatgctgcagacgtacataaaaaaccatcaatgctacgtttcctgatcttttcgtacataaaagattgtgcgtatcagccacaagtaagcttggacttaagatacacaaaaataaaaagtaaaatttaaaatttgtcttccaaaggagagtcattgagcagttgatgaagtttagttgagctttgagaaagctcacctacttggcttgtacccttctctttatatgtactcactgcagggatgtttgctttaattttggtgacctttgtgccataggccctaggctccagcttgatcaatgtgtgtagtgggattgacatccaaggggattcctcctgtggaacgttcataaaatatgcatatatacaccgaagtacggcttgatgagttataatgagaacattttcttggcgctccaattccataatgacgggctctaaacgaatcactacatctctgtatgattctccaccacgatatctgtactcgtatttgtcattatcacgtgctttaaaatcttcaggatattctttttcaatttcctcatacgtcattccgtcacaaacgccagcgtctaattcatcaagtgctttccattgcagtttcttatagggaagataatttgccgtttgttgtgttctttttaaggtggaagtccacacggtcaaatttatttctcctgcgctctctttcactaactgctccaattttttagcgtactgaaagcctctttcagacagtgatgaatccccgccaatttttttctctacgttatagatcgattcgccgtgacgggagagccagatatattttggtttaggacgaatattcataacataaaatacaatcctactttccaaatatgttctgatcttattaattactacttcttcaataatattgaccaacttaatgaacgtcatatccttatctttttgggggtccaaaggttcataaaatctttcatattgtctaattctttccaaaaaatcagcttccgccacatgaggttcagagttttcataatcaggagatgtgctaccgatatccttagcgttatttataatcagttcatgatcgttactccagctctctaaaaacatcggttgaatattattcttttcacatatatctttaagccatttccttcttttacgtgtactattagtagcatcgaaaactgccacagatccgtcttctttagtaaaaaaattaacaatatcttttatggcattttgggcagccaattctctgagtttaaaattatctgtattttcgaagttaaaaaactcagcatccattgggacatttccactcacgtctcttctgtaatttcccacattaaaacacttggcttttatggataaccacgataagtacctgataattttttgggaaataaaagactttcctctagctggtaggccaaccattatcacacatactttgatatcattatcgttggaaatagtactgtaccccatgtttcttgtcttacttgattcggtttttgagccccctttcctttatttcttaacaaacttgcttggtgaatttaagagcgaagggaaagcaaagattatatattaaattcgtatccactggccaaaatgatactttacctgatgtaaatgtatgataagctatagctctcttagtggcgctttacatgtagatgtaagttagggataagaatagatttgtgagcgcattggcgcgacccatttttttaacacagaaaaaaagtaaaaaatagaaattacccaattaagtgtttttatagtaaacaatccttgatatcttagttgaaaataaactcgaattatgtacaagtttccttccacttaatctatgatccttctttaggtaaatttttattagctttatttgtgtagtttttttttatcttgggcatgtacgaagagcaagtacgttatttaactatacatatatgactttgaaacgatcgtcaacttctctttgactttcaatgtactcacaagtgcgtcgaaaatggtggattgggatatacttcagttggtgcagtaatttactacctgaagcagttgctacgactccgcgtattagcgtggaagatccgttcagagtatttaattgaatatacgtaccatccgatcctatggcaacatttgattccttatctgtgattacagagccatcgtcagcattactgcttgccttcacattattttctccggtgatgtgcaaatcactgattgagttggtaatcatagaggcactgttatcttctagttttagcgattttaagtttgttttgattagttcgatcagaccattgatgtattttatcgatatatgagtttcggactcatccccgtgaataaaatagtagaggcatctatttaatatttcgaccattagctcacaactctgttcgttatccattatagaatccgccacacggagagacctttgtagacattctaacacccgtttaccatctctgtagaagttgtctgtgataccttcttcctcaccaatatttgaaatttccgttgcccaccagaggtgggagcataaataaacagcacgacattggtcttgtttctttaataatttggatccatggagtgtgcatctgacaatcaaagaatcataataagcttctttgtagagtgatcttgtcttttgtaaagactgagcaatatatattaaagcctgtaactgagtctttgaatcacttagagactcttcaaatattgtgaaggcctgtgagaaaaaatcatatgaaatttcgtttaattgcaattgatcagctagaatggcacattgtaaattcagtttcagaatcagatctgtgcatgagttgttgcaagaattaaagatatcattgatacaacgagaaacaaatttaaacatttgctttaaaagattggaataatgggaaagtaacgtcttgttatcgggtctttttttcaaaaggtactcttgtatcatacggcatttcctcatcagtttccaaaaatttgtgattattgctggaaaagtgtatttaacattgatgccacctttaatgaacgaagatttaataagaagtaatatttccaattgggcttctaagctaaattgaattttgtttttcattgtttgtttccgagaagtagtgttcattatccaatgaatcaaatgtgccaacttttcctgtattgggtccagtatccaggattcttcttcatcatgtcgattaaaaaacacttcgtctacatttgtatccgaggatgcaacatttgcgggcggtccgcttcttgatattattaagggctcacagattgaaagcaggcgctgaacttggagtttgtcctcaataactaaataagcggaatgccctggaggatgcagtttcgattctgaatcattatcggccatttcttccacttctctatccattaagatgtcaataatttcattgacaacttttttttgtagactaatgctctgcaaagccaggatgtttttgtaagcctggcactgggagattaattgaaagataaaatgctttttcgaagtaactggtgagtttggtggcgcagtggtcgatgaggttagctgaagtttactattctggaaagataacagaaccaaaaataaatgctcggactctaaagaaatatttttctgaccataatccttagttttttgtaagactaattcaaagagtttgttcaaattatcaaaattattaggataccatttcaaacttaaaacaatcacactctcaactagaggaataaactgttgtaatgatagatctggtctttcatgattcaatacggtcaaatagtcccagaacgtaccaaacacgtccatatctaaataagcattcgtggaggtggcgtttggatcgtcctccaactgtcttgtaacataatcgtttaatcgatcgaccaaagtgagaacaatcttgtttatcgaaacatcagggttcaaatgcaaagtagtttgcagtaaagtatccaaggttttcaaatggaactcgtctgcgaacacttggcagatgacgtccaaaagatattcttgggatactaaatctctacattgtatgacttgttccaaaatggtgggaagaatatcttgcttatacatttggaaattatcatcaataatctgcgaaagacgtactagttgagaccccactaaaatttgcagctcttttctttcacgtgttctggtttccctctcacgaagtggcccctggtgttgtaatctcacccacaacttgttcatctcgatgaaattattcataataaattgagagttaaacgacggatcgtcctccggaagtaattctttggttctctgggataaataatagcgtaaaaacaaacctcttattgggttttgcacaccacgacacatctcaatcatatcctttaagatttccttcttgggcgcttcattgaaagtgagatagctggtcccaactgtgatcatcaagtaaagcctgggtaccacgttaccggtatattgaaccaactcataaagatcagctaagtggtgattttgaggatggttttctatgaggtacgtagatagattagtcaatgagtcgaaaataatgacataaagttcgtagtatttcttcggcgataagtttggatttctcaattcggtcaacattatggaagtatgctgtaatgattccattagtttgtgttgagatagacaccggttcattagtgcggttcgctgcttgataacagcgatcgcattttctggtgagtccgcatacgccattgtgtttttcagcttcttctttctcgtcctcctccttttatcgttatatattaacttcactgggccttgttgagtggtcgcacatacaccaccttctttttttttttctctcttttcttctctttactgaggtggcccttgaataaatacagcactttctcgcatctacctcaactgaaaaaaaaaaaaaaaaataaaaaacgcccctttaagacgaagtgacaaagaggcaatagttcaaaagaaaaaaaaaaaatataaagactgttgatagttgaatttttataaacgttatgttaagtatatgtattgatggaagggataataggataatggtgaatgtcttgtttttttataggtaggcggaaaaagaaaaagagagtcgttgaaatgagattacaacaatctctcttcgaatcttagttcgttttgagaaggcaatccaatcaacaatcttaaaaaattttctaaggcggttctttgcttgtttaagccattcaccgggtgaaatcctggtcttgttaatggagcttttaaccagtaactcaagaaggttaaaactggataaaagttctcgaatttgccagcatcttctttaactgggtccaccttcttataggacactcttgtacaaaactcagtcatgactaaaagatcgatgatcaagggcgtagccagtaaagaatcttcgcaaacattgtgaatggaaatccggttatggccacctaacatcaactcactgtaatactcgtccattgccacttttgagtccccgacgggcttcatatatttgatgacaatgcagtggtcaacttttttacccagtttatcattgtacaagatatcattagacgcgatgatgtcatctatgacagaacttttggaaatctccttagacctaaattgttttggagcagataagttataaccgtcattattgcctaaatggttataggatgcaatggagaccggtttaatacctgcatccactaagaactgggccagaacagacttcaacttggtttgtcccgacttgagatcgtctcccgcaatgaatgtaccctcatgctcagccagctgaaccaagccgggaacaaaagtattctgcggtgaaccattaatataggggacaccttccaagatagatgctgctgcaaagatcgtggaaggagcaatctcttcatggtcattcttaatagactgcaagaggttttccatggtgtcattaacaccaggagatacttctacgtacctctcagtatttgcagtccaaagaacgattactttatcaagggcgttttcttctttgaaattctggatatcgcgtctgatgcgttgcagatgggtccacttacccctcgtggttacgttgcctttttcatccaaattgatgcagttattggctctctcatcttgattagctgcaatgaaatcagggtagtaaatggaaggaagaggcttcaccaaggacatcttcgccttcaagcgttgttgcagatcatattcgagaacttgacttctctgcatagcttcgtatagatctgcgttattgatgtcccaaccagagacgacaaagtcgtttgggctaaccatgggcaacagagagttaaaaggagcataaacgtcattcccctccgcatcgatacccagtttcaaggtagaacattgagtcatggagccgaagtagtttggttgcttaacgccttccttagtttgaaactccacattgtgcttattcgccaataccgaggccactaaagtggagccattgttgccacctaacccaatgagcataattcctagtttttccggctttttcaagtcaagtttgaacacgtagtcttgaacagtgggcgttacatcgaagcggccactagctgtcttcgtaactacagcattttcgtagctgtacttggtgagcagctcgttgtccttgtacgtgcacttgtcggtaactactttaacggaggtgattggagcaatattatcttctgtcattgttacttctttttcactggaaaaaaaagggaatgaaacagaataaatcaaggataaaactaacattaggaacccgacaacagaacaagccaaaaaaaggtgacgaaagctccaatttatatacgtctcaaattaacattgccgccaacgcagaggtgcgctttctctgctccatgtgaattaaataagttcaatattctgggaaagaaggatgaagataaaatagacaatacttttcacatgccgcatttagccgccgaagcgcatacttggcctccgcatatttcacattcaacactttcgattccgcatccaaccccggaacaccggcacgtatttcataaaaaggacgtgaagaacaaaaggaacgaagaaaaaggcaataatttactctatgtgttatttagaactacggtgataaagagctcgttccgatcactaagtacggccggaagagagctgttgtttgttgtccatcaagggcacatcggcaccggcctcatcgtcttcatcatatgctggaggctgtgcttgagattcctctgcagggtgagcttccaggtcacggtctacggcgggcgcagtcgcatgtctgcgtgaaagatcgtacgaacgttcactactcgtttcatatacaacgtagcaagcgtgaatgattgctgggaagaataacagtaggaagagaagtaagttcaatagtgtatccctgttgaacatacccttacgcttccagacggccactgggggaatgaaaaccgccaaaaccattaacaacaagtcgtccttgttgatggaatagctcattcgatggtcatggtcattaatatggtctctgtccatttctaaattatatttggttgtttgctttctgctgggtttttattttttaacctagcccctttcctgcagctggctcattcgtgctgtactctctttcctttatatactagtgagaccttttcccccgttcccaaaaagaaaaaaaaaaaaaaaaaaagaaaacgagccttcatcacgtgcattaaagaaatagtaatcccaacgcactcatccgctatatacatagcgaaaaactatatgcccacttcacaaatacgagtttgcatgtataatatataagatttataaatgttgtagggtgaatgtaaacgttcagtaatataccggtatatctatcaagatacgatcaatgcaacgctttactgcactgcactacaccccttttcctctacttgtttttcttagttcctatttccctctcaaaatgcacctgttcaccagagtattctttctcattgcaagtattaccctactttatcgtcccacacaaagaggaatatatatagattataagcgaattgtagatttcgatggagatctgatttccgtgcaaaatatccaggacgtctatacacagtgtttacaactcagcttatattcatatcatgccatttcaagattattttcagaagaaaaaagcagcgttcattaacagaaacaataaaagtaacgcagatgcttcagcgctacgagatattaacgatattaacataaatttcgccgccaagagcaaaaactacgtgttcccgctaacaaagctccccgatgagctcatgcaagaagtattctctcatttgccgcaaccagaccgcttgcagctttgccttgtgaacaaaaggttgaataagatcgctaccaaactgctttatagaagaatatatttgaacgactcaaatgtagtgaagagtgacttcatgcatctcgcaattaattggaccctactgaacttgccgtcttcgttgaaagaagaggagtcccgcgatatcgccaactgcaaattgaaaaaacttatagaaacactgcaaaataatattcacattactgaagtcatccagtggataaggatcaactgggatttggactctaccttgcaaaggtccattctcagcatcctttgcaatcagggcaagtccttgcaaagactagaaaacgtcactgacccggcttgtaacgatatcatctccaatggtcacttttccaggagcaacgtctcaagtttcgacatggctcctccaaattcattgcctgagatggttgttcccgaaaattacattccgaatctcaccaaatatctttcacagcgtatctcttctcggctttctcatatgactttattcatcgaccctttaaaactgttcaattatctttaccctttagatatcaagttacaaatcatcgatttaaaattgcattggaggagggagttttacaataatgattattttgttaaaaagatacgacccggcaatcctctgactaaactatcggaggtttttgacaagaggacattgaaaattcttaccatcatttcttggaatgacactttgttaaaacgcgagacagaaatgctgaaagattttaaagaatttgagaacctggaagatttgtctttgatttctattaagcaggatgttcatatcctcgtagatctttttagttcgttaaccaatttgaaaagactaaaaatggatttcttagaggagtatgtacctgaacccacaaatcctcacatatttctctccattcttttagcttgctccaaattgcaattcatagatctgagatacgacggtcttatcccacaaatcatcaatattcaagaaaataagttccaactaaatcagcaatgcaactgcacaaactgtcaaatagtattcagtgacattctgaagggcaaaatattcatgttccctgaagactactatattcacgatcttcaagacattgctgcaaaggatatttttaaaatgatgaaatacctatctttgttaccatactctaaagcttgtgatgcttatccgagcgttagaacacaaccaatgaatttgactaattttgtgaccaagatgaaccgcaaccttttggaatatagaaattctaaatcccagttggtgcccaaaatcgttaataacccacatcaacactccaccgtgacttccacatcaaccgctcatatgagcgagcccgaaatgataataatcgatgacgatgatgatgatgatgaaattaatgcggccattcctccaagtagtgatgacacagcagctacaatttccactgacctggaacttcctcatgaatcattgaccaaaagagatattattatgtgttatcacgctcttatccatcacttcaagtcgatttacgttacttttttgaaaagttttcctcatttgagattcttgatgttgaatgacattcccacaatagttatggaggagaataatgaacgtatttttgaacccgtcttttatcattatgattataagagtaatctgtatggatggtcaaaggaatcgaacaagaatctggagaacgacagcaacaacaacaataataattctgataccattgcaagaatagccactgttatgtaatcaactccccttcaaatatatatatttaataatatatattcaacgcattttttaagctagcaggattcagattactggtctacttcatattaaggaaatacaagatccattcggatgctagaaaaaaatcaaccaactattccaatgttggtaagctggtttgataaagtaaacacaagatactacagtatacgatcactcagacatcctaggaaggtctctaaagaagagcggtcaccgagagtactaacgatgggttcgtaagcgtactcctaccgtggaaactgcgaatgttaaggaaccagtctttcatcaccgtgatcataaattatatatattatctgtctcctcaaattacccacatttgataatctcatgagaaaaaataaaggctcagatctgcatgtgttgtataacactggcaagaaaagttcccgtttgcaaacacaaatgattaaaaaaaaatgtcacagaagcaacatcttttcaaaatcattcgcattaagagaacgagataaaatcccttgtcgtcatggtcgaatcggacgaggaaagaagagacaccattatcatcagggccaatcaattcttcttttctgtttaaaaaagtgtcatgaaatttctcttgagattattcaaacttgaatgtatcaaatgggaaggagtgcaatgctgaagtcgaaagaggaggattactctcattcttactacattacagtcactgctgtttgttcttatgtaggggaattcttattaaccgaatgtcgagattattataaccttacagaaggttgtccagtatttatacattttgtttctgcccataaagctctagaaaatgaaaaaaaattttcttttcagcctgagaaagttttttcttagggcagcgtgtggttattgggtgttgcgaaactttttttctcaaacatgaaattaaagaaatgaaaaattttatcgatgagcattgaatagctcaagttatagggtattcggtatcatataggtctgtgatcgagtgagcagtgagcagctaggattcaataaacgggattaacaaaaaattgatatgtccaagctttcgaaagattacgtatcagattcagactctgatgatgaagtgatatcaaacgagttcagcataccagatggtttcaagaaatgtaaacatttaaagaatttccctctcaacggtgataacaaaaaaaaagcgaaacagcaacaggtttggctgatcaaattcccatcaaatgtggacatctccaagttaaaatctctgcctgtagattttgaatcctctacaaccatgacaattgataaacacgattataaaatcatggacgatacagatattgagtcctcgttaacacaggataacctcagtaatatgactttattggttccttcggaaagtaaggaaagtcttaaaattgctagcactgccaaggataatgcaccattacagtttgacaaggtattttctgtcagcgaaaccgctaaaatcccagctattgattacagtaaggtaagagttccacgtaaagatgttccaaaagtagaaggcttgaagttggagcattttgctactggttatgatgccgaagatttccatgtggctgaggaagttaaagaaaataagaaagaaccaaagaagcgttcacatcacgacgatgaagaggagtctagtgaaaagaagaaaaagaagaaggagaagagggagaagagggagaagaaggataaaaaggataagaaaaagaaacatagagattgaatgcgtatgtgcgtataactgtgtgtaacataagataaaaatgtgcatttgtgtgtgtgtcagtgattttttttcgcatttacatatataaaaaggcatttctgctggtggaaactgatgaatgttttgtgtgggcaatattactatttagttttgcatacttaaatttgtgtatacgattagaaatttcaatatttcgggtgtaacacaaacgattatttttttcttgatttagagtcgccatatgaatattattaacctgctttttctgtgttctctcttatatgaggttcaatggtaagtgtgtttttaactcgtgttcttcttcattaatcatctttaatacacttccaaggttgacctgtaaatcttcaaagattagtttatcctggcacgtccgatggatactccgtatagaaatatctaaggatctaataaatttgtattggtccattattggtgtggacggtttcttcggtgactccagcattattttgctttgtatactcaattttacgatatcaattaaccattttttgaccaattttggttcctcttcaacgcatttcgaaatagcccttaaaatacgaacaagcaggatttgattttgggtgaaagagaaaccatcatctttattgtggttcaggaccgttaaatcaggcaatatatgtgacttttcatacaaagattgataaattaaaatcaaatcgttattcctccaatttgcgcctaaaagcttaatgtaatgaattatattttgacgaatattatcttcagatacgttagaagttagacatctccacaaaagacgtcgcagaggaaacggtagatcactgtaatcggacaaccaacgaggctcgtagtcttttcttatttgcacatcgtgcgttctataatacaacaggatggatatcactactctttggtattcgtcaaacaaggctctgtgctcccatactttatcgaatttgttgaacttttttgagagcaaaatttctgttatttgacgcacattagttaacttgcccacatactgcaaaagcagcagcctatcatatagatcctcggacgatgaaccttgtagttccttcgaagaagaacttttgttatccgttgcctgggtaactattgagttcaaatgtgagaaaagcacatcgtaatgaacagctactttttgtttcttggactctacttccggtagatttgaattcagtattctcaggatgttctctatatggtgattttgaagattattttctttagtgcgtgaacgattcaataaggaaccttgttcattaacttcagaagattcaaacaaaggccccaacaacttcactggacctttggtcaagtattttagagttgatttcagctcatcatctttcgacttcaatagtcgggttgctaactgagaaaaagtcctcctcataatcaatgattcctgtagataaaattgacaaaaggcagcgcacgcactatttccctttagccagcacaattacttatgcgtgttgttgtttagggttcgtaaatctatattgaaacgcaatttatattctactgttttcttttcgcacaaacagaaaaccgctgtcacattattgtatgactgttgatatcggaccatcattttcgacactttcattgaggggaaaaatgttggtgtcattacgctctctactcatgtctttatgtaagtatacgtttacaagattatttatatgctatgacactacgggttctcaacttgcagcaaaacaagaagcagttagcggcacatttcggtgcaaaaacttatcagcagtttttgctgcctctctttcactaatctaacttactatgtacggccgatagcagtatattgtgctttttactgtcttttattacttttgctgttgctcttgctcttgactgttcccatctttgcttcggaaatttccccatgcgctgcaggacagaaacacaagcatgattgaagcaatcgaattgtgcagtcgagttcaaaattggcagagaagaaaagaggtggaaattgcaacacgaatcaccgctttaccacgcaaagatatctggattcttgatatcaatctttttcaaatatattttatttatttatcaaaagggcaagaaagaaaaaacgattgataataaaaatggataatcagcaggaaagtatatctgaagatatcaccggtgatctggccgctgctgtgagaaagtcatggtccgagtcacaagataatccattactgttaaattttaataattctcccataggtactcccactgataggtactcccctgaaccagcaacgatgatggaaggaaatgcaatgaatctttcatcacttgcgagagggtcgacacagcagcagcaaaggctttatggatcttctcaaacacgcgaaaaatctgatcaacagcagcaggattatcagctgttcaaacatcattattctttgggacaggagacgagagagtctgtttcagatatccttaacgatttgactctaggatctccggaaccaagcgaaagggcatcaccaataaggcaaccatcggtggatgttccacctttaactacaaggcgtagttctatacaggacgttcagtggataagacatttactgaacccaagaagttcgttttccggcgcatcttccaatgaaccaaccaactctcctggggattttcttaatcagagcagggcttggataacaatactgcacgattcatcggcagaatctttacaggctgtcatcgtattggccgagtcattgaagaatgtcaattctcagtataatctctgggtattgcattccagtgaagtcaacgcctttcaattggcccaggtaggaatcaagacgctgataatagatgaatatatcaatttattcatgaatttcggcactggctcgggatttagcgcaagttcgcaatcgaccgaaaccaagggcgaattgaattttaagtggtgcaagctatttctttttttttcgttaattgatcgattcgaattgatttgctatttatcccctacatgcctggtactgcaaaatattgatgagcttctagagagcactgaagtatctgacgagattgataacgaaacttgtgtattgttatcgaataaggtaaattatataaatgaagatctcgttagcgtgaaccaagaccaatcttccgctgaaaattatgatgacgatcctcaaattattatactgaagccgaacagggcagtagcaatgtgcattaaggaatactttactatttacgggaacgattttgaaggtgaaagtaaaaggtcgatgtttcatcaaatgaacgatttacagattatgaaagcattgtttggcgataaatggagttatatagatagcgttggatactgtgctgttcccatagctagcgtgccagcgaatagattgaattataagataatcgaatttaaaatcctgaaaccttgggaaagacaaaactacattgctgccggtcaacatcgagaatctattatgaacaagtggctagatctttggcgagactttttgaaccaagcaaactaaataagaatagtactgcttttccgcaattcttcaatattcattaaaggcggtccggtaccctcttcatagttaatcccatcatacttataatgtgtttcattaaaatgcagttataataacaaaaaattatatttttttttgctgaaacatgccggtacaccgtatttgtaatcacttccttttgtatactaccacatagtcattatccttctttttaattcctttttttttggtttcctttatcatcactatatctgaaagttcaaggttattttagcacttctacattctcgggtgtggctagaattgggcggaatgaaaaaaaaaaactatgtccatcgctttactaattagtgatcgcaccaagaaaaacgagctgtacattgcaattgtacctcttttttttttcctacttagaatcccaatcgtaattaattcactaaattaacatccttaaaatgaaattcgacaatgacagtgagaagcaggttttcgataagcttaaaaaagcgattcctggtattatcaaggaaaaatgtgcaggatacgatgaattgtatggttacaagttgaatcctgaaggtcttacacaagaggaggttgataaatactatgacgaaaaaatcgccgatcgtctaacctacaaactttgcaaagcctatcaatttgaatatagcaccattgtacagaacctgatcgatattttgaattggaggagggaattcaacccattgagttgtgcctacaaggaagtccataatacagaattgcaaaacgttggtattttgacattcgatgcaaacggcgacgcaaataaaaaggctgtcacttggaacttatacggccaactggtcaaaaaaaaagaattgtttcaaaatgtggataagtttgtacgctacagaatcgggctcatggaaaagggtttgagcttattagatttcaccagctccgacaacaactatatgacccaagtccacgattataaaggcgtctccgtgtggcgaatggattctgacattaaaaactgtagcaagacggtcattggaatctttcaaaaatactatccagaactgttatatgcaaagtattttgttaatgtccccaccgttttcggctgggtttacgatttaatcaaaaagttcgttgacgaaaccaccagaaagaagttcgtggtattaaccgacggcagcaagttgggtcaatacttgaaggattgcccatatgaagggtatggcgggaaagataagaagaacaatctgaccaagcaaaatgtcacaaatgtccatccaacagaatacggcctttacattttacaaaaacaaatcatcgaggacgttgagtgatttgttggcatgatctaataatagtctcttatataaaccctataataatttcttatttttgccttatattcaggtaaatcaccatctaactgtattatctctcacgtatcttcacttatatggctcagaaaacaccgtacgaaacgaaggggctgcgaaaatgtttctagaaggtaatggcaataatagggatacagatcgatcagatccgcctatataaaagacaacgcaccgaaggtgaacaagatcgcagataaaggtatttacaagggaaaaaagtcagcaaaaacaagagataagataacaagaagaagatgttaaggagggaaacttcaacaatatacaggacacacaaaaaaagcaacagtagtatactcaggagccagcgggaccagactagagtggattccttggtagaggagtctcccatgggcgatttcgggatcaataaccagcctacacagcctggcgtgatatactactttgtagagctgactaatttaggcatacaggaaaacacaagcagtaataataacaacaacaataatcatggtgacgatgaaaacggcagtcgatacggccacggcagcagtctgggtggagacgttcactctcgccgttgttcatgaactccagcattataaagcatatctaacaataccattcgggttatactgaatagcccacgcacgggttcggggttgtaacgattatatgcatttcataacatgccactgtcagtggcgccacggaaggatagcgggactttatcaaatcattaatttctgtgcataaagtgtatagtatattcatatagatatgtatatatatcattgaatacagaaatcttcgggtgtatacaacgaacattcatcggacgccttttttactgctattgttcaacaaagtgggtaacccggcattcttgcgccaaagtttccatttttatgccaaatccagaggataaaagcactattctcatcaaaagatggaaaagctgtgaaagagtcaagttcagaagaaagcgttaagaaaaatagagtacacgggagcgttatgtcagccgatcattcgagagatccatgtcctatagtcatactaaatgatttcggtggtgcttttgccatgggtgccattggtggtgttgtttggcatgggattaaaggttttagaaattcgccattaggtgagcgtggttcaggagctatgagcgccattaaagcgcgtgctcccgtactgggtggtaattttggtgtgtggggtggtttattttcgacttttgattgcgctgtgaaggccgttagaaagagagaggacccatggaatgctatcattgcagggtttttcactggtggcgctttagctgtaagaggtggttggaggcatacaaggaacagttcgatcacgtgtgcttgtttgttgggtgtgattgaaggtgtgggactaatgtttcaaagatatgctgcttggcaagccaaacctatggctcctcctttgcccgaagcaccttcctctcaacctctgcaagcttaggcatgtagacattatatgagccattttttcatcgttgttggaagtacccttattcggcatgttttttgttacataaatgacgtatcgcactagcctcctttacgtttttactttatttcagccttttatttcaagattaccaaccatttctctcaaccatgtacatattatatattgaaaaagtaccatacttcatctctgaagagaaaatatcaacaagccaaaagctagtgcagaaactttataatgttactttattaattgtaatgactatacgtataaggaaaattaagaaaaggcaaaattcatatttatttagtatatcattatggcaccaagccgtaataaaatgaaatgggtagttaagaaaagtcagacaaaataacgatttattcttcgacaatgtgaagtttattgaacgcgcttgttggcccttcttgaacagaatgagtaacagcaaaattattggagatgtcgccagatgtattctccttccttttactgatagcaccaatgtcgacgctatcagcaccaccagtggcagagctaggattatagacatagttgtggcctgcattgttactagagtcgttcgcacttccatattcactttgctggccttttgcatcgtcatgtttttctgaaggacccggtaaagacgatcctggaggaaaccactcacctgtaaactcctgctttgttatgaaggggtgtagcatagcttgttgtggtgtccatctttctaacgggttcaaatttagcacaccgcctaaaaagtggatcaaacactccctattctgcatttcttggtcgataagttcttgggagttctgtatgcttttaggatacctgtagtttctaataatatctggtaactttctccacttaaaatattgtttactgggcttttccactatattgtattctctgcaaaactcttcaatagttttcatacgatgcttttgtgtagaagaagaactttcttctggtgccaatttcttcataaattttccagagtttttacccatatctatcatccacgatggaggatatccaagcgtgtctattattcttgttaattggttatattcagaagcgcctgggaagatcggtatacccaaaaataattcagcaacaatacaacctaacgaccacatgtcaatactggttgaatacggtatacccagtataatttcaggagcacgataaaacctggactggatgtatgtataaacggttcttgcctcttcgcaagatgagccaaaatcaataattttcaattccggcttatcaggtgcgcagagcaagatattctctggcttcagatcgcaatgaatcagtttgctttccttcaaaacgcataacgaatccagtatttgagtggtgaatgttctgataagttgtatagagagcccatgaaatttgttttgttttaataattcgtacaaattattgcttagtaattcaaacactaaacataagtggttcttgtggacaaaggagtcatacatccttaaaaaatgatgtttattagtagggtctatcttttgattcagtagctctaaaattttagcctccgttatactttgagtcaaatattctgtcctcgatttaaccacttttacagccaatatctctttcgtcagcaaattttgacatttgaccacttgaccaaatgtaccttgacccaaaatgtctagcacaaggtactttctgttctgctctacacccaaaacgtcatttacataaagaatatagtcactgtttatgttgtcgaatccgttgttacatttcccttcactgggcttcgtaagtactctcttggggtttttggacgtttggtaggtaaattctggagaacataaagaatatgtggtaatcaggcttttcgtgacactgactaggggagatatcgtcttggaattgagcgacgcacgtctaaactttggagtagcatttaagacaggttgaagatcgtttttagagttgcaaagttgcatctgaggaatggacaatttctgaccttgtacttcatctcttcgtaactgcttgaaagggggttgtagtgggggacttgtactaggaggatatgcgctaagcctcctgtaaggtgacatgactggtatggagtttgttccttgattagtatttgaatttagggaagaaaaattggacgaataattagttgcagccagactctgccttctttggaaatcttgacgatcataaagggagggaacaaatctggatccaaattgggaaggatggatagcgccctgctggtatacttgctgttgttgttgttgatagccagaaggatactggccactgctatttcctgccaaactcgtattagagctggtgtaagcgggataactatcgtactggaaaggatttggggcaggtgccctggctggaggtacaacgagactagatttacgtcgtctgtacgcatctagactttcgttactgtttaagtcatcgtattgagggggatacaccaggttttgttgagaattagttactttttcctcattccaagggttaacaaagcaaaattgagaattctgttgttgttgttgttgctgctgctgctgctgctggtgatgattctgatgctgctgctgtggagacctttgagagccttgatttacgtacgatggattccatatacctctccccatatggctattgtctgggcttgctctacccgagcccatactagcatcactgtgggtcacaagggtcgggctcaaggagttattcatgttgctattggagctggacgagtcgttattattggatgagttcatgattgctcaaattagcatgtgaaaaaaagataacgaaattatgttcccttgcacaatggctgttgctcttcaccaaaattcttctttcgatatattcccaaatctaatagtgagaaatttgtgtaatacccccagtaatggcccaccaattgtttccttatatctgtttagcattgcgactcattcattgttcagcccagaaggggtaaatctgaggagggggcattgcttgcaatggttcagaaggggcggttagggttaataaagccatcgcgctattttgatatttttattaggccttttatattttttttagtttttttctccaaatcctaaatcctttttaggtgtcatttacgtgcaacgcgacaatagtgatattgtcattcttcaaactttttgcaaggtagctattaaacatacctacacacatacgtacatgcttaacggtgagacaaaagtaaagaaagagacttgaatgggttgctgcatcttaataagttgagtttgagggcgaaagtacacaaatattcatccgtattgaaaatatatatataagaatatagaaaaatgaatgtttctacatcaacctttcaaacaagacggagaagattgaagaaagtggaggaagaagaaaatgcagctactctacaactgggccaggaattccagctgaaacagataaatcatcagggtgaagaggaggaattgattgccttgaacctaagtgaagccaggttagtaatcaaagaagctcttgtagaacgtaggagagcatttaaaagatcgcaaaaaaaacacaagaagaagcatttgaagcacgaaaacgccaatgatgaaactacggcagtagaggatgaagatgatgatctggatgaagatgacgtcaacgctgatgatgatgattttatgcattctgaaactagggagaaggagttggagtctatcgacgttctgttagaacagacaacgggaggaaataataaagatttgaaaaataccatgcagtatttaacaaatttctcccgatttagagaccaagaaaccgtcggggcagttatacagcttctgaaaagcactgggttacatccttttgaagtggcgcaactaggttctttggcctgtgacacagctgatgaagcaaagactttaattccaagcttaaacaataaaatatcagacgatgagttggaaaggatactaaaggaattgtcaaacctagaaacactctattaataactgtatgtatacgtgtgtgtaactagtaatgaattttcaccctgtggaagttaggcctatttaacaggaaaaaggacaggattttaaatctcgtcttgctcttcttttaagaaatatttgccgctaccgtttttccaccatctcatcaaacaactatgtggggttatatctatgacactttcatcatcgcttttgcatctacacctctgatcgagcctaacagcgtaagatgctggacaggtgccaaacggtgagtgaaaatagccaagttcgtcaaaatgaatgatttcgtcaggtctcagcagtagggagacaccaattgaatgtacaggtgcgtcaccccacctttcgtagtaaaatccgcccttggcatctaaagtttcaaaaaaatgcttatattcgtcacttctgaagaaattcaagtcgccaatctcaaaattcgaccaaaaatggcacaaattgtagtcagagtttgcttcaacaacgggataatgcttaccaactagccctgaatcggtcaaaaatgcataggcactgtcctctttacgtaaaatggtctcttcgctggccactaaatactcctctaccgcgtcccataaggttggtatggtttcttcatattcatataatgatatgacaaatccgtattttttgcccttcaatctcataactctgaacgggtcatatgggaaatcgcaataatacttgacattgggttccaccctaaagtagtaatcatagttgtccagtattgactgccggaaaaaaaaaccagaattaaaccgacacatatttctatatgacttggatcccccatataaaacaccctcatcctccatgactcgaagtctttcttcaaaaagtgtatcgttaatccattgcggccgattccaatcttctggtggtattaaagcatattgggtcttcccactcgccattgatgttgtagcttcaatgaagtcttgatcgaaaggaacgtcatttagaaaagtccaatcataatgatacttgttgttaaatctgtcctctaatgatctcattgaatccaatgccccttctaattctgaatttctcaccagcattaaaattgttgcattttctcgtaggtgaaaagaatcagaatcattctgtctggtataatttaaagtgtagtcgtcgtagctattgcgggaaagttttactttaggaaaatagtttcttcttcgacttgtatcatattgttcttttactctttgggaaagagcagtatacgtactgtcaatcttttggtattttcgtatgaggaataactctttgccaaaaatatagatcataaaggtccatattggtaagaatatgccaacgatgtatagcgagcctccttttgccattttaacaatttctgatgataaacttctttaattttgatagcgacttccaagcattagatttggagatgatatgaataagcagtgacagattatttctgcagatgaaaaataaagaggcgtagtactttgtctttaactttcctttattaaaaaaatgtatagaaaatttccaaagcgaccagtaaaacagctagttactcttcacacacaaagaaaagaagaaaatgaaggggaaagtggttatgtggcaggtatagcgaataaagaatttaattaaagaatacatttaaagcaaattttcaacacaaaatattgaaggaataatcagaaaattatttaattattgtacatattatatattcaaatatttattatgaaatatccctaacaaaaagacaataaaaggataatcaataataaaaacaaatatgggcaaaataatatcatatagggggtcaagataagataaaggtaatatagttatggatttcttctccttagagattagttcaacaaggtagcaatgtcggatggcaattcttcaatttgagtggagtagaacttttctagttctctcatagcgccaacgtcttcgttagtaacaaagttgatggcaacaccctttctaccgaaacgaccacctctaccgattctgtgaatatagttttctttgttagctggtaagtcgtagttaataaccaaagaaacttgttggacatcgatacctctagccaacaaatcagtggagatcaaaattctggaagaaccacttctgaattccttcatgatggtgtctctttcttgttgtggtaaatcagaatagatggcagaaacggtaaatttgtcgtttcttaacttagtggtcaattcttcgacctttcttctggtgttacagaagatgacagcttgagtaacggagatagagtcgtataaatcggtcaaacactcgtatttgtattcttcttcttcaacattaacgtagaattgtttgataccttccaaagtcaattcatccttcttaaccaaaattctaactgggtttctcataaatttggtggtaacttccaagacgtcatttggcatggtggcggacaatagaacaacttgagtggttggtggaagtaaggtgaaaatttggtagatttgttccttgaaaccagaagacaacatttcatcagcttcatctaagatgaacatcttgatcttgtcagttctgaatctacgtctttggatgttgtcaaaaacacgacctggagtaccaacgacgatttgagcatctctcaaaccttcagcgtcttcaacaaaggaagtaccaccgatacaagcgtggaccttgatgtccatgtggaaagccaaagccatgacaaccttttggatttgcaaagccaattctctagttggagccaacatcaaagcttgaggagccttgacagaggtgtcaattctttgcaaagcagcaatggagaaagtaccggtcttaccagtaccagattgagcttgagccaagacatcgtgaccttcaataataggcatgatggcacgttgttgaatggcagatggttcttcgaaaccgtaaccgaaaacacctcttaacaagttttcgtccaattccatatcatcgaacttgtagacgaccttgtcatagttggtttgaatttgggattcttcaatatcagtaataccttcagacatattgcaattactatttattagtttcttgtacacaccagtcctttgtttagcgaacctttttttttcctactatgtgtattgggatctgctgtttccttctccttgagatgagatttcttttatatatgatgctgaaaaaaaaataaaaaaatttcgaaaaaaagaaaaaggtacgcaaaatcaacgctttcacccggccttttgtattcgtctgatgtgacgactgtacagctaatgtatactatgtagtagtttagttgaatgattgatagctaagaggtagagggatggcatcaggtatcaggctttgggaatgctctttggacgcggtctaaataatccgtagactcccaatcaaatttaaaagcagattgcggcttagatgtcggtttctcaatatcatgtttctctgcagtactcttctgcgaagcatttcgatctactgaggttatatccaggtcaacgtgcttttgattttctcttttaccatgattcaacaggtcttgaagacaaggaggttcgtggtaaaaatttgtctctgtttcaatattgcccaattgcaagtgtgtgaagtagttacttaagtggcattcactataaagttcacgctgtgtacttctccacagctggtaatagtggtcgtcatagtcagttgtattacgggaccatggcttaaacgttccaatgaagtgaataagtctgatgtgttgttggaaaaaattcatggctggtgaagactggtatccgtagttgggcatggttacgttgtaggtgaaggggaggcgtatccattccatgagtggagacaccttatgcaaaacctctttgctgtagttgcaaataggattaaaaaattgattgaagattccttgatcagcaccatcaatcgatacagttttaatcaaaaaatcttgtaaacttgttgccatatctaaatcaggaattagtagtagtacaccggtgttgaacatgtcaggccatccgatgtctggaaccgcagcaatctggaatcttgtttgttcagggtataatcgtaggatttcaaaaaattctttatttaatggtaaagtatcagcatctaaaaataaaacctgatcgaactgcaccagttcccacagtctagccttgagtaaagtatgagatagctcaggccttttcaacagttcaagatttgccttattcttctctatgctcttctcttgatcctttagcggttcaataatgataatctctttaaaaagacttctaattaaagctatttcctgaggtttaaactcatctccaaacaattttttttcaattagcaggcataaggttatctcatcttccactacagcgtgtttcaagagtttttgtaattggtacgctaaagtcaatgcgccaggtaaatagtcccgtgaatacagcaatgtacagatggcaactttcttggccatagctccgtaacaaaccttacttctgatagatattcaaaaaaatgacacgatgtataagtaaaaaaatgcttttggaggtggatgcgctatccttgatctactcccctcatctttatatgtcatagtaagtgtaaacaaaacccttaacggctaccgcgcggtgacgaatcaatgcgattttgttttcgaacagtgctatttcaaggataacgaaaaatctacctagattggcacatcagtgccttattttccgtctttgcctcttgatatatgttctttttttattgttcttttgttattgtagttgttgcatgtacgtaagttatatatagattaaatattgataatataatagaaaataaatgatagggaaacgttgaataaacgacttcccctcttctttttattcaatatttatctttttaacgggagtaagaccaaacgttcttcaacaaaccatcgttttgagccaaacggttcaaagagtcatcggattcacctctggatctaacgtaaccggacaaagcgtaagtgatgtattcacctggaatggcgcggccttcttcatcaaccttggcaacgttgatttgaacagaagcgtggtcatcggctttgatgattctgttggtagcagaacactttcttggaacatataattcaacctagtaaaaaaagaaattattcaatgttagtacatttgcgcttatattcttgtaaaattattctgcacatgaatgaaagaaaagttctaagagtagttctggaatatggaaacccactaattcggaattatgatgtcttttcagcatatctctcttgggattccaattttgtcgttaaaacgccacatttcttagagatgtgtacttagaccacacatgataaagtatcaggtaacacttgtgccaatttaaatgggttatttgcattttcttgaatttgatgtattactaaccaatatgattataaacccatgttggtcccaccctatttgtaccactaatcttgcacacttaacttattataattttatttttctgtcgatgctcccttgtctgtccacgcttactcagtcctcttctttcttcctttgcgcgccatcatctgctataatttacgtactaattgacccttatcgttttccattttggcttattgatattcttttatttttttatcagatttttaactgaaattcccctttaaagtcaaattcgttaacaatgtttataaaactttcaatcctataatcctcaattactagttcttacattatacagagccgagattcgcttcaaacggacccactagccagctggtatggttcccaccaccgatgaagagaaccagaataaaggcagtggtctcactagcgaactcgctcgaagcgtgcccaccagctcccggcgagagacgcggcgaaacataaagcatttatttcattccttaaaagttatggagatgtatggatgtataaagtgtacgggtgtaaacacattgtcgtcaaaaggtaatctccccagaagttttcactcctatatagaaacacggatacaacctcgatagtgctttctttgtcccattttattatgctacttgttgcattatttttggtttttcaagcctacgttttggactctcagtccctgatgcggataagtattttacataatttacgttactatggcaacagtacatatgtagaaaagtgaaagagaaaaaaaaagaagagagaacttaagtagatgtatgttcaaccagctattgttggaaccaaatatgtgcaaaatatcgccagatattcatttcacgaataacaaggcaaaaatgttgcaaaaaatgtttcttagtaccaaattgaactactgcctttatcatgtgactgaactacgcttggctgttttgtttttccctcaccttgcgctaaagttgtcgtcacattataagggcagtaagaaaaagcagagtttaagaaagtttgtttacatacaaccatcacgtagaggaaattcttcaaacctaccagaccagcggacacaagccatttgtatagataaaaaatggtagatggactgaatacctcgaacattaggaaaagagccaggactctctctaaccccaatgactttcaagagcctaattacttgctggatcccggtaatcatccctcagatcattttcgaactcgaatgtccaaatttcggtttaatattagagagaagctgttagtgtttaccaacaatcaatcattcacattaagccgctggcaaaagaagtaccgttctgcgtttaatgatctctactttacttatacttccttaatgggatcgcataccttctatgttctgtgtttacctatgcccgtgtggtttggatattttgaaacaacaaaagatatggtttatatcttgggatattctatctacttgagtggtttttttaaagattactggtgcttgcccaggcctagagcacctccattacatcgaattacgttaagtgaatatacaacgaaggaatatggtgctccaagctcccatacagcaaatgcaacaggagtgagtctcttgtttctctacaacatctggaggatgcaagaatcttctgtcatggtccaactattgttgtcatgtgtggttttattttattatatgactttggttttcggtagaatatactgtgggatgcatggcatattagatttagtaagcggtgggctcattggaatagtgtgtttcattgttaggatgtatttcaagtacaggtttccgggtttacgcattgaggagcattggtggtttcctttgtttagtgtgggatggggtcttcttcttttgtttaaacatgttaagcccgtagacgaatgtccttgcttccaagatagtgttgcgttcatgggcgttgtgtcaggtattgaatgctgtgattggttgggcaaagtgtttggagtcaccctggtgtacaatttggaacctaactgtggctggcggttaaccttagccaggctgctggtgggcctaccgtgcgttgttatctggaagtacgtgatcagcaaaccgatgatctacacgttattgatcaaagttttccatctgaaggatgacagaaacgttgcggcaagaaaaagactggaggccacgcacaaagaaggtgcaagcaagtacgaatgtccattatatattggagagcccaagattgacattctaggtagatttattatctatgctggcgttccattcaccgttgtaatgtgcagccccgtcctattttccctcttaaatatagcataaaacaaaaggaacaaaaaaaaaaaaatagacaaaatgtagtgtaaatgtatccgtttctaaattaagtacttataaaaaaatatgtaactgaaaaagtcatgttgtataaaaatttgaggcaccgtaccaggaccccaaaagaagaataggttaaagtcatcatcattaataaaccaggaaagaaaagagcataattaagatacgcctacaactttggcgcgtgagccaagtgtcttctggtagctagtgaggcactcaagggaccatatgtcttggcattttctctatattccttaaaagagttgaacgagttgcccggagatctcttgaaaatagtgctggccatggcgctagcggctatccttgagacacccgcggaggcggctgaagaagagacggcggcggctaatctggtactttgggcgatcatttaatacgtttatttactgtcttatgaatgtaatatttaaacttgtgcgtaatcattaaaacaaaggtgaaaaatcacattaaacatctccctacattactttcggtttattcttttatatgtgtgaaactttctctctgcaccaggaagtggtcatgcttgatgctcggctcccaccggaaaaactaacttgcgggcgggaaattgatccctgaagtcatgcccctcaccttcattcgtggatcttatctccagagcaaccaaatgtggaaatggcatgacacccccccacacacgttccgcccactttttttcaaatgtgtgacacacccataccccataatgttgcacgtgacaggtttgtatcacgtgcttcttagggttttgttttaggtctgagacattttagggttttttttcatcaagtctagatcgtttgtaacgaacgattgctccttttttcttttttttttgctttttttttatactcaccgtttactgtcattatgtctctcgagaaactgggcgtgtgtgctaaccaagactggatcacctttacatagcacttattgcatttcttggtgtttcgtaccctacaattgacaaaagtaattttgtcgttcatttcttcatcgattctttcctctttcaacaacttccttattttatcttgggatcgtaacttcacttaattaatcacgattcccatattcgttaacacctcttaaggtttgctgtaaatatatttatgttataaaaaaagaagatattatggtagaaaactcgtcgagtaataattcaacaaggccaattccagcaatacctatggatctacccgattatgaggcgctccccacccacgcgccattgtaccatcaacttatagcgggtgcatttgctggtataatggaacattcagtgatgttcccgatagatgcccttaagacgcgaatacaatcagccaacgcgaaatcgctgtctgccaagaatatgctttcgcaaatatctcacatctctacttccgaaggaactctagccctatggaagggtgttcagtctgtcatactaggtgcgggacctgcgcatgcagtgtattttggtacgtatgagttctgcaaaaaaaatcttatcgattcgagtgatacgcaaacgcaccatccttttaagacagctatcagtggtgcctgtgccaccacggcatctgacgcattaatgaacccattcgacacaataaaacagagaatccaactcaatacctcggcatcagtatggcaaaccacaaagcagatttaccaatctgaaggtttggcagcattttattattcttacccaaccaccctagtaatgaacatcccatttgcagcatttaatttcgtcatatatgaatcatccacaaaatttttaaacccatcaaatgagtacaaccccctcatacattgtctgtgtggcagtatcagcggatcgacatgtgcggcgatcacaacacctttagactgcataaagacagtactgcagataaggggcagtcaaacagtttcgttggaaattatgagaaaggcggatacttttagtaaagcagccagtgccatatatcaagtttatggctggaaagggttttggagaggttggaaaccaaggatagtggcaaacatgccggctactgctatatcatggacagcttatgaatgtgcaaaacatttcctaatgacgtattagttggttcttacatgtcatattattttccattcattttgcatctcagaagattatgtgtatattatcattttcctgttgtgactttatgtacatttatatatacaaatttaatttgataatcccaaagcttgagctctttccctcaacgaaaagttttcattttttcttcattactttatatatctatgtttagtatacccaaagggtatttcggacgcaggcaagctgccattatttatagcggaaactctaagagtggtaaatctatttctaaaaaaaaaaaagattcattcaagcgccctccttggttagttagttagaaacatgtattcagagggaattaaataaagatgagtataattagttcttggttacttgtctctattatttgcttaactacttctattgtaacaaaattgcaagctgctggagttactacccatctattttatttaacaagaggtgctcccttaagtttaaaggaaaactattatccttggttgaaagctggttctttctttccggatgctttgtactcatgtgcaccttcaaataaggattggtctgattttgcagaattcactcattggcccaatttcttaatgattgcagtatcttattggcagcaaaagtatggtcagaacgatcgacttcggggaactcacggctcactcgcactaaagtcatttttaataggggtattcactcatcagatagttgatgtttcctggcattcgttagttaccgattatagaatgcacggactactccgagttctcagcgaaacagaatttgatggagatattgaaactgctcatacgtttttagacgttatgggtgaattcctcaccttaaataatgtaatccgtgacagtaataataacgaaaattgggattttttaactcgctctgattggaaattgcccagagaagaggatttaatggaaattataaggaacgctggactttcaaaggaaaagttgtcctacgcagaactggaattttgcgttaaaagaggaatggcagcggctattagtgaagggtacctattccgctctcaaagaaaccaattgttaactaatatttactcaacatcccccagggctaatgatctaatactgaatcattggctaggagggcagtccaatttggttgcaatgctccaaagatgcgtgcctttcttcgagactttgtttcatgacgagaatactaatgaagctcaagcagaagaactgagattatgtgctaatttaccgccagtatcacaaaaacggataaatgcacgacctttggtctcttcattaaaagcacgtaagggaaatagccacattgtcgtatctcccatgaaatcattttccgattttggcacaagcctgactatgggaaaatttcgagaagacaacaaggattatctcgctgtaagtgcaccacttgaagacacagttggtgcaatctatatagttccatgggatattctaactgtagcaagaaaagaggattttagcattttacaacccatcactgccatgtacggttcaaaggtcgggacatacaaggcaagtgatgttgactacctactcgtttcacagcctggtacctgtacaatcgacttttacttcaaaggagtaaaaatactgacaatcaaggatgagaccaccgaagaagcacatcagttacaatttgctgtaacaggtaatttttatgatgataagattcctgatttggtggtgtcaagcccaagttatggtgccaacgaaactggaattgcaacatttatcccaggatcttccataataagctatttgaccaattcagacaaatatcaagtagttgatatctcaacttttaagggcgttattaaccttgacgggtaccctatgaaaataccatttcagcatttcggggcaacaattcagatatctgacacgactgacaaacaaaagttaatatatattacatgtcaaagtcttggtactgtttttgtttattcgagtaatgatttacacgatttgtccatcccaatatattatataacgaaaaatggcgtcattccagcaaaggacagtgaccacgttgagtggcatataattccctcaaaagaacatggtatgttcggtgcagccatatattcttggaattttgaaggtatgagttttgtagccgtatctcaaccaatgtttgacactgtgtttatatatattgagaagtctgggcaaatagagtttttcttaaaactggttctaaagattaagacaaaatcagattcaatcccggatgagtttggttcatctttgctgtttaatgacgaagaaaagaaattgtacgtttcctccccaggcagtttcgatgcaagaggaagtatatggaaaattagtatggatgagctattaaaggcgggaaacgatccgaagcgcaaaacccttttgattaataatttaaggcatctcatgctcataaatcctgacaaaagtagcaagggtgtgtcaaattttggtaatagcatgattttgggtccccaaaatcaccttatagtaggcattccccaatatgggtatggaaattttgatcacatgcagctaaccggtagaatcctggtactttaatgataagttattatgtacaagcatcggtttagttcaattacattaatttaatacttgaaaagcatatttggcaatatgcgctatatatattctgatgtcatttgcttctatttacatttcattcattttttttctctgaatccttttttgcaatttttcttgcctctccttctttctcaattcctttaacgccctcttatcgttgttttgtggtttaacgtcctttggtataagtttcattatcattttcgagttcatgttacctagcagaacaggatcattagcatattcgctaactatctctttcaatgtctccaagacagcagctcttttctggaaaactgattctggtagcctgggtggttcacctttttgagagcggtccagctcctcaaaattttcaagccaattgtttgaatttatgttattcttgtcatcaagatataacgttactttattcccttttttcaatagcgaaactatttcgtgagccttctgcctttttaaatcatcgctttcaatctgccatgatattttaatatgcttcaagttatcttcttttttatcagtcaccaaattcttgtaagacttattcagtactcccaattccatcagttccttttccttttttttagccagaaagtctgaatatttttttaaggctacacgactttcgactatcttaacaagtggaatttgattttcattatcgatttgctctacattaacaatactgagtccaactttatcgagatcaatgcccttggcaaaataccgaatattggatgcttcaattcggtgggtagtgggatccacaactttgatgtttcccttgtgattttttttgaatatctcactaacaactgaattagctgcctctttagctcgatctgtcccggtgctccaagtaatcaggatttttttcctgttagtagcattccttggcacttgtttcgggcgcttaatatactctttaggaaaagcagcatttcttgccacatttccatgactttgctctttaagatttgccagctcacgtttacgtttcattgcgttgcgaaatatatctgtggtagatgatgcattgtctctgctgaagtattttgtgcaatgaaaatatctaaaactttttaaaaacagcatcttctgtgaaagaacatcactcaaaggaacttttaacatatccacggacctgatgttacctccttactgtgtatgcatcaggtatgcattttgtgatatatagctgttatagttttctgaacttacttttttagacccttaaagttcttaccgtcgcgggaaaattcaggtaaaattcaagagctcaggatgaaaactagacaaaaggaacgagattaccttcaactcctatgccttaaacattttttgtttcctcaagaaaatttgtttacaaaatcattccatcttttgttttaaataaaaactcgactttgggaaatcatattattgagtgtaatatacaaataaaaatattggttaaaaaagtttaataatagattataaatttaaaatacggataggtctcttatcattcacatatcaacacccatgaccatggccaacaaagccattctgacgaacaaaccatacttcatttgtctgaagtaagcagcacgatgatcgtagtccacttcctctttgatttcatttacacgaggcaatggatgcatgatagccatattttctttggcgtgtgccaagatcttgttgtccacgatataagtatccttcagacgtgcatattcttcagggctattgaatctttcttcttggacccttgtacaatacagaacatcggtctttgagatgatatgaggggttaattcaatgctctcaacaccaagtaagccagcttttcttagctcttctcttaatccttctggtaacctcaattccggaggagaaacaagattaattctgacttgatagtgcattaacaaacgacacaatgaatgtacggttctaccatgtttgagatcacccatgaaagtaacagtaataccattaacagtaccgatttcttcacgaatcgtaaacaaatccaagaaggcctgcgtaggatgctcgcgagaaccattaccaccattaataattggaacaggagaatatttagcggcgatatgaacagacatttcttctgaatgacgcatgacaatggcatcactgtaacaagccaaagttctgatagtatcttgaagggtttcacctttcttgacagaagacaccaatggattaacatttacaattctaccacccaaacgttccatagcagcaatgaatgaagaacaagtacgagtagatggttcaaagaaaattgtagtaataacgtggcctttcattaaatctaagacaccttctcttgcgacagctgcccttagttcttgtgcaacagcaaacaacacatggaaatcagaacgtttgaattgtttgatagacaatatatgtcttccgcggaatggattgttactacggatcaaattctggatggcgcctggagcaacaagttctcttggtggccttgaagacatcaatttttgttccaaaggctgttctggaattgcatcctccgcggcatctaaattatcagcgattgcttcttccgtgatcgagaaccttcttttagcactagtagattggagctctgcggaagcagttatggaagctggacttggattaacaatgcattttcctttggcgcctggtgaaactaattcaccgctcaaaactaatgtttcgccattatagacaacacgctcaataccaccgttcatatctttgttgaatggtgaccatctcttattacgtctgaaagaataatccaaatcaatttcgacaactgagtcctgagtagggatgttgaaaattttagcgggattgtcatgcagacgaaggacgatatcatcaatggttaatttaccttcttcaacagcagccaacaatagtggtaatgaatctttgatacccataccaacatcaaccttgttacctgtgacatttgccaaggcgacaggaagagcaccgacagagaaagcatcgatactatcaaggttgttccagaaaaactcttgatcttccttagtaggcaagaaaactgcctccggatagtcatcttgggcaataaacaaagaataaatattgacatcacaagtcactctagggtcttttgccttgaccgtcatgatcaaagctaaatcttccttattcgaaacaccagtaatgtgaatagatctgttttgaagggaggttaacaataaaaccgatgccaaatctgcagttttagcttctgcaatcacttgcttttcagttggccactgattcagaagttcagctactgctgtgatcttgttctttaattcacgtaggggcaaaaacaatgctgtcactttgctagcagattgcgtaacactatgagcattgtgtgctgtaccagcaatagtgaaagaaaagtcagtgtaagatgaatcttgggaaacagagtttgcggccttcaaggatgcaacgtcagtaataacaggtccgctgatggatctgggcatcaattgacagtatgtaaaaccggattccaaaaatagacgtgtggtctccttcagttcagctgggcctttgataacatgggatgcattcggaacataagttgcgatattgattaaaccaggtaaggtaatagttctgtgggaagtttgtgcatcacgttcagaaacatctaaagtgatatttcttgaaatggcttcaatcaacaattttgcacatttaacgttagtaaccaacggaaccgaataatcgacagccaaacgacgtgttttatacccctttgaaacataggatgcaggacgacggaacctgttggcagaaggcaagttgatgtaaaggtcaatttcattattagccaaatgttgagtaagtgagtattctgatttttgatcatcatcatccttgtttaaaacctccagatattggacggcaataccatgttcagataaaaagtcagcagtacctgatgttgcaaataatttatatcccatgttgtatagtttttgtacggaagaaagcaattcttgtttttccttgtaagaaccaatagacaataaaatattcttctttggaagtttgaagccggttgccaacaaagactttaagtatgcttcatacttcgagtggccaaaagtagcgacttcaccagtagaggccatttcaacacctaagactggatcagctcctgctaaacgtgggaaagagaattgtggtactttaacggcgacataatcatctggtaatttttcaacaggataaggcgtcaaaggcaaacccattatggcctttgttgccaattcaatcagattgacgccaacaacctttgaaatgaatgggaaagatctcgaagcacgaacattacattctatgaccttgatttcattgtcctttgcaatgaattggatgttgtatggacctgtaattttcaaagccttaccaattttagcagtggcgacaacaattctatccacagtttcaggagccaaatcttgaggtggaacgattaatgttgcatcacccgagtggacacctgcattttcaacatgctcagagacaacatgcataaccaattcaccatttcttgcaactgcatccatttcaatctcctttgcgttttcaatatatttagtgataacaacaggataatcacgtgaaacttcgacggcttggtttaagtaggattccaaatcgtttttagaataaacagtattcatggcggcaccggataacacataagatggacgtaccaaaactggataacccaccttttcggcaaaagattcagcttcgtccatggatgtcaattctttccaagctggttggtcaacaccaatttgatccaacatacgagagaacttgtaacggttttcagcagaatcaatcatgtcaggggatgtaccaagaatctttacattttcacgatgtaaagtcatggcgatgttgttggaagtttgaccacccattgatacgacaacaccgcttgagttttcaatctcgtaaatatccaaaactctttcaaggttgatggtttcaaagtatagtctatcagcctcatcataatctgtggaaacagtttctggattatagttgaccatgatagttttgatattgttggcacgtaatgttctaactgcagtaacagcacaccaatcaaattcgacagaagaaccgatacggtaaacaccagaacccaagaccataacaccgtggtcatcaaaggataaatcgtgtgagtcagcattgtatgtcatgtataaatagttcgtgtaagcggggaattcagcggcaactgtatcaatttgtttgacaaatggtgtaattccatattcttttcttaatctacggatggcaacttcgttggaatccaaaaatcttgcaatctgtctgtcatcaaaacctaactgcttagcctgtcttaaaactaaggaaggtaattcctctttagtaccaaatgaactaattttctcagcaaattggaccaaatcgtgcagtttgtttaaaaaccacttatcaattctagtcatttcccagactttatcaacagaatatcccttcttagcaaaagcatttgcaatggcgaagacacgcatatccgtagggttgttcaactcgtaatcaatgtcgatatctagatctgtctcattgaatccgaggttagcatattctgtggatctgatagctttttgaatagcttcttcgaaggttctaccgatgctcataacttcaccaacagatttcattgatgaagataattcggtagaaactctggtgaacttcttcaaatcccatcttggcattttgacaacacagtagtctagagaaggttcaaaacaagcacatgtggattttgtgacggaattcttaacttcatttaatgggatattcaaacctaacttagccgcagtgtaggccaatgggtaaccagtagccttagaagctaaagcagaggaacgtgacaaacgcgcattaacttcaatgatgcaataatccttagaaacgggatttaaagcatattggatattacattcaccaacaacacctaagtgtctaataacattaacagcagtagttcttaacatattgtaatcttcatcagataaagtttgagatggggctacaacgatggaatcaccggtgtgaatacctagtggatcaaaattttccatattacaaacagtaatacagttgtcaaaagcatcacgaacaacttcatattcgacttctttccaacctttcatagatttctcgactaaaacttgaggtgaggatgaaaatgcaacattacatagatcaaccaattctttttcattattagcgaaaccggaacctaaacctcccaatgcatatgcagcacgtacaataactgggaaaccgatctccttgacagcggccaatgcctcgtccactgaattagcagcttgagatttcgcacatttttcattaatttcgtcaatggcattactgaagagttcacggtcttccgtggtaataatagtatcgattggagtacccaatactttaactcctaacgcctcaaattcatctttcatggctataccaacagataaagcagtttgtccaccaaatgtcacataaatggcgtccggcctttcatgtaaaataacttttctcacgaactctgcagtaacaggaacaaaataaaccttatcagccaaccctttcgaagtttggatggtagcaatgtttggattaattaaaattgtatagataccttcttctttcaaagctttgatggcttgagaaccagagtagtcaaattcaccagcttgaccgatggacaaaccaccagaaccgagaactagaaccttcttcgcttcgattctagggtgtgccttaacgttatcctctaataggccacctgggaaagcgattggtttcaacacttgtgtatacttgaattctttaactgcttggataaaaacgtcaaacaagaattctgtatctcttgggccaggtgtggattctggatggaattggacggaaaaataaggtaattcagaatgatagataccttcgttagagtcatcattcgcgttaacaaacaatggcttccatccggaagttagagtgtcaacatccacagcgaacccatggttttgagatgttatgtaacaacgaccacttatagttgatgtacaaggtatgttatgaccacggttaccaaattttagttttagggtggatgcaccggcagctcttgctatcaattgatgaccgagacaaataccgaatactggcgtctttttagcctccaggacatttgacaatctttgagatagatcatctagaacagatggatcacctggaccatttgaaataaacagaccatcataatcttctttagtgaaatcgtagttccatggaacaactttcaattctacaccccttttgataaaacaacgaatttgattgtatttcatacccacgtcaatggctagaatccttaaaactttaccatcgggtccggtttgcaattcgatgtgcttattgtctgctggaggaacgtacaatttaggttcattgatggagaccttagaaactaggttttgaacatttggatccacccattcaggaacatcaaacgcacttctccaagaggaagatctggagatggttctgtcagagccgcttttttccaaagacaacctacccaacattgaacctgcatctctcaaatgcttggtcaatgatcttgtatcaacaccataaacagctgggatcccttcattttgtaaccatttacctaaggaagatttacgaagataatgagagtactcgtcggtatagtgagaaataactaaaccggcaatatggattctattactttcaaaatatcttggcaattcttcgaccaattcatctctcaagtgcatatctgggacaccataattgcctaccaatgggtaagtgatgactaagatctggccttcataagatggatcggtcacagattcaggataaccaaccataccagtttggaaaactaattcaccagcgacggatttctcagcaccaaatgaataaccttgtaagaccgtgccgtccttaagttccaacgtaaccagacggtcacccgtagattccattggaggggtgattggagcagtgggagcaatagtggccatattatgattgttatattctattaggtaaggtttatgtgttgtatgctgcaattagttatggatttctatcgtcgttaatattaatgttagtaattgttgatcgttcaagccagatgccgatataaaatcagaactaattgaagagattgatttgctttcgtgccatgaagatctctatcaattgcgattcttttcttttttttttctttcttttttttctttcctattccaggtaatgaaaaacgacatcatcgcagagtcaaacggcttctattttccacgcccagatactaaaatacgcgcccactgatattgcgactggcatcgcatggtctgaatagatggcaacattaaggcttctcaaaagtaatcataaaaaacatactcaaatttgaatgctaacggattataatgtttcctttttctttcaattcaaagttgaacgtggtgagtctttaacaaaagagtagaagtatttataagtttttttggctagatatagcggtattcctcaattctttctcaagtgcttccgtagagaaaatgttcaggaaaccttttgtttgtggttgttgtcgacaggttttttattttctacaatcaagaataagataaaaatacaagaccattaggaaagacgataatttgaaagaaaattggtgtagttaaaacatactagatatgatattatactaattgagcaaaatagagaaggaaagagaggattctctctctgagtaaaatcgatgagtggggattttgtcaaagtatttatactttttgtccataccatttgtcctacttttttaccgtttttttttttttcaaggccagggaaaaaagagtcattgcgtttgtgtgacatttcttttaatattcatcggagaacaccggcgggccacagagaaaaaaaaaaagtccatattccatgtacactgcaaataaccaagatttttcatttttcacgaaaagagggacaatgtactaatggcgttgacgatgacgaaagcaccattttggacattgtatgtcgtacattatcgtagagagattcggttgtctttaagggaccgaaaaaaagaaagaaatcttaggacatcagaaatgtacgtaggcaaatgtatatcacaatgttactaatcaaggttaaaaaaaaaaaatccttttaatgcttaattaccttcttaaatattgagtacgaaaacctatttctaaagaatgagtatatatgttagagcgttgtgctgctccttttaggatttcgggaatgtgtggtcttacgcttaagagctccccaacgatgtttcacatcagtgaaacttctcttgaaatgttccgtcattgggtcttctgtattggttctagcctgtctcttcaatttcatgccctcaaggtggtcaatatgttcaagtctatcactaggcaagataattgcacgatccagtgagtatggtagacctctattcttgcctctgatcagcatagctatgatcaccaacttagataatgtagtaaactgtcttgaaaacgattggttggtgtccggataacctagcgatagcccaactgtaccgtaagcgctaacaatttcaaaaagaattgcaaatatattaaagtttggttcttgtacgtcctttatcttgtccccttcacaaatgcaaatgataaataaccctaaaaatagaaaccacaagtcaaatgaaagctgtttccttaaatgggcaccgataaaggattttgtagatatttcatttggattttcagttttctttttctttttctttttcctgttgttattgttgttgttgttcgaactacttctttgactactttgaccttcgtgactctcgttttcctcgtcgtcatcttcatcgttaccatcgtcttcagtatccgtatcttctggttctccccccatatctccatatagtcctaaagattgctcctcgtaaacatttgtccgtcgaatagagatggccaatggtaatacggagacatacatcattagcatataggagacttggatagaaggatgcagttgacttaaatcgacaacgctgaatccagcagttcttgtgctaacagattgaaacaggccgacaaggactctatagcctttcgataatgatttcacaactgttgagccaaaatctagaataataaataaaatccaatcagttatattcaatcctgcaagcgttaaaagtagccaccatgtagctgccttaggaaatagcaaggtgaaacaacgacgtggatggtctaagagaaaacctaaactttctctcatctgtgataaatcaggagaaattttaaacattatccaaatgatgcatctaagaaggatgggaaaccctgtatttccgataatgataaaccaaatcataacgatcaatgggtatacagctttgttaaacgacatcattgaatttggagttaatgtcaaacctaaatcattaaatgcactcattgctgtccaaaatccccaccatgtaggtgaaacaccatcatctctaacaacttcactataatgctttttcaaaataatccaaggtactaacataacaaaagcaacaatatgccatccaacgtagtagacaaccaatatggtgcataaaagtttgattgctctgtactcgacaccacctaattcatctttctgggctcttgttaatccaaggaagtttgagttacgtccaatagttggttgccatgatagatacgttttaccactgcctttagataaatcatgacgaggatctaggtcataatcggtatcgaaatgtaaaccataatagccttcttcatcgtcgttgtaagtaggatagttgttaagaccattgtggtcgcttcctccattcgtggaatagatattctcattagagtcggaagaggcttcttcgcttccatttttatgagagccatcatgatgtaaaatagactctgcgtaatgaagaatactgtttccagtattactattatcaggataattgcgatcgctgtcagatgcatagggaccatgttcaaatatcttgttattccatcccctcttcctaaagttcggtttttttctatgatgggctttccaattttgatagaccattttttgaaaatcaggcgtccttgcgagctcatttagatccttagcctctgccatatcgatggtcctggaacgttccataggaactgctcttgaacgattatcatcaaatgatttggttttatacatgcggtgcaggttctgctgcagttggtgtttttcttgctgttgttggtgcgatttgagttctgaatcagaatgtggttcagactgctgtactcgttcatcttcatcgccgctttcgttgtcagcaaagtattcttcgttgttatcgccgtcgttgtcatcgtcatcatcatcatcatccatatcagtaataggttttctatctgaaacattgttactgctgtttttctcaattgaaccagtagaaagccttctcttaatttgttgccgtattcgccgcgctttaggaaaatgtttcatgaggtacttcttcgatgctttttttcgataaagaacggaagattttgggttcaaatcatcgaaggttgaaactctttttgaaatttttctaggaggtttagttatatcgaattgaattgatggcccatgctttttgtctgtttctgcgttatcagtaatggctatcgggcccgaatttgatctatgagtatttgttcttaatgaaggtactttgttaccaaaatttgtgtgtaacgagctttcgtccgaaacgctcgccgtactgtttgcttcacttgacacggaattttgatcagtgttactttcatttcccttatctcgaatcttgattttgttaccatttatgccggtggccttctttagcttattgacattacttttatatcttgtgccatccgcaggggacccgatgactaaagggggaccttcatcttcagcagttgcttcatgcttaccttgtagcatcataatggatcgatacatatcggctgggctaatatctcttgaaccccttctttttgcaaatttctctgagggaactcttgcgggtctttgtttgctgtgtggctcatcaaaccgaagactgcttggcttgggcttctgatttaaactttcgtctgcaactgtgttagacgaactacctaccgtcgagtaggagttgttctcctgatattctccattgtcatccgtttcgtcttccttaacgaaatcatctaaactgccactgctaccattgtgattcgtattattattgctgctgtccctactaatgtcatgagaattctggtcgctgtgaactgagtcctgctcatctctattaaccatttctccgctgaacaatttttcttggaaatcatctgttttagcttgtttcctaggataagacgttctttgggtacctgttctattcttggtcatggttcttgctgttagttccctttctaagattgttttcgttcttctcatcttaaaatttcgtctagaagagtctctaataccatcgaagtagcgctcaaaccagtaaagccgtacaaatgccaagcaactatgaactgcaattggtgttgatatgcagcatacgatatacagaacaatttgttggtataagcttagattgttgatatccacagtatttaagccaccttgtgtaactgcgcccgctgctaaaaacaatgtatcaatgtatctggtattcttaatgggatatagcaggattgaagttattaatgtcagggatatcgtgtagaagtagtgaaccgcgataaaactggggaagatatattttttaactggagcaaaatagtgaccacatagagcaataaaatcacgaaatttatggccgaaagattttttatatcgtatttcaagagatgccaatgtgggcactctactcatcgttcttctaaaatgcattgttagttatcaaaaaaaggtaataactttaagtaaaatggataggaatgacttccttgagagccaatagaataccctccttctttttaaggcaatacaagtgtggaatcagtgatgctaatggtaaggtaaaaacaatgggcgaaaggaaagcaacagtaacaaaaagtttctaataatgtaagagctctttatcttgataggtaattatttactgttttccgtgaaagtagcaaaatttagaagttagggtaagatacaggtatagttcctggtccagactccacatctactctcaataacgtggatttgaactttcaaaacaccttttattttctcgatgattttggacttttttttctttcctagccttgagccgtaaagagcggaaaaaccatcagacaattccagagcattttttctttcttgcgttgtcagccccgaacgtaaataatttcgaggagtcgatggccgtagcaataatcgaataacacaatatattgacgtccacatcgcttcacttgccggtgcttgaaataacatcccctcaatactctgtcataattcgtgcccttttttaggttcgacaaaaggaagtcagacgatatatatatatgaatatatatatatatatatgtctataacgagtataatgcaagtttattacaataaacatatgtatatgtaaggtttttttgtattcgccgcatcatttccacagtagcttttcgtctgctttttttttgttgttatattcacgtgcctgtttgcttttatttggatattaacgctataaaccacccatatgtaatgccggtacatttttagataaaccattctcaccacgttcccgtaagattttgttgcgcctttctaatcgttcagtgatatactcactcatgtggacatcctggtttctgtattttactaaccaaggatgctctgttaaagctgcgtatgtaggtcttctttccggaatcttttgtagacataaagaaacaaaatcttgtgcgtcagaactgaatttatctgaaggtaatctcggtggcggcccatcaacaatagcgctcaattgagagaaaatgttgtcgtatgtttctggtggatacggatatctacctagtgccatttccagaatgcttaaacctaaagaccagatgtctgactgtacggtataggtggctctatctggattcaacgatttgattcgttcaggtgccatgtatgactgacaaccaatattagtcttcgctaaagatgccaccaaattaccagaaacaccgaaatcgcacagctttacggtgccttggttggctgaacataaaatatttgttggtttgacatctctgtgtatgatattatgctgctctttgagttcttttagtccatgaatgacagcattggcaataaacgctagctgaggttcatcaatgccgccgatttcagatgattcgtcgtatattttatccaaggaaccaccatccatgtattccatacacatgtagacggcgccctcaataaagaatgcaccataaaaatccacaatatagggagaattgcatttatgcaaaacttctagttccattaaaatttgtctaaatttagcctcatctagctccaaacggacttccttcgtcgccataataacatttgtgggcttatgcagtacctttgagacgttaccatagttaccatgacccagttcatccaaaaattctagttcgtccaatgtaattctcgaactagaaccattgctgaaatctattcctttagaggatagcgatagtttgcctgcaaaattcaaagagccggatttgatatccacgtatttcgagaaatttgcgaaaagaccaccaccaccactactaccagaatttgaagagttgttgctgtttccagttctgggtgtagtgcctacagtgtcatgtgggccttcggtacttgatgaggtggatgtgctttgcacaccatttatcaaagaacccggattcgatcttttcccttcaacaactttgctgtttgataaggtttctatatgttttttgtttgaagggcttggggcaaactgctgcggctgttgagctgttttagtgggcatttttaatgacattcctcctggtggtaatttgaccgctcgacgggcacttaaactttgttttggtgtgttgattatagcaggggccttatgcggggcaacatttggtcttgtagggtgctgggtagaaagcggccttcttggtgcccttctgttaggattcagcaattgcgccttatgtgttgctgatgcagtattagaaactgacggcgtaatgtcagtagcaggtaggccagtatttacaccaattgttgtggcggtaattttggttgtatcgatgttaatatttacgtcggtaatgttttgtgtttcttgattgtccagaacgttcttaagagtgctcttggaggacgcttgcacgacttggctactcattctttgtgaaaccttagaacttcctgctacgggaagaggcggcaatggcttattaacaatctgctgaatatgtttaggtgattgtgaactgcctttgtcttgctcgctttgattactgcccacgctggcagaccttttcaatgcacgttgttcttgaaaagcttttacacgagcatgaaggtcagcgttgatgttattgtagtgcgaggacgtcgaagatgttctcttgacagcagagccattatctgagcctgtttgctcgtttaattggatagatgacttaccagttttctcatggagactgaggttagcaaacttgtcttccatctttgagaaattaacgtctcgatctgcttaatataataatgtatctatagaaatgtacggaaaaacgggtactttatcagttttagttgtatgacgttgatgtctggagaaggacaaggaaaaagtagttctgtgaaacgtgtacccacaatagcagctacccttgtcttcttttttagtaattcttttcttccggcaagcaggtaagcagttatctctgtgtccagatccctttgaagtaaagtttattcaattttctatagaacgtgtatggctcacgaaatcgctcactagtagacaacacacgttagaaagatcctttcaggtgcaacgggacgcagagggaaaaaactggaaaaattgccactaatgaaaaggcaaatagaggatgaaaaagaaaaggtaaatgcagatgaaaggacgaagacagatgcgataagaacagcgtttgagatcggatgcaaaggatatagttttgctctggcactgtgttagtgtgcttgtgggtgctttttcttctatttgcaagaaaatgtgacctttgcggataacctatataagacggggtttccttgctttgaaaagtttaaaacagatattcttgcagatacaggagtacatacttgtgcgatcatcaccaagataacaagagattaatcaaatatagaaacagatatataaaatagatacagagtgctacgcaataagatttttttttcctgttgcaatactatactacgtcttgacatgaactctcaacagtgatatttctggggagttgtatcgatgtgtagtaactggtagtagtctagtaatgagttgttctcatgttagtgaatattctgtatgcttccgtgcctgctgctatgctcaaggggaacagaaaagcaacacgcctcaaaatagtaatctacatgagaaacaagacttagtcattgccttttgccagaattggcttcggccgtagctgttgaagttaatcccgcagtaaaagacaaacggctccgtattcagcagttctatatatcacctcattaagacacagacgatcttgacagttgcagcagaaacacgccaccatatgttcttgtagctacaccacgattgagtgtctgcactcttattcaagtgtttcaactaaaaataagtctaagctgaaagattattactttcatttgatttttttatttttgaagccccatttccttaaatcgttctcgtggacgagattaaaaatagaaatgatgtagaggagatgcactaaacattgcctccctgcaccgcacaattactgtagccattgtgcttatttatatctacctatatatctaagcagctatatcatgggcttgacatacgcgacttctgcttgcttttgtgctctcgttcaaagagcaattacttcattccatctcaagaaggactgttgcaggtcattatttcatttcttactgcacgtatttcgattgagctgctaatgaaatcacaacacaactacccaaatagcctaagaattggaaaaaggcccttcttgataattggatctgttgagttggcgtatgcaaagctgtaaatattgaacggatctggttgaaaaagaaaatcatgctttctttattgtcgcgtaaactgtacactgctgcaattatctagctggctgctagtagcaatgtgctcttcgttacgctaccgtagcttttctccgtgagtgactgattttgctgctgtacatttaactccttttctatttaaattgtgcgctgccattttccgcatcggaaaacctaagacaaattttgatgagtatacttggtacgtgcccacgcagccaatagtgtctcgttcacggcatcagatacagcagtacttaaaagggcactgaggatcaggtttcctaatctggaaaattttgcagcacaaagcttagttatttatctccgattatggatttctgcagtacctaggtttcaacgtaaaactgtaacagaacctttcgtcatgcaagcataattgagttgagtgccttgtttccaatttcagtttccaattttacttcaaaaatcacttctgaaataagatttaagacttgtcaaccctgttccaaaagtggacgcatcattaaatgtaccttttttctgtacaaactttatagtttctagggttggtgatgtgaccgtctctggcagagtcgcaatttaataataaatattagaattgtgctctgtaaatgtattagattcgttgttaacaatcttagtgactgaattctcattaccttcactgttgttcaaatcgatttgttggccagtcacatcttcacctcgatgatttatcttctgttgttgttccttttggaccatttctagagcggccatgacgttatcttcgaggctcaacatagcatcgttcattatagtatggtcatttctatctaaatcgggaactgaatggttcatatctcgttcatcacggttgacggggttcgcgtgatcctgcgattcgttattcgttaaatggggtacaattccgttggaggcaacatccaagtattttcgtctttttcttgagttttcttcctccacgaatctattgaaggaattcattgactgttcgtcgtccaatagtggcgtgctctgtattgaggaaagaaactcggatcttttattcgcttcgttggcttcagctgttgttgcgggactattcgtggcgttctggaatgtgggttgtacgatattagtgtctggcggagtgggttcaccctccacatcattcagcgtactggaaataatattttgagggaaatttattgcctgtcccaataacgcattatcatgcttcttgctttttcttggattgttgatagtttctatatgctgcgtcggtagcatatgcgcctgcttaactgctctcttttgttcaattattacccctgtcccgtctttgtacctcatcttgcatttttggcaccgagagattacctccgaaacagtactcttgattcctctccaatggtatttttcaccaattttggaggtcaccttgttgatgcctaaatgttccattaaatgtatctctaatgcaatctggatttgttgatccgtgtcataaatgatttcttttccttttgtcatcaacttgccattcaataccgaatgagttttggaaagtactcttaatctagccttttcgtttctatcacaatgtaaaggatacttgcctgtttccagaaaatgctttaatcgttcatatttcccaatttcgatactcttttgaggatctcgtaacaaatctatacttttcgtaatatgtgtgaactctttaccatacatgaaagaatctactgggacatcaaagcccttgagaatcccggcttcaggcagctttccaatccgcctaaagttcaatccttccaaaattcttctgattcctacgttcgttccgtaaattaacgggaaaaaggaggacgtaaatcctaatttctttgaccattctatgaatgtttccattagtgttttcccaataccttttccacgaataccagcattgaccagaaatgttcctgtgaccacatgcgctgaccgtccagggtatgctggtttgaggtcaaatatgcctagacattgcttctcccactgcatacttagatttaaattgcgacgttcttttcgtttcttatattgggtggtgtgcttcgtggtttctatttctgttccaaaattatcatttgtgtccgcttcagtatccatactataatccagttctggtatttcgcctaacaccataatacaaacgtgaccatcattatgaaaccagacatttttgaattcttctagtgataaagtctcgtaataaggaaaactatctcccttttccacttccatgttaaattcatctagaaggaaatttaagagccctagcggcaataaatcaggatacgcaggtataggatacatcgtagctattgtttctccatctttcaataaaatggtatacggttgtaaaggagtcaaaagttgatctgggaccgctgcctcatttctcacttctgaactgctattttggtgtgccatctgcagatgttcgtcatccggtactgaacttgtgtgctgatttagcattgaagctaattattacgatttttgttgataatcactttggcggaagtctagagttgttcttgatcggtacactttttactcatcccccgagcagtgaactaacgccaatgtaatgaattttgctcttttatatttttcatttttttattattttagctcacgatccgcatctcgaattttcagagcttactagattctaggccattagaagtaaatgaatagaggtgaaataaaattcatacccatcatgaagtctccttcataaaatataacaccgcaaatgactagtaaattaaaacgggttgctgtcgcacaattatgttcatccgctgacctgaccaaaaacttaaaagtggtaaaagaattgatatctgaagccattcaaaaaaaggcggatgtcgtttttctccctgaggcaagtgactatctttctcaaaaccctcttcattccaggtatttggcacagaaaagccccaaatttattcggcaattacagtcaagcattaccgaccttgtcagagataattcacggaatatagatgtttccattggggtacacttgccgccctcagaacaagatttacttgaaggcaatgatcgagtcagaaacgttctattatatatcgatcatgaagggaaaatattgcaagaataccaaaaactgcatttgtttgacgtagacgtgccaaatggaccgatattgaaagaatcaaaatctgtccagcctggcaaagccattcctgacattatagagtctccattgggaaaattgggcagtgccatttgttatgatattcgctttcccgaattttctttgaaattacgatcaatgggggctgaaatcttatgttttcccagtgcgttcactattaaaacaggggaagcacattgggagttactaggcagagcaagagcggttgacactcaatgctatgtgctcatgccagggcaggttggaatgcacgatctcagtgatccagagtgggagaaacaatcacatatgagcgctctcgaaaaaagctccaggagagaatcttggggacactcaatggtcattgatccttggggtaaaataatagcgcatgccgatccctctactgttggaccacaactaattctcgctgatttggatcgtgagcttttgcaagaaataaggaacaaaatgcccttatggaaccagagaagagacgatttatttcattgaggcaaataaaatatgaaaaaagcctttattcgtacagatttgctttacatattaaaaatttcaaaaacatataatttaagtatataagtagttaatcatttaattatttttccgtggatcgaagaatttcgttaactttttcatcatctcttgatctattcacaactttaaatgcaaaagtcaaatatgaggtatgggatttgatctcagcttccatctttgtgacctccttccatttataattactatcaccttccttgattcgagaacctttgccaaaaggattaaatttggccttttctgttaatggtacgccatcctcgtttctttttccaactttttcatcgttagaatctattgtattgttaaacatccgcttgcgtctttctacaccctggagtttgtgcctcttaatatctctcaacctttccagggcatcattgagtgatctgaccatttgtcttcgactttcgtactgtctaccttgaatttccaccatttcaacatccgtccagccatatttctctaatacatccaatgttttgtctacttgctcaatgcatggggagaagcaacacaatccgaccttttcgtctacggaaataacagaatccagatgaggtatagcatcccagggagccggcagatctaaaaacactacatttgcattcaatgaagcggcggtttcattattgccaaattcgtaagatgtagtgtctcccttctttataagaaatccaccttggcaaacatcccgatgtgtaatcgtaacgttatcatcaataagtccatgctctttgaattcctctaatgcttgttcgtatcttatgtgatgaaattcaaaactaaaaagatgacctacagatcttgcaaaagcgtgcgaaaatgatcctgagcctgtacctgcctcgatcactctgctgtgagggctacaattcaacctttgcatgatgtaggaagagtcgggcgtatatacaatttgagttctgtgtggtaacgacaaagtccacaattcaggagttggttgcagaacatggacgaatgcaaacttatttgagccctttgttcttatagcaatttgagaaccataaggtttacctatgatatccttatgaggaaatgaaccataacgagtattgaatacctcttcggaatgcatccttaccggtttgatgttatctctagaaacccatattagagttaaatcgccttccttgatgaggtctttgtaaccggaaaaacaatttgttgacatttctaaatctgcgtaatcttagctacctgatagtcccaccccgatcttattcacatatattttctatatactttaaacagttttaaaagtgatgagcatggaaaaaaattcgttgctaacggcatggcataaacaaaaagcgaaaaaattttatagataataataaagaaaaagtatcaatagcatgagtgttaatgttataacgaagtgtaagaggaaaaagaatgctgcgcaaatacgttacttcataaaaaaactcaagtactgtatatattttacatttaaatatattaatttatatacaaatacggcctcctctcttgcattttttttattgttccatctccaaaaggcagttgattaagtgtacggataggtaaaactgaatgtggaaatttttgagagtttactccaggatatatgttggtagtattgtgtttttctttcttagtacatgtcagatttatggaaatcgtaaacgataccatggcgggccatttttttacctttgtgggtttcctctttaaaccttttctcatcatttttttgcttggtcagccaagcctccttaaatggtatgcgttccatggcctcaaggggttgatcttctttatcgatgtctacttcgcctaacatgacaacattttcaccacgaatcatgaatatgccgcggtcttcttcagcgtatttgttttcttcgctaaaatatattctctccacgcaatcttgaagtatcaaatttgcatattggtcaaaggttcttagtacaccgaatagcattcttccatcacgcaaaagaacgaagattttacggtctactgagcttacaatagcagcggtggtagtgaagttatactggtcgagatataaatcggcctcaccttctgaaatcttctttgggaaattctgctgttgtcgcttcgcatcctgattggactgatttctgtccttgctatttgcagacatttttggtgaattaattcgattcgagggctgctttcttttataggttttgaaagcggagcaaatgttggtataactctactgcagcgttggcaatcctgttgaaaaggaaaagaaaatataactaaactgtgttacttgtatcttcactaatatttaatcagcccttggtcatacaggcttcccctagattgaaatacaggtgctgaacaccgttgtatattcacgacttcctctatttttttcatattttccattattcaacgaacgcgggtaacaagtcggccgaatttgaacccactcctctgcgcttgtaactttatacatcatcgttacgctataaatgttatgtattaagtgtatcaaagacccatacggtcaatgacataattctgtgccatgaccccaaatgacaagcttaatccatcttcgatccattcctttacccattcactaggatcaatgatctcatcgtcttcgtcttcgtcttcactttctttttgtttcttttgatcgtatgacttattcctctcctcacttgctgttgatcctgttttctccacggatccttctagccaattgacccatttgacagggaatccttgtgatcttgttatggtggtaatatcgttagttatgtctttcaatacaagggtgaaattgaaattgcctggcgtattggagtcggtcacttgaaagtcaccgtcggcatctttttgtttttgcggaatggcaattggtaagatggatatgaataaatcactgattttattgctgttactgctaatagaactcctatcgtcatctggagtggcatcagcctctttctgttgtttctggtattcctcatgtgcagtattgaagagtttgactgcattttccaggtttgcaaatgccagtttctcaccgtctgttaccttgccgtcgaatagattaaactgtaatttttttttagagttgcctaactcaccgtctgcaactgaaggctttttttccacaggtgtaattccattattgttaggatggccccattcatctacaaatattctgattcctccctcaacttgtgagcttagaacttgatcaaacttgctttcaatattgtattgtaatgagggatagttaaccaaatcatggactagatgaattcgcagcacctcttcagtctcaccaacaacgattttctgtaagtttctggctatttcagtaatcgtgctcgtgtttatctttgaagtcaaatcaagctgttcttgggcaagtcggtttttgatctgggatgcttgttctgcagttttattccaaatactcgatacctttgcggatccagaggaggaccaccagtttgaaatagaagcaattgggtcatgcaatggggtctcctcctcctcctcttcttcttcttcttcttcctcctcttcttcttctttctcctgctgctgtggttccttttcctttccgtgagcgtcctgctcggaatttttgttttcttttgattcttctactttttcgtcttgtgctttattattaactgattcactgggagccttcttttcaacccctttcttgtcagttaagcttaagttactcttctccaactcttctaagaattcaaagatatcatcgtcacctttctttccatcattcccggtcttgcccgccacagaattagaacctcccttaacgccttcttggctaccctttacgtcagtattaaccattttcccgccattctttgcttctggcaaagaatctaaaaattcaaatacgtcttcagcctcagagttcttattttcagacattttgccctggtagtatgtatgtttttaatcgattgagtctagttaacctgtcccttgttctattcttcaccgtctcgtccaacttccatcaaagaaccagaaaccagaaaatcgccggtttcttccacgcgtcaatccgtttggaatgatctcatcgcaaaattttttttcgctaaaattttcatagagagtatcaatattaatatatggttataacttatggcggcattagtcgatgaggtgcttgccgaagagactagcacagccaacccataatgccttctaaaaactccatcaacagacctaagctgacttcaaatttgcaccacaaggtgcactctttaaataagaaaagagctcaaagagaaagagctggtctcttgaagccagctagatccagcgtaaattcgaaatctggggaaataaaatcagtagcgttggacctatacttccaaaacaagaagaacgaaagtcagaattccactgctgtgacattacaaaatgcttcatcttctccggcctccatcaccacgaggacactttccaaaaagagagctaagaaaatcgagagaaacttaaaatatgctacacagagaaaattattggttgacgcaagcgctaagctagaagacgaaatggatattgatctagatggcggtaagaaagtgaaagagaatgaaaagaagagttctttgactttggttaaggaagccttatggagtgtcattgacgatactgcatcccagggattgatcatcgaaaacggacaaggcaccaccctgggcggcccatttttcccatgagttaggcacttacgtatcttgtatagtaggaatggctcggtttatgtatattaggagatcaaaacgagaaaaaaataccatatcgtatagtatagagagtataaatataagaaatgccgcatatgtacaactaatctagcaaatctctagaacgcaattccttcgagacttcttctttcatgaaggagataacatcgtgcgggtcagctgcagtgaaaacactggtaccagcgacaataacgttggcaccggctttggcggctttcgggatggtctccttgcccaaaccaccatcgacttggatattcaaatgggggaacttggctctcaaagtttccacttttggcatcatgtcttccatgaatttttggcctccaaacccaggttccacagtcataacaagagccatatccaaatgaggagctagttcaaataaaacgtcaacagaagtaccaggtttgatggcgcatgcagctttgatgcccttagacttaatcaacttaactaaatgcaaagggtcttgtgtggcctcgtagtggaacgtaaattggtcagcaccacatttagcaaaatcgtcgacccatttttcaggattttcaaccatcatgtgacaatcgaagaacgcagtgggcttcttttctgtgttgctagcatcgccagggcgtggcacagaacgacgtagggaggtaacaattggttggcccagagtaatgtttggaacaaaatggccgtccatgacatcgatatgtaaccaatctgcgccggcgttgatgaccttatgacattcgcaacccaagttggcgaagtcagaagcaaggatactgggagctataattggtttgaccattttttcttgtgtgtttacctcgctcttggaattagcaaatggccttcttgcatgaaattgtatcgagtttgctttatttttctttttacgggcggattctttctattctggctttcctataacagagatcatgaaagaagttccagcttacggatcaagaaagtacctatacatatacaaaaatctgattactttcccagctcgacttggatagctgttcttgttttctcttggcgacacattttttgtttctgaagccacgtcctgctttataagaggacatttaaagttgcaggacttgaatgcaattaccggaagaagcaaccaaccggcatggttcagcatacaatacacatttgattagaaaagcagagaataaatagacatgatacctctctttttatcctctgcagcgtattattgtttattccacgcaggcatcggtcgttggctgttgttatgtctcagataagcgcgtttgttatgcgaaaaaaaaaaactttacagaggctttgtttatatatagaaagaccacgaaaaaaacagtgatggcttcatgcttttcagtttcattattggcacgagtagcagtcgttgagcccatcagagtgcaactttggttaaatgtcgtaaattgtatgattgaatcatccatgcaccaatgtcctccacgggatcgccactttttttcttcatcacgccccattttgttgatccgacgttctgtatcaactgtatacagattcgttgcttctcgcaccacacaggttttacgtgcggccaagaccgttgtcaagtggttcattattgtcgacccactgataaattctattctaatcaattatctcattgataggctctgcactcttgggcatgctgtattgcgagtgaaaaagcgcaagaccgaggagagacaaccctgttctcccattatacaacacacacacgttaagagacgcaaacggcctcgtctgaggatcgtagccatcaagaggaagcggaggcgtcgaagaccacatcgcatcgagcgtccactctcaaatatgtacccaataatggaaatccagatggtggctgttccacttgctcttcccagtccaactgcactggtgcattatcagcagcagcaacagcagctcccgcaacatcatccctggtacgacctctcgctttctgaagaagccctctcgacctgctgttgtagttgacctataactgaaaattcacacccgcattacccagcgcgcccgcacgtgctctttatggaaactataatgaataacgaccaaagaacatctttttttctctctcacacaaataaagcttttcatgtttatagatatatagcacatacttttactaagttttctagattgattacgactcttccagttgcacattttttcatagcgaaagtacaagagtaggaagagtggcacaatggcggttcaacaaagaaagaagaaagagggtagaaagtccgataaaaatgccccatcggtcccacaagtagatgcatcattagacaaaccacttgatattgatgctcctcctactatttacagtgttaatttgaaaccagaatatggtacagctgcattgaatttgtccgcggatttcatcagacaagaacaggcattggctaataagtatttgttcttccatcccgtcatccttgttgttctaaccattgggctgcttatttacttgacgccaagaattgtctttccgataaggaatacaggatccgttgctggatggttctaccagctggctcgtattaataagaaggtcgtcctcagcggtttagtgttcaccgcaattggtgcatctttcttgttcaccctcctctcacgtgtatctgactcgtatttcaagtcgaagatcaaccaacttgttggttctaaaggtgagaaagttttcggcatcaatttgaatgatttggtggcaagacatgaaacaaaggatccagtggtgaacaatacgcatatcatcgtttatagagaaacgcccattgcattgatttcgttagcccctaacatgacattaagtactgatgaaaatttagtcatgagtgttactactgtgggttgtcgtcgtgtatatgtaaaaagtggcattatcgaagatttgattgattgggctatgctacactccaaaaatattagaagcagcggcaaatacggggagaccatgaaactcttgattgatgtctactcattcgatagcacgcttaaggaaattttgaagaaaaaagggttcacttatattcaaagcattagagtctctgaaaatcgactactaggcggtttgttcggtgtgaagaaggaattatggggtttgcaattccattttaaagccgaacacaaggactaggatactgttatttttatagccaaaaaatgaaaaaaaacagcatggcatcttgttagttctgttgcaactcgcaggaagtaacaaaataaacactataatatttccatatatttatatatatgtatacaaacaccttgttaacaaaaaaaaaataaacgaactaaagaaaaccgtaatgcagagtacaccttgaagagagagaaaagaaaatctttgaatccatagcataatagcgatcaacgaaactttttaagaagtaaaatgaactgaaaggagaaaaatataacggaatcccaatgtataataataaatagagagcggaagaaaaagaataataaggggaattgagggtatcaaaatacaagacattcttttaccgaaaagaagaatgacttaatagaaaacaaattcagcagatccagataaaacagaaactgtgcaaccatcggaaccatctccggtgaaagagccatcttcatacgcacagctgccctgaacgttagcgccatcggatgcaactattttaacgttaaagttggcagcttggttactgttggggtttggaatcaacgacaagtatgtttctccattagtggaaccagcacctaacactagtggagcccagttgccgacatccgaaccagaagtaccccaaatgcacccatcttctgcagatacaccggcgttgttaatatagtactgagcagaagtctttttaccctgccattgataataagtgtcttcatcaacgactgaaattggttgtgaatctccaccatcaaccactgtgggaatcaccatgttttctgatcctgggtaatccgtcctacatagagcaatggagtcagactttttgttaatggccttagcagatgtttcatccgtagaacataaatcgctggtatcagtgttggtacggtacaagtaaccatttttacagtaaagaccaccaacagatttaccatcgcttggttggtcagaaggccattgagtctttgacattccaggttcacatgcataagaacagtagtagccatccttacattcggacgaagtgttggcatccatgtccatgacagaggcccatccaccaaatcctagccagtccaaggaaactataccgtttacagaagggaagtccgaacatttgacagtaccatcttggaatccgccatcacgcttctgttcagaggtatccttctcagatgaggacaatgtagtggtagtagcagcagattctacagtactagtagcggcattggaatctatgtattgagtgacagtgacaaccgctggtttttcatctttgtgatgatcttcatggtgactgtccgctggagcaggtgcaggggcagaaaatgcgacagaagaaagggaagacaatattaaagctgcggaaattttcattatgtgttagagagagacgagttaagtatgtgcgactatactagtattataatattaaaggaaagtaaggtaccgtctatgaggagactgttagttggatatcagtaatgagacgaaaaagctcgaaatgaatggatatattctttttgctactggcaactgttgaatatttaatgttaaaacaaactaactgaggtatattcgtatctgtatgtacacatatactatatacaggaaaagataagcaagagagaggatatcaactacgagagcgatcgattatatatcaaaagctgtccgctttgccacccataatcggcgcttagtttcggagttcaatcataattctaccaccttacactcaacttactctttaactcctatagtataatatcgccactgaccccatattaaaaaaatttttttgctcgatcttctatcctctttaggttaattgtcgctgttattgtctagattttttctcggagatggcgcatctatttgccgtcaaaagatcctctcataccatattaagtaaattgcctccatttctttttcctcgggcagagaaactcgcaggcaacttgctctcgaagtggtcacgtgcgggtctaggcctgcataatcggcctcacagagggatcccgttacccatctatgctgaagatttatcatactattcctccgctcgtttcttttttcagtgaggtgtgtcgtgaaagaaaacccacaattaaactttcaacaaccgggcgactaggaagagagtagtgggcgcggatgacgaaggctaaggtcacttcttcgtttcctttattggggtttccgtgtagccttcccctgaatagtgtgggacgttttatgagaagccgtaagaaataggcaaattgagttatgacaagtagacatgatgccgcagccttgcctgactttacgtctccttcatgaataagtttttctatcgagttcttttccttttttcgccttaattagctcaattaagcctgtcctcactacttttctttttcttatcggctttgtgccacacctaaccttcgaatgctgttttattccgttcttacatgggatggtaatgccttggcgagaatttcgattttcaggatattgtcttggtggcgtcttttgctgttactatgtgtttaagagagagctgttctacaaagaacttttcatttacgcgttttttcctttttttttttttctcatcctaaacgcgtaaatctgttccctttttcatgtaatgggcgtacaaccgacgatggaaaaatgaatcttgcaattttaatactaacacttggaataactccaaacaggtaagaggctcacagaatctcgaaagtgtaacagcgtactctccctaccatccaattgaaacataagatatagaaaagatgtcaattgtttcactgttaggcatcaaagtcttaaacaacccggcaaagttcactgatccatatgagtttgaaatcacttttgaatgcttagaatctttaaaacatgacttagagtggaaactaacctatgttgggtcctctcgttctctagaccatgaccaggaattggattccattctggtaggccccgttcccgtaggtgttaataaatttgtgttttctgctgaccctccctccgccgagctgattcctgcgagtgaattggttagtgtgactgttattctattaagttgttcttatgacgggagagagtttgttagggtcggttactacgtgaataatgagtacgatgaagaagagttaagagaaaatccgccagcaaaggtacaagtagatcatattgtaagaaatatactggctgaaaagccaagggtaacaaggtttaacattgtttgggataatgaaaatgaaggggatttatacccacctgaacagcccggcgtagatgatgaagaggaggaggacgatgaagaagaagatgacgatgaagatgatgaagacgacgaagatgacgatcaagaagatggagagggagaggcggaagaagcggcagaggaggaagaagaggaggaagagaagactgaagacaacgaaacgaatcttgaagaagaggaggaagacatagaaaatagtgacggcgatgaggaagaaggagaagaagaggtggggtctgtagacaagaatgaagatggtaatgataagaagaggaggaaaatagaaggggggtccacggatattgaatccactccaaaggatgcggcacgttcaacgaattaagaatttatgggttataagattaatggtacctgcaagagaggtacactttataaaatgtataaataaaaaaataacagacataagataaagtcgggttagggcaacagctacgtaaaaaataaaaggcagtaatattttccatttaagttgattttcttattattgtcgttgagaacaaaaagaaattggacgagtccggaatcgaaccggagacctctcccatgctaagggagcgcgctaccgactacgccacacgccctaatattattgatattgttgtttatcaaagtgagatacgtcagtatgacaatacgtcatcctaaaagttcataaaacacatatgaaacaacttcataacagaacgaacatgttggaataaaaatccactatcgtctatcaactaatagttatattatcatgttggaacgagagtaattaatagtgacatgagttgctatggtaacaatctaatgcttacatcgtatattaatgtacaactcgtatacgtttaagtgtgattgcgcctattgcagaaggaatgttaaacgagaagctcagacaatactgaagctgtgttaaagacctattagttgaacatgttatggtaggtacatatatgaggaatatgagtcgtcacatcaatgtatagtaactaccggaatcactattatattggtcataattaatatgaccaatcggcgtgtgttttatatacctctcttatttagtataagaagatcagtactcacttcttcattaatactaatttttaacctctaattatcaacatggcgaccccagtgaggggtgaaacaagaaatgttattgacgacaacatttctgcgcggattcaatcgaaagtcaaaacaaatgatactgtcagacagacgccatcatcattaagaaaagtttctattaaagatgaacaggtgagacaatatcaaagaaacttaaataggtttaaaaccatactaaatggtttaaaggcagaagaggaaaaactttctgaggctgatgatattcagatgctagctgaaaaattattaaaactcggagaaaccattgacaaggttgagaataggattgtggatctagttgaaaagatacaattattggaaacaaacgagaacaataatatattacatgaacatatagatgctacagggacttactatttattcgatacgttaacttcaaccaacaaaagattctaccctaaggattgtgtttttgattataggactaataatgtcgagaacattcctattctcttaaacaattttaaaaaattcatcaagaaatatcaatttgatgatgtctttgaaaatgatatcatagaaatcgatcctcgtgaaaatgaaatcttgtgcaagataatcaaagaaggactcggtgaaagtttagatatcatgaacacaaatacaactgacatttttaggataatcgatggtttaaaaaaacaaaatatagaagtttgcatggtagagatgtcagaattagagcctggggaaaaggttttggttgatacaacatgtagaaattccgcattgttaatgaataaacttcaaaagttggtactaatggaaaaatggattttttctaaatgctgccaagattgtcctaatctaaaggattacctacaagaagctatcatgggaaccttacatgaatccttaagaaattctgtgaaacaacgtttgtacaacattccacatgacgtaggaattgatcacgaagaatttctaatcaatactgttattgaaacagtaattgatttgagcccaattgcagacgatcaaatagaaaatagctgcatgtattgcaaatctgttttccattgctcaattaactgcaaaaagaaaccaaatagggaacttaggcctgactcgaccaatttctcaaaaacctattatctacaaggtgcacagagacaacaaccacttaagtccagtgcaaaacgaacaaaagtcttggaacaagacacaaaaaaggtcgaacaaagtgtacaacagcaaaaaactggtaattattgataccggttccggagtaaacattaccaatgacaaaaccttactgcataattacgaagacagtaatcgcagtacacgattttttggtattgggaaaaacagttcagtgtctgttaaagggtatggctatataaaaatcaagaatggtcacaacaatactgacaataagtgtctattaacttactatgtaccggaagaagaatccactataatcagctgttatgacttagccaagaaaaccaaaatggttttaagtcgaaaatataccagattgggaaacaaaatcataaaaattaaaaccaagatagttaatggtgtcattcacgtaaaaatgaacgagttaattgaacgtccttccgatgattcaaaaataaatgcaataaaacctacttcttctcctggatttaaactaaataaaaggtctattaccttggaagatgctcataaaagaatgggccatacaggaattcaacaaattgaaaattccataaaacataatcattatgaagaatcccttgacttaatcaaagaaccaaatgaattttggtgtcaaacctgtaaaatctctaaagccacgaaaagaaatcattataccgggtctatgaataatcatagtactgatcatgaaccaggctcatcatggtgcatggatatatttggccctgtatcaagttcaaacgcggacactaaaaggtacatgcttattatggtggataacaacacgagatattgcatgacctccacacacttcaataagaatgctgaaactattttagctcaagttagaaagaatattcagtacgtggaaacacaatttgacaggaaagtcagagaaattaattcagacagaggtactgaattcacaaatgatcagatagaagaatattttatttcaaaaggaatacatcacatacttacttctacacaagatcatgctgctaacggaagagcagaaagatacataagaacaataataactgatgcaacaacactcctaagacaaagtaacttaagagtaaaattttgggaatacgcagtaacttctgctaccaatataagaaattacctggaacacaaaagtacaggtaaactaccattgaaggcaatctcacgtcaacctgtgacagtgagattaatgtcattcttaccatttggcgaaaaaggaataatttggaatcataatcacaaaaaattgaaaccatctggacttccttctataattctatgcaaagatccaaatagttatggatacaaattctttataccatccaaaaataaaattgtcacatctgataattatacaattcccaactatacaatggacggtagagtaagaaatactcagaatattaacaagagtcatcaattcagttcagataatgatgatgaagaagatcaaatcgaaacggtcacaaacttatgtgaagctttggaaaactacgaagatgataataaaccaattactcgcctggaagatttgttcacagaggaagagttatctcaaatagactcaaacgcaaaatacccatctcctagtaataacctagaaggggacttggattacgtattttctgatgttgaggaatctggagattatgacgttgaatctgaactttcaacgacaaataattcaatctcaactgataaaaacaaaattttgtcaaacaaggattttaattcagaacttgcatcgactgaaatatccatcagtggaatcgataagaaaggattaataaatacaagtcatattgatgaagataagtatgatgaaaaagtccacagaattccatcgattatacaagagaaactggtaggaagtaaaaatactattaaaatcaatgacgaaaacaaaatctccgacagaattcgtagtaaaaacattgggagtattttaaacactggactcagtagatgtgtagatatcaccgatgaatctattactaacaaagatgagtcaatgcacaacgcaaaacccgaactaattcaggagcagttaaaaaaaacaaatcatgaaacttcgtttcctaaagaagggagcattggaacaaatgtaaaattccgaaatacaaacaatgagatttctttaaaaacaggcgatacgagtttaccaataaaaactttagaaagcattaacaatcaccatagtaatgattattccacaaacaaagttgaaaagtttgagaaggaaaatcatcatccgcccccgattgaggacattgtggatatgagtgatcaaactgatatggaatcaaactgtcaggatggtaataacttaaaagaattaaaagtcaccgataaaaatgtaccaactgacaatggaacaaatgtgtcaccaaggttggaacaaaatattgaagcatctggatcaccagtacaaacagttaataaaagtgccttcttaaacaaagaattcagttctttgaacatgaaaagaaaacggaaaagacacgataaaaacaatagtctaacaagctatgaattagaaagagataagaagcgttcaaaaaagaatcgagtgaaattaattccagataatatggaaacagtttcagcaccaaaaattcgagccatatattataatgaagctatttcaaaaaatcctgacctcaaagaaaaacatgaatacaaacaggcatatcataaagaattacagaatttaaaagatatgaaggtatttgatgtcgatgtgaagtacagtagatcagaaatccctgataatttaatagtacccaccaacacgatattcacaaagaaaagaaatgggatttataaggctaggatagtctgcagaggtgatactcagtcaccagacacttacagtgtaataactacagaatctttaaatcacaatcatattaagatattcttaatgattgcaaacaacagaaatatgtttatgaagaccctggatatcaatcatgcattcctatatgctaaattggaagaagaaatatacatcccacatccgcatgataggagatgtgtagtcaagctaaataaggcgttatatggtctaaaacagagtcctaaagaatggaatgatcatctaagacaatacttgaatggaattggactgaaagataactcttatactccgggattataccaaaccgaggataaaaatctaatgattgcagtctatgttgatgactgcgtaattgcggcaagcaatgaacagagattggatgaattcataaacaaattgaaaagtaattttgaactgaaaattacaggaacattaatagacgatgtactcgatacagatatattaggaatggatctagtatacaacaaaagacttggtactatcgatttaacattaaaatcattcataaatagaatggataaaaaatacaacgaggaattgaaaaagattagaaaaagttcaattccgcatatgtcaacttataaaatagatcctaagaaagacgtactgcaaatgtcagaagaagagtttagacaaggtgttctaaagctacaacaattactaggtgaactaaactatgtcagacacaaatgcagatacgacattgaatttgctgttaagaaagtggctagactagtaaattacccacatgaaagagtcttttatatgatttacaaaataatccagtacttggttcggtataaagatattggaatacactatgaccgagactgtaataaagacaaaaaggttattgctataactgatgcatcagttggatcagaatatgatgctcaatcaaggattggagttatattatggtacggtatgaatatttttaatgtttattctaacaagagcacaaacagatgtgtatcatcaacagaagcagagcttcatgccatttatgaaggctatgcagactcagaaacgttgaaggtaacattaaaggagctaggagaaggagacaataatgacattgtcatgatcactgactcaaagccagccattcaaggattaaatcgcagctatcaacaaccaaaagagaaattcacttggataaaaactgaaataataaaagaaaaaattaaagagaagagtataaaactgttaaaaattaccggcaaaggtaatattgctgatttactaacaaaaccagtatcagcatctgattttaaaagatttatacaagtattaaaaaataaaataacatcacaggatattttggcctcaacagactattgataattaattaatgaagttctaaacacacaatgaatatctgttgaagtacaataatatatctttaagggagcatgttggaacgagagtaattaatagtgacatgagttgctatggtaacaatctaatgcttacatcgtatattaatgtacaactcgtatacgtttaagtgtgattgcgcctattgcagaaggaatgttaaacgagaagctcagacaatactgaagctgtgttaaagacctattagttgaacatgttatggtaggtacatatatgaggaatatgagtcgtcacatcaatgtatagtaactaccggaatcactattatattggtcataattaatatgaccaatcggcgtgtgttttatatacctctcttatttagtataagaagatcagtactcacttcttcattaatactaatttttaacctctaattatcaacatatcaatatattattgaagattgggtgaattttgagataattgttgggattccatttttaataaggcaataatattaggtatgtagatatactagaagttctcctccaggatttaggaatccataaaaggaaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacaattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacctaatattataccctctatcaacaacaggattccaacaattatttcaaaatccacccatatctcagatttcacatcagtattgattaaaatattaattgctaccagttctaataaatctaatgtttacatcatatagtaatatatcttttgagaaatgtgactggcgttatacagaaaccgaattacacgtttaaatactaattataaattatcctgataagtgtatctttatttccgtacagcacaaccgatagaggagatgtttaaagtgtttaagctcactttatagggtgaaacacattttgacgaccgtaaaaggtcatttgatttggtattgaggtcgagaaaatattttcaaatagtgaaggatacattaaacacgctcacaaaacaacataaaaatccgtgatagtttaatggtcagaatgggcgcttgtcgcgtgccagatcggggttcaattccccgtcgcggagattttttttggcccttgatgactgttctggtacaatttccaccttgaatgagggtataagataccgatgatatatattcagactatttctacgacacagaaaaacaatcgaccaagccgtccttgaacatgctgcagaacttccttttttttattttttttggctcatctacgtaatcctattatcttttattaaattttgaagctatgagtttctttccagcgacttggaaccaatagttgacagtgagtgcatacttgagtattttccccctacattgtacagtcctcctcagacctggtatccctgtttaatgtggtcgctcatcggacttttccgtccgataggaattcgctcaactttgacaggcggaactactttcacatcgattttctcaggaaagacggcgtaaacaagagaagaaattaactttctacagaaagtacaaccatataaacccttcgtagagctccaattagtagcaaataatgacaaataatgtcagtgaacgaccaaataactcatataggaaaaacattgtccaccacggcttccgcttttttaaactaccaaaaatcgaacagcaacactcaagatgtactgaccaataatgggccttataagaatttattatcaaataccgtcaacaatgcgagctcaacttcatacttttacaagaggactgaacacggtcgctttgtaaaaaatgcatctaacacttttgaggatatttactccaagacaagaaggggcgatgtattcaggaacaagttcacagacaacaaaacatgcttcagaatgctcacgtacataagtgatgatttgttgaacgagatcccaactaaggaaggtctcaaaagtgatgcagatggcaagcttctaaccgaaggaggcgaaaatgaaaatctcaggaagaacgcatccaaaaaagaaacatcgctgtttcagggctttaaaagctacctaccaatagcggagcttgccattgaaaacactgaaagattaaactatgatacaaatggtacaagcggtacggttggtgcgaaagatgttatgtctaaaacaaatgagcgagatgaaattcacacagagcttcctaacttccaagattcatttctcataccgcctggggtagaaactaaaaaaataagctcctcttattctcctagtgcattaaaaagtttttctcaaactcttgtaaatagtttagagtttttaaatattcagaaaaattctacgttatccgaaataagagacattgaagttgaagttgagaatctgagacaaaagaaagagaaactgttgggtaaaattgcgaacatagagcaaaatcaattactattggaagacaacctcaaacagattgatgataggttggactttttagaagagtacggattggaggtgatcgaagctaatagcgacgaaaatgcagaagatgatggtatgagtgagcgaaaggcccttaaaaatgatgctataagaaatgagggtgtcaccacagagagcatatcatcagaggcttctaatctacctccaaggagaaggcaacaacttcgagacgataactcattgaatagattaggtgccttttatagcaaatccaaaaaaagacacagaaaaagcttcccaacattccagcagctttacgagccaggaacaaaaattggctctataatgtccactcacgatgatttcctcacttgcctagattttgatgcgccctttggtaccttatgtacagccggatatcttgatcacacggtaaaaatttgggatttatccaaacaaaacaaaattggagaactagcaggacatcttgctacaattaattgtatgcaaatcaatcgtgactacggaactcttgttactggtggtagagatgcggctttaaaattatggaatttgaatttagctcaacaactttaccaggaaacgcaaaatcttacctctcctacaaatcatattgattctccatgtgttcatacatttgaggcgcatacagatgaggttactgcattatcattagatcctagtttcttggtgagtggttcacaggatagaacaattaggcaatgggacttacgttccgggaagtgcttgcaaaccattgatctgagctttgcaaatgtcttaacaacatccactaatgtcgatttatcaaagagcacacttcttactcaaagaaatgagaggcctagtataggtgcactacaaagttttgatgcagcgctagcaacgggtacaaaagatggtgttgtaaggctatgggatttaagatccggaaaggtgattcgtactttgaaagggcatacagatgccataacgtcattaaaatttgattccgcgtgcctggtcacaggttcatacgacagaacagttagaatctgggacttaagaactgggttgttgaataagtttcatgcgtacagtgcgccagttctttcgttagatctcttccaagagaacgctgcagtcgttgtcgcagacgaaccaagtgtccagatatacgatagcgaaaaggatgaaagctggtcttgcgtcgaacaaggtaacgagactagcgttagtaccgttaagtataaagaaaattacatggttgagggtcgtgaaaatggggacgtaaatatttgggccgtatgataggcattgcattgcaatcaagtcaacccatttgaagaaaaataaatatcgagtgcatatgtgaatagctgctcgctcagatatatataaataaatattcgttctggaatgtaaataaagtatcgtcaataccttggatggtttatcagcgaaatcggtgctgtagatgttgccctgtcatattactacagatgtcttggaagcaatcaccatacctgcattatccttacccggaaaaagaaaactttcgtgaataatgattaatatttaagtggcgactttttcatccttgctattgaaaaaaaaaaaaatgaataattgttattaagcgttagcagatgccaaattgtcgaaatgatttcaaatacagagaattagccgcaaatattaagtagtacctgaatcacgagacatacaactcggaaaaatgaactttggaagccaaacacctacaattgtggttctaaaagagggaacagacgcatctcaaggtaaaggtcaaatcatctctaatatcaatgcctgtgttgcagtccaagaggcattgaaaccaactttaggtcccttaggttctgatattttaattgtgacatcgaatcaaaagactactatttctaacgatggtgccacgatcctaaaattattagatgtagtacatcctgctgccaaaactttagtggatatttctagagctcaggatgccgaggtgggtgatggtacaactagtgtaaccattttagctggtgagttaatgaaagaagccaagccctttttggaagaaggcatttcatctcatttgattatgaagggctacagaaaggccgtttctttagctgtggagaagattaacgaattagctgtggatattacttcagagaaaagcagtggcagagaattacttgaacgctgtgctagaactgcaatgtcgtcgaaattgattcataataatgcagatttttttgttaaaatgtgtgttgacgccgtgctatcccttgatagaaacgatttggatgacaaattaataggtattaaaaaaattccaggtggtgctatggaagaatctcttttcatcaacggtgtcgcctttaagaagacattttcgtatgctggatttgaacagcaacccaaaaagttcaacaatcctaaaattttaagtttgaatgtagaactggagttgaaagcagagaaagacaatgctgaagtacgtgtagaacatgttgaagattaccaagctattgtagatgcggagtggcaattaatctttgaaaagctaagacaagtggaagaaacaggtgccaatattgtactatcaaagttacctatcggcgatttggctactcaattttttgctgatagaaatattttctgcgctggtagagtgagcgcagatgatatgaatcgtgtcatccaagctgttggaggctctatacaatctactacttcagatataaaaccagagcatttgggtacttgtgctttgtttgaggaaatgcaaatcgggtcagaacgctacaatttattccaaggttgcccacaagctaaaacatgtacattattattaagaggaggtgctgagcaagttattgccgaggttgagagatcattgcacgatgcaatcatgatagttaagagagcgttacaaaataaactgatcgttgctggtggtggtgctacagaaatggaagtatcaaaatgcttgagagattattcaaaaaccatagctggtaagcaacaaatgataatcaatgccttcgctaaggctttagaagttattccaaggcaactctgtgaaaatgctgggtttgatgctatagaaatattaaacaaactaagattggctcacagcaaaggtgagaaatggtatggtgttgtctttgaaacagaaaatattggcgataattttgccaaattcgtatgggaacctgctttagtaaaaatcaatgctttgaacagtgccacagaggctactaacttgattttatctgttgacgagacgatcactaataaaggtagtgaaagtgccaatgctggcatgatgcctccccaaggggctggaagagggagaggtatgccaatgtaattaacactctaaaaaacatgtgctgcatacattttattattactctttttgcagtagttatttgcatcaaaggtaatttctttcaatcataaataagttaatactgtattgataaaaccttattcttttcttttgtatactctgtatcttaaagtaattctaggtctaaagaaaaatgaaagaagtaatgaaaactccgagaaacaaatcatatcattggtcgtcatccgggttggatgtcatgcagctgcattccatttcttcggcaaaatgtacgtaatattcgattagaaccctgttttgcaactgattatgctactatgtatttatatatgcatacatatgatgatattatatttgaaaaatgatgctgatttttttgaaaaaaagatctatcctcctttattcccttcttgttttactgtcctttgcaaacgttcctcaagagctcgacatttcccgtctaattcattgatatgtctcctatataaatctgtaacaagttctaactcatttattctagttttgagctttataatttcttcttctttgtgcaatttagtggataactgatcacctaaatctttagctgggtgattttcaaattttcgtccagaaacatcagaactagaaacactatttgagatggattgtgaatttgctttggatatacagggagctttagaagattgtagaaacggtatgaaatgaggcggtgtcgtctcggttttcacgttgctaatcgcacgatctctcgtctcaagcatgtcgttaatagaagccatgtggaaagataaaggggctgggtcgttacgcttagcagatattatatctggggaagacatcgtcgatctaatttgattcggtacctcggatggattagagtcagtcgtccgtgaagaagtgggtgccagagttgcggcggtagaggcaataccattattgcaattggacactatttcacttccgttatttgatattgaagtactgctcaagcttccaagcagcattgataagtgaggtaattgaggagaatctgcgcctgtttttgatgttactgaatgtgaagcattgagggggaaagaggctgcgttgaattgcgaccgttctttgataaaagcagattggtgtgcagaatttgaatactctttaacgtccgtataacttgggaacgtaagtaacttctcttggtatatagcagtatcttgtttgggcagtttaggctttaagtttggtctcgaacaatctcccgacatcagtacctctaattttgttgctgataggtgagaatcgcttctttccttagactccgtttttggcttcttggatatcttcgcagtagatgatgttcccattaaaagttgcgaactttttttctttttatcttcagatgttactctgttagctttgcgaccgcttgattctatattacaatcacccttaagctctgcaatcagcgtctgattccgaaagttgtccagattatgtgcatgatttgtattacttttcctatttcgagactttattacatcagttttcaaactaattggcctgggtttcccatgaagctttaaaaagagaccacacgcattacaaagcatagctccatgctcatctcttctccataatggtgttgtagaggttaaacagttcttacaaacaggaacattagcatcattggatacgttattattgcaattggcatccattgtttgtccattattcttaacttgatttttaggtaatatatggtgtaatgaattcgtatccggactcattcttccagcagtagatgtggaaaaagacttgtcattcgccttaaaattcatattgttgcttattgacgctcctgcttgcgattcacgcaattgaactgccgatttttgctcggcagatactgcttcataacctaaaggtggccatctcccaatatgcccttcttcttcgctttgatttaagctgttgaggttttcacttgattttggttcaaatacattatctcgttttctaatgttatagcctcgaagagttgtagcctgcgatgccataatattaccagtagaattgtagagcacagtacaaatacccgaaatgatattcgtatatctagtattatagcttcaaccgcttgcaatatgttctctttcaaactaccttattatcaagcctatatcttatttttcactgattaggattgataagcgcagataagcgaagataagaaaattttcactctgttcgcccgctatttaggatcagtaattttagtaacgttaatcactaggaacgacgagaaagatgacagaataatatctcattgaaacttgaagtagcgtaattgaaatattaagttcaaactcagaaaggggcagctatcacgaatgaataacaatattttcaatgaaagatttcgttcaacagcatagtgttttactttacaaaaatttacataatacttcaccttttttttctaatctaaatacctatcaaaaggttcccctaaaacgttttcaacaaccttgaccaaaccggtcctgacttcacgttcgatctcttcatcatcatcttccaataactcagcgatgacgggaacgagctgtggcaatagaactaaccaactttcacctatctttgagtatatcaacttcatggctctaatagcccataatttttcattggaggaacaggaagctttcatgtgttcaacgattagtttattcaaaatttggttatgctcatcaacgccactattgttagaagccagagcgccaattgccttgaccaggtacttcccaatagagttttctatattagatagttgattgaccaaggatacagaaattaactcgaatctggaagttgatttccagtattcgtctctatcaaactttagcgaagaggttagagagttgattaccaaacgtcttaaattaacgttttccatgtccttgctaatgaatctttttaacaacatatcaacaggttctaacaaatacgtgaaataggaagtaattatacctctcaaattttcttgaagcttgttgaaaaatttgaaaaatgccaacagtctttctgtttcagtgatacctgcatttgtaacgccttcaccgtcaaacgcccatcttactaatataacaaatagcggtctaaatactttgtcattcatcttcaggacgtaagagttggaaatttcgtgaacggatgcctctatcctactaattgtattattatcgaaactggaaatggatctaaattcgaataaagataatagtaacttaaaaaatattggcgattgtgaggttgcggattttttatcaatattttcaacagtggattctaatgtactcaaaaatagactaacagcaactgtatcattggacgttgctatttcagtggaccaaattctgaataaaactttcaaaacttccttcaaatctatattctcaattatcaatgaaattactgacagcctaatgctgctgtcaacttcacgggaaaaataaataacatgcaaaacatccaaaatatttgacatcaagaaacttggtatccttttgattagaccggcgaacagcaacagtatagcaacttgcaactgctcttttaatgggttactactatctgccaatgaagcatcaaataatttaatagaaggtgggactatttttggatagaacgcaattgacttgactcctaaaacttgaacacagttagttatcaatgccaacgaagatatcttgacctctgtcatatcagaactaactttttcagtagcaagggtgagggcttgagttaatatggacccctcaagcttcttaccatatttgctcactaaagccgtcatcgtgttcaatattacttgagaaataacaacagatttagattccaaaggcattctgtcgagcaaaaccttcatcacattgttaactataggaatagcttcagagccttctaactcgaatttggaccctattaccaacgttaggtggtatctaatatcttcattagtggatgtactgagtaagggtaataccgcattaacaaactcgtcaactggtagaatttgtaacacattgccaagcaccttgaatagaatctcctttatttcagtcgtgtgatctgataatgatgtttcagagtcggaagcttcctcattttcttgggaagttatacatgaaaaggttaattctacagaattaatgaaaaaaagaacaccttctaaaagggttccaaattcttccctgatgtttctaattaactttttatcgcttgtttcatctaacaaaacagaatatacctttagtcttaaatttctcctcacatcgtaataatcttgatctgtttcctcggttattttattgataaactcaaaggtattgttcataaatgtcaaaaattcactttccgaaaaattcaagacaccatttgaaaacaagacacgggattctagtgatttcttcttttccgaggagctctttgatgatgtcaacaatttgatgatatcgagtaagtcattcaaacctgataattcctcattgacatgtagatcaacgagtagggccttaataaactcaattaatattcttgcctcgccaattttaaagttgactaaagctgaagaatactgttgtgcaatcaagaaaaggaacgagcccagtgcctttactggatcaagtgttttgattaacgtagaaaataatttaaccctcctatgtcttggaacatgttgcaaagcggttgtgaagctcaacaaaaggaactccatttcctctttttcatttcctttgctattcttgatcaaggcagggacaacagttagtatcgtacgctcaacaactttagttgtgaattcatcatcttgacgaatactatgggctcccataaaagtaaagataggcattacagaatgcaaaataacttccgaacttaaagtagcaagagatccaattacaagtaatagtttgttttggacttgcggagatgcagaatttctaatagcggataccaatatatctgcccttacgttggttagttctgtacagccatgttccttcaagtatgtgatagtgttcagcgtacaagaaatcaaagtttcttgcgcatataaaaccggtaatccaccgtcttgatccaaagtttccagatctgataataaggaaagtaaagtgaacaaaagcttttcggatccaacatttctgactttatcaagtgcttccaaaataatcgtcaactttctcaggtgcaattccgccagttgcgaaacctcctctttcaaaaatgcgtttttacttgttgatgaacgtcttcttcttcttttagaaaagtctgtctgatccatttcgttactgatactgttttgatttagtatggatacaaaaatatcggaatctaacggcaatgattgtagtacaccgactgtatcgtacgatgattctacgttactcgaagaatccacgatattttggacgatttttagtttttgagcattatttaatgaagcgaatatgctgataagcctctcggcagctatgttagctaactgctcataatctgagttaagagcactgagaacaaaatcgatcatgaatgactgcttttcttttggtgataccaaattaactaaagagcgctcaaaatgctcaaagtttgttttattagcaatacaactcttttcccaactagatctgttttctaagtagtgggaaataaattcctcaaatagggaggaataagaagatgcataagtcggactcttgttcaggttatccaacaacactgtcttggcatacggagaaggtattagtagggcttgattagcccaaaacatcaaaaagactttttcatttctctttggcgttaaaattctggatatgtcataattctcagtaacgtactcattcaaaaatcctgataaccatgcctcactatctttgggatttaacataggaatggtaacgttctctccgtaaagtttatcagacaaaaagtagtgcttagtggatggtcttttagcaatcaaggaaagaatcttcttcacgccagtcctaacttttatagaagcatctcgcaaagcgcaaatcaagcatggaactaaagtaaaaatattaacttccttttcaatactattaatatattttgcaatattgtttaaagatattagctttagcgcggttggagcggctggagatatagttactcttaacaaaaacgttattcttgattctaaagtagtgaaaaatgaagtcaagaaggaacttgctttatagcctttaccaatagcttcagtgaataaagataaaacctttttgtatctttctccagtttctgttagcatggacacattcgttgtgtttatcaattctgaatgcttatccaagaatgtttgaaatgaagcggtatcctttttagtagtttccacggggtcgcttaactgctttacaatgtcggtgttaacatcggcattagtgaacaaagatgtagtaagcctgatttcgaagagttcgcctgtcagtcccaatgatttcaaacattttaacaccaaatcttcatttatggagataaaatattcgaatagttctactaattgtgacttgtcctctaaaatttcggaaaggtaaatcaaatcagtgattatcaacctaacttcgtatctttctagtcttattttttttagtaggctaagaataatgttcaatttggaccgatcataccttgctatggatcttgtataggaagtaatgaatttatcacaaactggtttgtcttccttatctaagaaggttagtatagacacagtgtcgaacttgctatcaaataacttgaaaattttggaaggtagctgatctacgttaccttgtccttttaatgtttggaacagcttacaaatcgtgaggagtgctgaatgttttgcctctttagcatctaagtttgaaagaatggtttccatggcagctaagataattgttttctttaaaggcaaagctgtagcaaatacaactaatatggtatgtgcagctatttgacaatcctttgatttagaggctaaaagtttagcagatatttcaagtaagattggaacaagctgattcagtttttcatcgttgtttgaattgaaagcaacaacgttaataaagcagcatgttgtaaataaaagctggttagtatacgttgcattatgcttaatacattgatccaaataactggtataaagtttcagaaaatccatgtcattaaagagctttatcatggttagcgccgttgggggcttttcacttctaacaaaattcgacaaacaattaaacaaagggggcaacttaataatgctgagaattctcttaaagacaggtgtttggtagtagttgagagtggacaaaagcagcatctctgtgtttttaacatgtatttgaaaacgacgaaccaaccattctgttgcatgtagtgtaggtgctaaataccatttagaagaagccaatagcaagtaagcattgatagcattatccaaatctttaatttcttcttttgtttggacatttctatcaagagaaatggaagactctgaaaagagtgttcttgagaaaatggcaaattttggctcaatttggctcaattcttcaagagccttactagcgttttcaaaaatgaaatcgtaatcttgtgttgcagccgtctttgagttataaatcaaagaagcagaatgaagtttttgtcttctctttctatccaacgcaacagtagcattgttggaagcaacttgagctaattggtcactcaacgaagacattttcaaagttattcgtactttggtggccagttagataagtctgattctgaaaggtaataaagaaagtatttgttacaccttcgaaaatatctagctcatcgctaactgaaaatttttttctttgcttaacgcagaaagaaaaaagaaaaaaaaaaaagtcatgtgacttgaatattattaatctatgtatgttatgattattggctatgaaaccataaaattgaaaaaaaggattcataagctgatatgttatttgtacttaatgctatatttataatttacttttgaaatttttcttagtgggtcaaagtcttctttgatactgaagaatgacccaatggcaacacttggtccattggttaacaagtttctaacgaagtggaccttgtgagagcttataaactgaaaagaccagttttctttttaccaaaggggtagacaaagagtgaagaagcaaatagtcccacagaaataccgacacaaacttgaatcattgtcataccaaatgacattgaggacgatggatcggaggtgcttgtcgtaatggtttcattagcattaacaattgtatttgcactttgcaacccagacaacaacgaattttgtgaagcaataccagatggcacttgaacgaagattgcgggaagcatagctgataccgctaaacctttccaaattctggaatatagattacctaaaacacctatgacaaatgcagctaaggcggcagtaaactctgtcgaattcgcaaaatgcttaccggcccaatatgttacgacataaccggtgcaagaaatgaagaccataactggcagttgtgagatgtgtgcttgatttaataacgagatactaatggtaaacgctggaacgaagaggaacctgaaccacggagaaattaattgaggacatgaaatttcgttagtggcattgtgatacatccatccaaacaaagctgagcccaatgttatgccaaaacccaaaaacaaagaataaataatggcgtagaacatacggaccgcgccagcaactaggcttcgactttgcagttctagtgcaccacacagaataatataacctggcaggattaatgccaatgagccttgtgtaactgcaccaaagcagatgtgagaacgagggatagagccaaaagctctaccgcagaagctaacgacaatagatgcagaaatttcgaagacgtttgaatacatgtatgacttttgtgaaagaataaattgtaatgaccccacacaaagccccataaaaaatgagattgccaggtttacccaatcgccaccaaaggcatacggagtgaccatagcggaacaaaatgcatataaaagaacacacatccaaggtggatatagattcgtgtcagccaaaatttgatcgagtaaagcattaccttcatcggcacctaaggtatcatggacaactcttttgtaaacggcatgaacttgatgcagcttccaaaggtttagaccttgagtacacctaaccaattgaacttcggaagttcttgttgttgcatcaccaaatgaaacaatcatacaacctggaagatacaaaactgaccatctatttcaaggactctagaagtcataaccatatattcttcaagcctatgcgtcggagcaccatacatcataagagctctacacatgcgtaggatgaaccggtgtctttgtaaaatgtctgcaatgtgaaccgtaattttcgcttcagtttttagtcttttcttcagtctaggcattctgccttttttagccttgccttttaaattttgtaatctgctacgcttggcaactggtacgtctttgtttccagcagtagaagaaataccttcatcatctgttgttacagcttgtgaatctgaaaagattgagcttgaattttgatcttcattttggtaaagtttcaataatgaccctagtactccacttttcacttgagatggagggggtacgtatgtggaggtttcaataaacccttcgttatcgtcggatgaattgttttctgcataatcatcaaaatgatccactgcaggagccagaaatgaattttttgaacttgagcctaacgtttcgccatccgacgtacaatttacgtcaccttctaatttgagagcctccagtttttctttatcgtcgccctcatgaacgtctacgattttagacgcatcagctagatcggataagggaatttcttcattacggttatttttttctatatcattcttcccattttcattttctgaaggtattggtgccaagccagggaccaaacccccttgatttccagtcaggttatttattatcttcttgatgaacgtctcatcgtctccatccttaccattgttccttaaatgtgtgaaagaaactttaggcttcctcttgtggcgagcaggcctatcttcttcatcttgtccatctgtgcccttagaattatcgctggtttctgtagatcttgaagacaaatcattttctagagcatccgtatcagcagtgaatcttacatttttgttatcattattagaaatacctagatcactgatgcttttaccacttaaattgccttttttgctctcggctgaattggaagtgcgatggtcactactatcttcaagattcactcccgcttgactttgctcggagcttcccacccgaaaatctgacacaggagtggttggtttttcatttctaccgtccattgtatagcctatcggttattcgatcttttttcttttgttattctatatctaaaagataaaagtcgcacaccgctaagtaagtaagtaagtgttatataagatttatttagctacgttctcagatatagtaggcttaaaacaaacgtaaaacatagttatatattaatatgcaattcggtttatttctttttcaagattcttccgaatttcgtcatattgggttcgcaatttttggcgatggctttgcttcgatatttttcggatgaaaatagtcaaaggacactagaaacacgaatggcgcgctgattacggagacgtcgggctaagacaaagagggtccattcggcgtgctggtggtactgtgacagataaacccaatgccccacttttctcgaggagttgaaacaagcgggacaactgctacgtcataaaaatgggagtaccaagggaggagccataagccgggtaaaatttggcgctgtttttcttaatctaaaaatagttcaacaataaaatttgggctccgcccatccagaccaaagcaatcttcggccttaacaagccaaagggaacgaaacccagactctaccatgcatttcgaacatgttgtagctaactacactggtaacccagatacctattctctcagtagctgtttcaccaagactccgcactcatggtaagtagaaaaagaaaactctcacaaaaatctgagtggcacagcttttccaaatacgctttttaaacttggagaaataaagatgtattacccgctggtgccttaaaatatccttttctccggttgtccaataatttatgttacggcggctatttgagtttttgtggaaatctctatcattaataaatgtcagccttgtgtcttaaatgcaattcaacagggaaaaggcgcgagacttcggcggcaaaaagccacagacaagtgctggttgcaaagaggtaaagaagtaatgtgtgtaatcaaatagatatattaaggtagcaactcaccggtctgtccattttcttttcctgaataacttcttctgtcttcacacattcatttcatttttattttccaatatcactcaacgagaaagaagttacaagatctatctttcaaaatagtttacagttacctttactttaccctttcccttttcagtttgttaccccttctcctaaaagttttattttttgggtaaagatataaaggacactccagtcggttaaggtggctgtctagagaatataaacctgtatttatttaccaggcttatcagaaaagttaatcgtgttcttaaatattcattgaaaaggaacgtgatacagacgtaataaaagaagagtactaagcttaacttaataggtcatttatggttgaaaaacgtagtagacagagttccagtagtggctcagagttcagtgttccacctgatgtcgataacccgccactttctatccctttgaagactttatcagacagatatcagctgatcgaaaaactaggtgcaggatcatttggttgtgtaactttagccaaagcgcaatttcctttatcgaacatattgggtaaacaacatgatataaggggtactttaatggatcagcctaaaaatggtcaccaaaactatataacaaagacacaaggtgtagtggctataaagacaatgatgacaaaactgcatacactccaggattatacgagggtcagagaaattaagttcatactggcaatcccagcgaatgaccatctgatacaaatttttgaggtctttattgactctgaaaattaccaattacatatcgtaatggaatgtatggagcaaaacctatatcaaatgatgaaacatagaaggcgccgagttttttcgattccttctttgaaatctattctatcgcagatactggctgggttaaaacacatccacgaacataatttcttccacagagatttaaaacctgaaaatattcttatcacaccaagtacccagtattttgaaaaggagtacatgaaccagattggatatcaagataactatgtcattaaacttgcagattttggtttggcacgccatgttgaaaataaaaacccgtatacggcctacgtttccacaagatggtatagatcgcctgaaatattattaagaagtggttactattccaaacctttggatatttgggcattcgggtgcgtggcggtggaagttactgtattcagagctctcttccccggtgctaacgaaatcgatcagatatggaaaattttagaagttcttggtacacctatcaaacgttctgattttgttaatacaaaccacatcacagctccaccacctggtggattttgggatgatgccagtaatttggtccataaattaaacttgaaattgccttatgtagaaggttcatcgttggatcatctactttctagctcccaactatccgatttatctgaggttgtcaaaaagtgtttaagatgggatcctaatgaaagggcaacagcccaagagctttgtgaaatgccattttttgaaaacaccgtggcatcccaagtagacgcaagaggcaatgtgactaatacagaacaagcattgatttttgcaggtataaatccagtagcgaccaacacaaagcccatatattttaactcttcaacaaaattgcccgcagaaacagagtctaatgatattgatatcagcaacaacgatcacgattctcatgctatgtgctcaccaacattaaatcaagaaaaactaactttggtagaatttttaaacgaattcgttgaagaagataatgatgatcactcaatacctgatgttggaacagattctaccatttcagattctattgatgagactgaattatcaaaagaaattcgtaataatttggccctttgtcaactaccagatgaagaagtcttagatcattcattatcgaatattaggcagttgacaaatgatattgaaattataaataaagatgaagcagacaacatggaacagctattttttgacctggaaattcctgaaaaggatgagtttcagagaaaacaaccatttaatgaacatgcagatattgatgaagacatcgttctaccatatgtgaacaactcaaattacacacatacagataggtcacatcatagaggtgataatgttttgggtgatgcctctttaggcgattcgtttaattcaatgccagattttactccaagaaatttcttgatacctacattaaaaaaatcacgggaaaagttcgagcctcatctatccaattcaaaccaacattttggaaatgtaaccttctaataatttgtcatttgactgacgaatcgttaggcacagttatatagttatatacacatagacatacatatgttcgcatatatattatattactatgcattcacctaaatagctactgctctattaatacagtgctttttcgatggctttaatttaacttattagacattactttgcgtttattcccctccaatatatttttatgtttgtttttcttgaacattttatgatttcttgctcttggcggctactgattttgttaagcaactcatcaagaggtcaaaaaaagtagaacgagatctttgtgttcggttacccggctcagatcctaacttggtatgtttattcgtataagttactgttgtccacaggcaatactctgcagaaaattaaaacggcattaatgctaggacaaccagaactgttactactgtatgtgcgatagttgataactgcaacattatgcccggtatattctcaaaaaaccctattactgcatacgaagaaatcgcaagagaaatctttcggtttggaaaagctcactgtgaggttccttggagccaatagtaatacagcacaatccaaggaaaaatctggcctatatgcaaggaaggagagatagtcaaaagcattctttcccctagaagttggtgcatatatggcatcgttaaaacatattacccccaaaatttcttctctaaacgatgtgcttggcctttgttttggtttttgatgtcggtcgtttgaggccccttgcggaaaatcgagatcgccgaatggcacgcgagggaagggaaataaggtttaaaggcactgaaacaataggcaagaagtaggcgagagccgacatacgagactaatgtgtccgcgtttctaaggccacttttcaatgaaacggatattgatatgctagtaaaaggacgagctcaagagcgaaaatataagtaaagaattcgagtgcacttgtctccatgcagcaagatttcatatgagtcttttttatctttttactttttacattacacgatatgcactttatgaaaatttaacgaggttggaagccggataatcaaccaaaatcaggcacgaaggcacactcgtatatgcatgttgttgaaactctgttacgctgaactaacaatcacacatgtagaggtcaccgggaaaagttgcgaccccatggaaggtcgatctcttcgtttggctttgcttggctggcggcattgcgcttcttcgcttatacccgtctcttgacgctcgagctcgttcattgagatacctttattcttgcacattttctggcttttttcgctactcgggtacatgtaatcatgcacacagaaggtgctgtagggtgaaagttcctttgtgctgtcgtttgtttttaatgccaaactttctggtgatcaataaccacctctttttccttcaggaaaccttattattgttcttggatagtactaggaagtatataaggaacctcgattttggtattgcacggctatacacatctaagaaactttgtataaaaggtggctaccctattcatagcttgatatcaataggccatctcatcactttttattgaaaaggaaaggagggaaatatatctgattcaaattacttgtttgcttctctttaagacaaaagcatagataatttcagcgtggaacgccggaataagattggtaccctcgtcagaaagttacaaataccgcttcatcttcaaaatgacttcaccggaatcactatcttctcgtcatatcaggcaaggaaggacatacacaaccacagacaaggtcatatcgcggtcgtcgtcgtactcatctaatagttcaatgtctaaagattacggcgatcacacacccttgtccgtcagcagtgcagcttcagagacattaccctcacctcagtatatgccgataaggacattcaatacaatgcctacagctggcccaacgcctttacatttatttcaaaatgacaggggcattttcaaccatcattcttcatcaggctcatcaaaaacggcatcaacaaataaaagaggaatagcagcagcagtagcattggcaactgctgccaccataccatttccactgaaaaaacagaatcaagatgataattccaaggtctcggtaacacacaatgaatcatcgaaagaaaataaaattacaccctccatgagagcagaagataacaaacctaaaaatggttgcatctgcggttcaagtgactccaaggatgagttgtttatacagtgtaacaaatgtaaaacgtggcagcacaagttatgttatgctttcaaaaaatcagatccaataaaaagagattttgtttgcaaaagatgtgacagtgatacgaaagtgcaggttaatcaagtaaaaccaatgatattccctagaaaaatgggagatgagcgattatttcaattttcatccatagtgacaacttcagcatcgaacacaaatcagcatcaacagtctgtgaataacatagaggaacagcccaagaaacgtcaacttcattataccgccccaacaactgaaaatagcaatagtatacggaaaaaattgaggcaagaaaaactggtagtatcaagccactttctgaagccactactgaatgaggtaagttcttccaatgacacggaattcaaagcaataacaatatcagagtataaggacaaatatgttaagatgtttattgataaccattatgatgacgattgggttgtttgttctaactgggaaagctcaaggtcagctgacatcgaggtaagaaaatcatcaaatgaaagagattttggagtcttcgctgcagattcttgtgttaaaggtgagctaattcaagaatatttgggcaaaattgattttcaaaaaaattatcagacagatccaaataatgactatcgtttgatgggaacgacaaaacctaaagtactttttcatccacattggcctttatatatagactctcgagaaacaggcggattaacaagatacataagacggagttgtgagcccaatgtggaactagtaacggtaagaccgcttgacgaaaaaccaagaggagataatgattgtagagttaaatttgttttaagggctataagagatattcgtaagggagaagagataagcgtagaatggcaatgggatttgagaaatcctatttgggagataataaatgcatctaaagatttggattccctaccggatcccgacaagttctggttgatggggtcaataaagactattttaacaaattgtgattgtgcatgtgggtacttgggccataattgtccaataactaaaatcaaaaacttttctgaagaattcatgaggaatacgaaggaatccctatctaataaatcttactttaatacaataatgcacaactgtaagccataaacgaaattttaaaattaatagtattcattttaatcttttttgaaagcttaattttatcatcataatttttcttccaaaacttcaatcttggtattttttttcgcattggtcttcattttttttcttttgtttttagctttaatgttgaaagcgtgaatatcaaaacacttttataataaatcaccactttgtaactatagagaacaattcatgctttatttatagatgccacgattaagcatcaatcattagttgagaggatccttaacgttaaaatccaccgcacttttcctttcaaaaagctgcattgtttccataattcatttcatggcaggttaatgacttatttgatatgaagagtgaggttcttatcaaatgaaattcctacatatgaattttttaaaagagagtttttcgttttacgatatttatttacttcatcatcgtttatcatttttcacgtagcaaattttgaagcttcaacttataactcatttgcatccgattcacatatttcagctgactataaatttggcaacagcttcgtgacttgagcataagaaaaacatagacttgttggatataaaatatggctcacagggctttcatacaggttataatcacaggaactcaagtttttggaaaagcattcgccgaggcgtatagacaagcggcttcacaatcagtgaaacaaggtgctacaaatgcatctagaaggggaacaggaaaaggcgaatatggtggtattacgttggatgagagttgtaaaattttaaatattgaagaatccaagggcgatttaaacatggacaagattaataacaggtttaactatctatttgaggttaacgataaagaaaaaggtggaagcttctacttacagagcaaagtttatcgagcagcagaaaggttaaaatgggaactggctcagagagaaaaaaatgcgaaggcgaaagcaggggacgcttcaacagcgaaacctcctccgaattcaacaaattcatctggtgcagataatagtgcaagcagcaatcagtagtcaaggaagcctccatcattacgtcacaagtgttatcgaaagcatgcagcagtgcatatattttcctagttggttgcttcctgtacgttaggaatcttcaaccaccatccttgtatttagttaatattagtatatgtaccaaagtaaatatactcagatgccatctcgatatacgcaccgtacacgaaaatgaaattaaaaaaaaaatgttggagcacaagcaaggcagcatcagaacgtaccgtcagttggtaccaagacaagtccatccccgtaggcactacaaattatgggaatgagaaagtatacaaaatataaactgtcttatcatgaagaagagtcgcttaggaatttaaactttcaaatcgcattacgcaattctctaaaaacgcgaacctttccctgatatgtaatcagggaatttcctcagaataatattcgatctaagaaaccggaaacgaaatgaaaattgttactactttgtttaggagtagtcaaagttcattcagctatgggttatgatgaaatgatttaaattattctcgctccagtattaacttattacgtaatatgagcttaaaagagcaagctcctcatcactcacactccataacatgaagaacgaaaataacctaatctttaggtttctatggtataatgaaattaatattatctaaagatagtattaaccactactgatgttagccttttgaaaaaaaatcaaaagaaaaatttgaattttaaagaagaagtaacaaagggaagaagtttttgccaatcggacaacactagctctatttatacttttctgttgctccaaaaacaggaaagaacaaatttttcaatttagtgtgacccggctaataataaagagggaagtaataggtagggttttactggcaagaaatccatattgttgctcccgaataatattataaattcttgtaattaatacaaagtttctagatccaccttgtttaaaaatataaagttatgcttaaaattcttcagggaagaaggttttcaatggatgattttacatttttgacgaattcctgagaaactaaattacaatgtaaaactgtacataaatataaatattattgttgatacggaaagtaaaataaaaaaaagaaacgctaaagaatactgaattgccaacctaagtaaaaaataagcgataaaatcaaagaaacggacagaatgcatataaaaactgtaatcagtaataagcccaaaaaatagtgatcagtccatttcaaaaattggtaaaaattgtcccattacgagaattgggatattaaacgagtccctttttactgtccaacaacaggcacacttcaaataaagaccgttacttaataataaattgcacttagtaaagattgcttttccatccgtagtaaaagaaaacccttctgtaatttttgacgaggtagaagaacatgcgttcaacatcaatagttttttccttttattgatatcattgtaaccaaatgccagcaattcgttaaatatttgaaagtaattcgaaacgcttttatgatccagatattcaaaaataaaggaggtgcggtctaatagtaaatttttgttaaaacctgttaaagaatagaattcgttactgacaaaacaaatctcgcctgatcttctccagatgcacatcggtgtgcagcttactaattttgccatgttctccaaatctaataaagccctttgcaaggtaacttcctgtaatagcaaatcctcttcaatcatattggatgttaacgaaatgaaaattggagcatatctttctagtatagagcgtattataacttctaaatcatatctcaaattatgcttttgggtactgtgttcgtcttttactgaggcagatttatcaatttcagctccttcaagaaatttttttcttaaagtagttagcagtttggtgtatgcgagcttgtaattatgcggttttattaaacatttattgtcatataggtcttgaggagtctttactaattcacgaaactttgaaggtgatatgaaatcggtatcatgtttctccagatctgcatcggagtgactagaactgtcacattcgctttccagtttggcgttatgtgatgggtgtgtattagcgtttgctccacgattcaaatgcagcatgtctaaagatataaagggcctagacactacttcatcatatgtattgaaagtagaagtggaatggccgatcgaggagtccttttggtcattcacgctttttgtcgagtttaaaaggttcgttaaatgcaatgacgaatttccccgtgtagatgcgctaggattgggatattctgattcttggagggaaaatatctgggagttattcggtaaaaacggcgttgaaatatctactatatcctttaatttcatgtattcgtcattgcaccacatactatcaaagtgaatattagtttcgtcatcgacatcatcgtcactcttattactatcgtccattccagagtgcacaggaacgtttgaagtagcaaccaaacaattggtagccagcggctgctgcattgctttatgttgctctaggaaatgcgactttaaattgagagtactcttccgtacggtgggtatgatggggtcattcattaaatgtactgcttgtgaagctgatatattattagaagtattttctaagacggtctggcggttattcgtattgaagttcgtaatacgtggaatagatccagcgctttgaaagttatcatttatattatacgtatattggatattcgtattgtgggcaggtgttttgcctggtttttcctgatctgaagatagaaaatctcgctgcagatgtacgcttgagggggataccgtcttcgacggcacatcatgtattaccagcctcttccccaaattcaagtatggttgtgttccatgcttctcaattcgttttcttgatttccttttcttatctctgcaaaacttcccaatatttctttttaaacagttttgacatggcctccctacgtcacactgtatatgtttggtatgacagaattcacaagctgtctggatagactttctcgtctgtttcaactctgaaggtagttttttggtcatatgtatatatattcttgtatgctgtatccaaatatattatttctttactccctttattgctaagctgtaatacgttaaatcattcgaaatatgatctattcatgcaaaaacttgatgtgtgtaacaaagaaaatatccggttcagagatccgaacaaatgatagtcgtacccttccccttagtgttaactcgtttaagcaggctatgatgattagtaaatcgtttcagcctcttctcatttcgacaatttttgaggccttcccttagtgagaggggagataaccaatcagcacagagaacgacgacggcgcggaggctgggcggttaaaagaagataatgtgaaatagatcaacaagctttctggtggcaaaacggcagtcagagatatacaaaaggggcaagataagtgagggaggctatgtggaaatggaatgtgcgcagatgggcgggcgcaagagtaaacattagcaagaaccgattaagtgtaattaacgttggaagtagatacttatcgaccgcaagaagtccactgtctaaggttagaaatataggaattatagcccatatcgatgcaggtaaaactaccacaacagagaggatgctttattatgcaggaatctcaaagcatattggagacgtcgacactggcgatacgataactgattttttagagcaggagagatcccgaggtatcacaattcaaagcgctgcgatttcattcccatggcgaaatacttttgcaataaatcttattgatacgccgggacatatagattttacttttgaagtgattagggctttgaaagttattgattcatgcgtggtcattttggacgctgttgccggcgtagaggcacagacagagaaggtttggaagcaaagtaaatcgaagcccaaaatctgctttatcaacaaaatggatcgtatgggggcgagtttcaaccatacagtcaatgacttgataaataaatttatgagaggaacaactaccaaaccggtgttggtaaacattccttactatcgaaaacaaccgactagcaatgattatgttttccaaggtgttattgacgtcgtaaatgggaagcgattaacctggaatccagaaaatcctgatgaaattatcgtggatgagttggatggtacttctcttgagcagtgtaatcgttgtagggaatcgatgatagagactttgactgaatacgacgaagatttagtccagcacttcttagaggaggcagaaggcgattactccaaggtttccgcacagtttttgaacgcttcaataagaaaactgactatgaagaatatgattgtacctgtcttatgcggtgcgtcttttaaaaatattggcgtgcagcctctattagatgctatagttaattatctcccttcgcccattgaagccgaactaccagaactaaatgataaaaccgttccaatgaaatatgaccccaaagttggatgtttagtaaacaacaacaaaaatctttgcattgctcttgcattcaaagtgattacggatccaatcaggggtaaacaaatattcattagaatttattcaggtacactaaacagtggcaataccgtttataattctactactggggaaaaatttaaattgggtaaattactgataccccatgcgggaacatcacaacctgtaaatattttaactgcgggccaaatcggattgcttactggctctacagtcgaaaacaacatatctactggagatacactaataacgcattcgtcgaagaaggatgggttgaaatcacttgataaaaaaaaggagttgacgttaaaaatcaattctatcttcattcccccaccagtttttggtgtttccatcgaaccaaggactttaagtaataaaaaatcgatggaagaagctttaaacactttaattactgaagatcccagtctttcaatttctcaaaatgatgagactggccaaacggttttaaacggtatgggtgaattacaccttgaaattgccaaggatcgattggttaatgacctaaaagcagatgttgaatttggtcagttgatggtgtcctacaaagaaacaattaattcagaaacaaatatagaaacgtatgagagtgatgatggatatagattctccttatctctgctaccaaattccgatgcccttcctaactgccttgcatatccattaggagtcaacgagaattttctgataatggaaaaaaatggtaattgggataaagaatggaaataccaagtttctttcgaatcaattctaaattctattattgcaagttgcattgtgggacttcaaagaggcggaaaaatagctaactttcccttatatgcatgctccatcaaaatcaatagcgattggtcagtcccacctgatattgaaactccacaagaaatcttaaaaattactagaaacttaatttttaaagctctcaatgacttaaaacctgaaaaatacaaccttctggaacccatcatgaatcttgatctaacaatccctcaatctgatgttggtacggtgttacaagatctaacaggagcaagaaaggctcaaattctgtctattgaagacgaatcaagcgtgtcaaattctggcgcatccacttgtaattctccagagaacagcaataggatatatattccctctgatgctgttacaaccctacacgcaaccaaagataaaaaaaacactcaagagaccagttctaatgtaaaaaaaattataaaagcgaaagtgccactaagggaaattaccacctacaccaataagctaaggagcttatcgcaagggaggggtgagttcaatattgaatattccgatatggagaaagttaccaacgatcgcctacaatcaatacttcacgacttgtagcaaaaatgtccttaataaacgccttgttatatctttatcaaaatggtttttacaactatcgaatagtgtgaaccgataactgtgtagttgtatattaatagaactttacttttgcgcaggaacaaacattttattgcgacataggcataccttgccctcagagatctttatattcttgttcctcgtggcccaatggtcacggcgtctggctacgaaccaggagattccaggttcgagtcctggcggggaagaatattctttttgtcactaacacaaccattctataaattgaagagaaaaattaaatggccaatattctacgtgcttgttattagaaactcgcaacaattgttctgcaaggcccctcatttttttttgctatataaaataataaatggtcacgttggcataagtttgtgtagaaatgcttaagatcacttgcaaaaatataaactgaataataaaaaaaagaggtataatactggtcgttgctttttcaatcaccgtgtcacccaaatcgataatgtcaactttctttcacaaccgaagtaaaaggagtttaacatttgctttctattgaaggcttatttttttttacatattctgcaatttcagctcctaaaaaggatgtcaattcaccttttgaatcgtctaaatgggtaagtctatcacacgtagaaagcaaatcataattgatcgactttgaaatttttgaatcatgtttgtaatctggatgttgtagtacaaaatttctaaagaattttgctgttgttggcaattcaccgcttgctctatcagaaattagctttaaataatagtatagtctctcgtgtttggaagaatgctttaattctttccaatctttggttacaaaccctttttggcataggattggcgtaacaaattgaggaaatataccattctctggattatggaaaatctcgcttatagaataatcttcagtttccacatcggtgtcgttgcgaaatgattttttccaatgaaatttttcaaataggatagcatctctgtgatgggctatcttcatattttcccatactttggacatatgaatatatgcgttaatattatcggaaaaggtcaaaatgctatcgacaatcaagtatatgagcacggaatacgcagcgttctcaaaatctaatagttgcacttcaaatggtctgaattccactctccaaccaggagaatcctttttgtccggggttgcttgttgtgtggggggtttaaaacgtaatgtctgccaatttgtactttggatgttttcaaagtgatttgaagacgttttgttgtcctgattcaacagttcttcgaatgtagatactggatctcttatgtagagatgcgcaaaatgtttagcaagatcatagtccagtggcgccttatcattctctagtagtcgtcctaatactttttcattaataggtacatttgtgtcgttataagtcctattgaaaaatttcgacccacccaagaaaagatcaaccgaactatatcttgactttggtatttcaaggactttatcttgtacgtctttggcaatgcctccaaatccgttcttgttgtatttgggtagtaatggcgcaacacctctttccttcggagtacggtcgtccaccgcaccagatatcacattccaacgaacatcttggtcggctagccaacctttaaaagcaggcgcagcggcagagaaggctagcattataggtgcaaaattcactaatgcatcgtacaggtaacgtgccttgttgatattgggtgcctgaaaggtcacttgtaagcacgaacagcccatgccaaaacccatggaatccatataaatgaaacccggtttggaagccagtttcgcctctttgtcttctggtaaaaaccaatctcgatcgtagatggagtcatccgtttctggagtagctatatctttatacatgggaacattcatgcaaactttttcaccacgcctggtcctgatggatgctgtcaagttaggaaacctgacatgtctgttaatgacttcatcgggtaaaaacagagacctggaagcggcatttttatgattccacggatccttaatgttaataaagtcggggcatcccatcctcgggaagacagtcagcgtcaaagggacagacctggagcccacatgcaagttatttttactatcttgtctcgcatattcagatagcttatattctgcaatggcacgtcttttttgcatgttaacctcaacgtaactacccacgtaattcaaatatggagaagctggtgttgcctctaacatataccggccatactcagggtgaaaactcacatcgttagcctcacaaagggacgaatcctccatattaagctcagtgagtatcttgtcatggcaaacgtcgagcatagaatttctctccttatcatcaaaatctacaaccatgtactcaagctcgtctccccaaaaaagagggtcattgtctcttttaccagcagcttggaaaatatacaacaactgctcgataccttcatcccttatgtgttcattgtacgtcctagactcaaaccactgcaaaggcgtgcccaaagctaagagtcccattttattcttctatatgtatattttcgatactctaaaccaccctacaatgtagccctatactaaatctgctcaattttcagcttctacaagtgactcgagaccacgtggaaagatccaactactccagcacaacgattcaatataatcgattgctccactcataagaggcaagaacaagcttcaacttttggtaagccgccgtttataaacagggaagatgtcctttgtcaagggaggcacagagcatggccaatttggcaaattgcaggtttttctgagtgaaaaatgaaaaagcattgtagtagagtcggctcactgaaaaaccggggaggacgaaaaggtttccagccacagttgtagtcacgtgcgcgccatgctgactaatggcagccgtcgttgggcagaagagaattagtatggtacaggatacgctaattgcgctccaactaccaaggttgttgagggaacactggggcaataggctgtcgccattcaagagcagcaacaggcatgggaagattcgctttttttttttgaattacaatagtatgtctgatgtctgcaagaagtaacaggcgtgtgcacaagaatacgtgtgtgtgcgtaagcgtatgcactggtggcataacttatctaagaagtatatatcactgacatagaaatgtagatatacaggtatttttctcgataatcgataaaaatctcgtcgcgctgaaccaaacttggtggttacggagagtttttctctcatcattactgtctttcgcattgatttcccctttgaccgataaaatcccttggattcataagattaaacaaagaggtgatcaaagagaaccctgtgaaagtttatgtttataaccgggcataaagtgaactagacactttcaagaagccaaccaaagcatgagtaacgaagcttaccagcatgatcataccgtaaatcctcaccagaagatagttgtgaacagctacgattggttacagttccgtgatgagcaagatcactgtaaaagtaagaacccgataacgcacgcttctccaggggtcggttcgaatgcacagaattcagacatagcggaggcccctcaggtattccacccttcctatcaatctctggtcaacgtaccgtccgagagcccgcgacctgatcagacttcagggtccaatcctgccgttggactgcttcataatgcagaggacaaagcgtcagggcaagaagaagaaggaagtcaatatgagattcaatattcggtatttcgtccgctgcatgcatatccaaccaagggcctagcatatgagcagctccgaagaaaagaagaacaagaacagagggaaaacttcaaccatttggtttctgactgtattgaggctgtagagacatttggacgcgaactcgagagaatccaaactggctcaagtgggtcgtactttgtgtatggaacacgggccgacgaaagcgttccggtgggggtcttcaagcccaaggatgaggaaccatatggcccattttctcccaaatggaccaaatgggcacaccgcacgtttttcccatgtctgtttggcagaagttgtctgattccaaacctcgggtacatctgtgaaagtgcggctagtttgttggataggcgactggaaacgcatctagtaccctatacagatactgcatctatagagtcttttaatttttatgataatagaaaaaaatgggtattgggatacaaccttcagaagaagaaacaaaaaaagctgggttctttccaactttttttgaaggagtacatcaacgccgatgagttctttcataaatacccattacctgggatgtattcagatgttaaacattcatttcatcgtaagtcatccggcgaagatatcaatcataaaccagagacaaccaggaacctaacagatgagacagaaccgtccaagcaaataaattcctctccaatttcgacggaatctgaagaaaattcgaaatttgaatggacagaatcaagtttgagtcagttcagattggaactagaaaaactaattatccttgattatataatgagaaacacagatagaggtctagacaattggatggtgaaactaatcaaactttcaaacaataagtggagactcaagttagccgccatcgacaatgggttgtcctttccctggaagcatcctgatgagtggcgtctgtacccatatggctggttgtatttgcctctgcaactactagccaaaccattttctgagcaaatgagatctcatttcctaccgatattgacaagcactaattggtgggaagagtcgtaccaagaattcttggccctatttagcagggaccaagattttaacgtccgaatgtggaagaagcaatgggcagtattaaaaggacaggcgttcaacgttgtcgaaacattgaaagacccacgacaaggccccttggaattggttagaaggacaaggtgccaggtaatagatgagaagatgcaagttccctgttgcccacctccagtttctattttcaaaaacgccatagacgaacctattggatcatattccacttcaccaatggtactccctagcaccccaagcacaattccatttcatgcacataaccaaagcaatagtaatcctgtatactatgattccactctgcacccatttgctaataaaacagtgatagcagagcggctacaaatagtcaattccacccccgtattcacctggtgttgattttttggaaaataattcaatacatactcaatataaagaaatcataactctactttagcatataggaaatagactctttcgaaaaaacctctttctgtagtgttagaaagcaaccggctattatttttgtgtgtcttcgaaaaatcggaacccaaacagatcttagcggattcatggtaaaaatagccttgaagaatttaggaaaataaatagatactcaaaaaggaatagaggatcttaacaaatcattacattacttaactcacattaaaagcaaacacctttcttaagctgttggtgcaaaaaaggattacatctattgcccttatgaatttgttttggccatcggaaaccaaaaagcaaaatgaaatacctggtggcgattatacacctgggaactcaccttcagtacaaaagggttatcaattcctcaatcgagacatatttaaaagttgtccacgaattatggaaaggcagtttggtgagtgtctgcacaatagaacgcatttaatcaaggatttaatttcttctggcaatgttggactaggtcccattgagattgttcacatgtcctacttaaacaaacatgaaaaagaagagtttggtgaatatttctacgttacagggatcgaagtttccggtcctgcaatgcccgtagagtttcttgaagtgctaaaatcgagtaagcggatttccaaaaatatatcgaataatatcatattgacttattgctgttttaattttttcagcaatctagacatccgtattagatacgatgctgacgatactttccagacaacggcaattgactgtaacaaggaaaccactgacctgaccatgacagaaaaaatgtgggaagaaacgttcgcaagttctgtcatccgagcgataataacaaatactaatccagagttaaaacctcccggtttagtagagtgtccattctacgttggaaaagatactatctcctcttgcaaaaagatcatagaattactctgccgattcttaccacggtcactgaattgcgggtgggattctaccaagagtatgcaagccaccattgtcaataactatttaatgtatagtttaaaaagttttattgcaatcacgccaagcctagtggattttacaatcgactacctgaaaggacttaccaagaaagatccaatccatgacatatactacaagacggctatgatcacaattctagatcacatagaaacaaaggagttagacatgataactattttaaatgagacgctcgacccccttttatctctgctaaatgatttaccgcctcgcgatgctgattcagcacgattaatgaattgcatgagtgacttgctgaacattcaaacaaattttttgttaaacaggggtgattacgaactagcattaggcgtctctaacacatcaaccgaactagccttagactcttttgaatcttggtacaacctagcgagatgccacatcaaaaaagaggagtatgaaaaggctctcttcgcaataaattcaatgcctcgtttgcgcaaaaatgatggacacctggaaacaatgtacagtaggtttcttacctccaattattataaaaagccattgaatggtacccgcgaacactacgacttgactgcaatggaattcacgaatctctcgggaacgttgaggaattggaaagaggatgagttaaaacggcaaatttttggaagaatcgcaatgataaacgaaaaaaaaatcggttatacaaaggaaatctgggatgatattgcgataaagttgggtccgatttgtggtccacaatctgtgaatctgattaattatgtctcccctcaagaggtcaaaaacataaaaaatatcaatttaatagcaaggaatacgatcggcaaacaattgggatggtttagtggtaaaatatatgggttattaatggaaattgtgaacaaaattggttggaatggcttattaaacatccgaacagaagctttcatgatggaaactgaattctatcaagcttctaacaacattatcgatgaaaacggtcatataccgatggaatcccgaaagaaaaggttttgtgaagggtggctagatgatttatttttagatttatatcaagacttgaaattgagcaagattagcctaagcaataaagatgaaaaacacagcggattagagtgggaacttttgggtttgatcatgctgcgtacctggcattgggaagatgccgtagcttgtctaagaacaagcatagtagctcgattcgaccccgtaagttgccagcagctgctaaaaatatacctgcaacctccaaaaaatattcaagaggttacattactagacacagataccataataagtttattaattaagaaaatatcatatgattgcaggtattataattattgccagatatttaatctgcaactgctagaaaagctatgcaacgaattggggacgcatatactgcgtaataagatccttcttcaaccttccataggagacgaaatcatggtcatgatcgatgccatgcttgcgtggatagccgacctagatcacacagtacaaccttgaacaaaacggtgctcttagtattattatataaccactacggttggatggactgagggtaagggtaaccgtataccttttatttttttttttacattttgaactgggaagaaaattttttttgcgagggattgacggctaacgccaaaacactccgaagagaatgagaaaagcttgggcatcgctcgaagtcatcgaacgggactatttttgtttaaaatttcaccagatctgcttgataagggtagtttagcttgtgtatttgggaaaggtacgcaaaagatatattttactaagatctttaaatatttttagcttgaggtaatacatgctaattttagttgattagagattctgaaaaattcgttttagttagtgtttaagaatagtggcgtttatcgttttgcccatttaataattaggaaaaaatatgtcagggtccttttggaagtttggacaagattttggttcacagtctccattagctaaactgttgaacagggctttcattaagatcgatgataagcccactagtacggaagcagggaaaattgactctaatagcacagatgaaagtttagaaagcaattcttttaaatcagaagacgaagaagaagaatatgagctgcctaacagagaagaagactacaaagcttataagccaaacctgtctctactgaatgatcttttagatgatgaggagttatatacagaactgatgtgctcgaacttcaagctactagtgtacttgaagtaccctgaagttttgtccaaattgatagattatgtcagaaatagtaccatacttgagtccaatattgatagagttacttcagaagacagagatttagtacgtggtgaagacaaggacacaacggaggactttgagaatgctaaagcagataagaaaaacattgatggtacttttgaagaaaaagaacgtactcgtagtggtgaagaagaggaactggaaaatgaagaaaatgatagtgcatctgaggatactagagtcactctacctcatgaactagaggaacatgatgatacgcgaagagccagaatagcggccgaaatattgtccgctgacgtgtggcccatatcatctgctttgattgaaaacgaaggacttctcgctaagctttggtcgatcctcaggctaccttctccattgtcaattgaagcgtcaacatattttatgaaaataaacgaacgcctcttggatatgaatatggacggaataattgaattcatattaaaaaaggaacacattgttgacgattttttagcacatatagataatccgcctttgatggattttttattaaaagtaatatcgaccgataagccagaaatatcaaatggagttatacaactgtttaaaaaacagaacttggttccaaagttgattcatttactcgatcctgtttttgattcttgcacacaatctgcagccggtgattttctgaaagctctggttactattagcggtaactgtcctaatgagattacttcgagcatagggcctaatgaattaacaaggcaattagtttctccaaatatgatgaaacaacttatggatataatgctcaagggaggcaattcgttaaataatggcgttggcattatcattgagctgataaggaaaaacaattctgattatgataccatacaaacaaattatactaccatagaatctcatccgccaacagatagagacccaatttatttaggatatttggttaaaatgttttctgaacacatggccgatttcaacaaaatactaactgagaagaagattccccttttacagacgtcctatggaacgattgaaccgttgggatttgaaaggtttaagatctgtgaacttattgctgaactattacactgctcaaacatgactttattgaatgaaccgagtgcctatgacattgtaagagagcgtgatgccgaaagagagagaatcttcaattcacaaaattacgtagattctaacgatcgtagtgaattaaaagaaaatgaagacgacaatacaggtgatgctgatgatgaagtggaagatgatacaaatcaggtagaatccgctaatacctccattgatggtgaagaagttatcgataagttaaattctttacagatagaaaccaacaaagtaaaccagaacatgaataatgaagagcaacatagtttaatgccagacttcaacaatggtgattttaaggacgaggaagatgaaaatccatttgaaccccaatattcagacgtcattttggattcttctgatatagaaaaaaactttcgtgtgtctcccaacgttggagatcagctgaaaatcagtttacaagataccagagtaatagatactatgctcgaaatgttttttcacttccagtggaacaatttccttcataacgtagtgtacgatgttgttcagcagatttttaacggtcccctcaaaataggttataataggttccttttagatgatctcctaatcaacatccgtttaactgatatgattattaacggaaacaatgaatgcatagaatatgagaaaggacatgacaccaggcttggatatatgggccatttgaccctaattgcggaagaagtcaccaaatttactgcatatattgaagagatgaacatcacctttgaaaatactgaagtaatgagttctttatttgagagtaaatggattgcctatacggaggatgttctagaggatctaaaggagaaatacaacgccatattaggcgatatagctgaagaaggagacatgttgcaagatgaagaagaggatgctgtatacgacaagggagagcgcactatgggtacagtcgatgactacattaatgacataatgcaaatggacaatgtacggtgtcaagaggaggaagaggatgaaggagaagggtatgtcagctttgatgaagatgaaccccaagaatatcgtaatggtgattccgttagaagcaaagaatcgaattcatcagaaggcaaacgtgaccaagagcagctttactatgagtacgttaacgaagatggtacaaaaacaagattaaacttcaatcctgattctgacgccacggaacaagttccaggtgaagtgaatcgcgatcataagataccattgaagcttaagcgaagttttacggatgcatgcaaatctgaaacaataccaaataatacagttaatgctaaggaagaaagtgtatttcaatttagcaatgaacttagtgacggctgggagtcatcaccttctaattctatacccaagcgtgcttctccatcaaaaaatggcatgaattcacctatgtttcaacaccagtttgaacttcatagccccaccgatgaatttggaggtcataaagacgaaatattaagcgcggaaggccatgactacgacatagatgaatacgatgaactgagcgatgacagtgatgaagagtatgataactgtgaagacgaagacagtttggattatgctgattccgccgcatatgcattgtgtagatccaaaagtaaggacaagatatcatgggatgaagaagaacaggcgcgattaatgggcgttgtaaaatttaattcagagcattacagggactaggaaataatactaattaaataattctaataattctaatattaataacaataataataagaataataattatacaataacacatgtatttcctaactcacaatcgtttggactacatatgctgtctagtgccttattgcgactttgcccgtttgataacttacttcgattgtttagtattcaaaaaggaaaaaggcgttttctttttcgtgtactttttttcgaaattctgttgaatttattcgaactcagaattggtccatcaagagcatccaaaatacaaaataactcatcatcacacaagaagaagcacaactccaagcaatttctacaatatgtcaaaaaaacttgcgtcaccattgtccttcttacccctttataatttgctttctgctgttggttggtcttatttgctttacttggtcatctccttgtacccaaaagttggacagccagcattcttctaccaaactaaaaatgtcgctacccttgttcaatgtggtgctataatcgagatcataaactcatttttaggagttgtacgttccccattgctgaccactgttgcacaagtgtcttcaagactactagttgtcctcggcatcttccaattgttgccaaacacaagtggtgttcaatcagttgtttacatatcattattactggcatggtctataactgagatcgtcagatacttgtattattttttcatgttggtattcaagaatggcgcaccaaagatcttaattctattaagatataatttgttctggattttgtaccccactggtgttgccagcgaactacgcattatttactgtgctttaaatgcagctgaatctcagtattctttactttacaaaagaattttaatagcggccatgctcgcttatatcccaggcttcccaatgctcttcctacacatggtagcacagagaaagaaagtcatgaaaagtttaagatcctctttcgggaagaaactaatttgaattctttagataaattcttctgtattttttataagaatattagccttcacattgaaatggcttcaacgctcttaaccataatcactagtatcttgcggtgcacgggctttatattgagcaaaattgcgaagggtagccgaattagagaactcttagaaagatgtcgaagctcactcggagtcgaccttcacagcctactgaaacaactgtgccgagacaatcttaagtgtgttgctctaattttcatgctacaactgaaattcatatggccagtggccagaatcacacctatttataggccatttaccagtcatccattcagaaatttagctacttcctcaagcatcagtagtacaaaagctaagactactaagacagatacaactccactaaaattatcaaatgaactatatgcaatattcaagattcataatcgtccatatttggtgaccgagggcgacagagttattcttccattcaaattgaagcaagcggaggtgggtgacattttaaacatgaccgatgtaacaactttaggatctagaaactacaagctagttggtcatccaatcaatacttctctgtatactttaaaagcaaccgttgttgggaaaactaaaagggctttccaaactagggaggtaacgaagagaagaaatagacgggtccgtcatgcaaagagtaaaggtgatttgacaatcttaagaatatcagaactgagtatgaactgaattttagggatatgtacatatacgcatacgtataaaatcatgtaaataacaataaaatttgacacactttcttcgccccaatggccattcaattccagaccgacgcgtcttctaagttataatgctatgaaatttcaacaagttaattaaaagtaagcataataataaaatcaggtaatggattcaccaaaaaaaaaaataaaaaaacaagggcagaggggtgaccattagtacgaaacactaaatatagtattaaaatagttcaactccacctccaaatgccctttttgaggaaaatagcggggacagcacatacacattctaggtctgattcgaactcatctgtgaaattcggccatcagccgactagttcggtagcatcaaccaaaagttcaagcaaaagccctcgtgcaacatctcgcaaaagcatttatgatgatattagaagccaatttcccaacctaacccccaactctacctcttctcagttttacgaaagcacgccagttatcgaacaatcctttaattggacgacagatgaccacatctcagctggaacgcttgaaaacccaacgagctttacaaacagttcttataaaaatgacaatggacctagtagcctctctgattcgaggaaatcctccggtggcaatagcgtaaatagtttgtcctttgacaagctaattctatcgtgggatcctacagaccctgatgaatggacaatgcatcgcgtcacctcatggtttaaatttcatgattttccagaatcctggatattgtttttcaaaaagcatcaattgtttggtcacagatttataaagttgcttgcatatgataatttcgctgtttatgaaaagtatttgccgcagactaaaactgcttcatataccaggtttcagcagttattgaaaaaaacaatgaccaagaacgtaacaaatagccatattcgtcagaagagcgctagcaaacttaaaagttccaggtcttccagcgaatcgatcaaatcaaaattaaaaaatagtaaatcgcaagaggatatttcaaattctagatcaacgtcagaatctgcattgagcccaacaaaatcgggcccttccaagaccgatgaaaagaattttttacattctacttcaacacaccaaaaaaccaaaagcgcaagttcactatacagaagaagttttatatccctaagaggctcatcatcgagcaatgcttcctcagcaaaatcaccttcaaacatcaagttaagtataccggctcggccgcactcaattattgaatctaacagtacacttaccaaatcggcgagcccacctgcatctccttcgtatcctagcatatttagaagacatcacaaaagtagttcatctgagtcgtcattattaaattccctttttggtagtggaataggcgaggaagctccaacaaagcctaatccacaaggtcatagtctgtctagtgaaaatttagctaaaggaaaatctaaacactatgaaactaatgtgtcttcacctttaaaacaatcttcactacccacttcggatgataaaggtaatttatggaataaattcaaaagaaagagccaaataggggttcctagcccaaatacggtagcttatgtaacgtctcaagaaactccatccttaaaatcgaattcgagtactgctaccttaaccgtacaaacggcagatgtaaatataccatctccatcttcatcaccaccgccaatacccaaaactgcaaacagaagtttggaggtcatcagcacagaagatacacctaaaatttcttcaaccacggcgtcttttaaagaaacgtatcctgattgtattaatccagacaagacagttccagtgccggtaaataatcaaaagtatagtgtaaagaactttttactggaccaaaaattttatcctctgaagaaaacagggttaaatgatagtgagaataaatatattctggttaccaaagataatgttagttttgttccgctaaacttaaaaagtgtagcaaaattatccagtttcaaagaatctgctctcacaaaattgggaatcaatcacaaaaatgtcactttccatatgacagactttgattgcgatattggtgctgcaattccagatgatactttggaatttttgaaaaaaagcttgtttttgaacacttctggaaaaatttatatcaaagaccaaatgaagcttcaacaaaaaccgaaacctgctcctctcacctcagaaaacaatgttcctttaaaatcggtgaaaagtaagagttcaatgaggtccggaacaagcagtctgatagcatcgacagatgatgtttccattgtcacttcgtcttctgacataacatcatttgatgaacatgcatcaggaagtgggcgcaggtacccccaaaccccgagttattactatgacagagtttccaatactaatccaactgaagaattgaattattggaatattaaagaagttctttctcatgaggaaaatgcaccaaaaatggtttttaaaacaagtccaaaattagaactcaacctaccagataaaggaagtaaattaaatattcctacccccataacagaaaatgaaagcaagagtagttttcaagtgctaagaaaagatgaggggactgaaattgatttcaatcatcgtagggaatcgccttatacaaaaccagaactggcaccaaaaagagaagctcccaagcctcccgcaaatacttctcctcagaggaccttatcaacttctaaacagaataaaccgatccgcctagtgagggcaagtacaaaaatttcgagaagcaaaagatcgaaaccattgccgccacaattattatcatctcctatagaagctagcagctcgtctcctgattcgcttacttcctcatatactcctgcttcgactcatgttttgataccgcaaccttataagggtgcaaacgatgttatgcgtaggttgaaaacagaccaggactcgacgagtacttccccatctttgaaaatgaaacagaaagtgaatcgctcaaattcaactgtatcgacttcaaattcaattttctattctccttcaccattgttaaaaagaggtaactcaaaaagagttgtttcgtcgacatctgcggccgatatatttgaagagaatgacataacattcgcggatgctccgccgatgtttgacagcgatgatagtgatgacgattctagttcatccgatgacattatctggtccaagaaaaaaacagctcctgagactaataatgaaaacaaaaaggatgagaaaagcgataacagttctacgcattctgacgaaatattctatgattctcaaacgcaggacaaaatggagagaaagatgacctttagaccatctccggaggtcgtttatcaaaatttagagaaattcttcccaagggctaacttagataagccaatcactgaaggaatagcttcaccaacatctccgaaatccttagacagcctactttcaccaaagaatgtggcttcatcgagaactgagccaagcactccttcccgtcccgtccctcctgatagctcatacgagttcatacaggatggacttaacggtaaaaataaaccattgaatcaagctaagacacctaaaagaacaaaaaccataagaaccattgcacatgaagctagtttagcaagaaaaaactctgtaaaactaaaaagacagaacaccaaaatgtggggtacaagaatggtcgaagtgaccgaaaaccatatggtgtcaattaataaagccaaaaattcgaaaggtgagtataaggaattcgcctggatgaagggtgaaatgatagggaagggatctttcggtgctgtttatttatgtttaaacgttactacaggtgagatgatggccgttaagcaggttgaggtccccaagtatagctcacaaaatgaagccattctaagtaccgtggaagcattaagatctgaagtgtccacgttaaaagatttagatcatcttaatattgttcaatacttaggttttgagaataaaaacaatatttacagtttgtttttagaatatgttgctggtggctccgtgggatccttgattagaatgtatggaagattcgatgaaccgttgatcaaacatttaacaacacaagtattaaaaggattggcatacctacactcgaaaggtattctccacagggatatgaaggcagacaacttacttttggatcaagatggtatctgcaaaatcagtgacttcggaatttcaagaaaatcaaaggacatatactctaattcggatatgaccatgcgaggaacagtcttctggatggctcctgaaatggttgatacaaagcaaggctacagtgcaaaagttgatatatggtctctgggatgcatcgttctggaaatgtttgctggtaagcgcccgtggtccaacttagaagtcgtcgcagccatgttcaaaattggaaagtcaaaatcggcaccaccaattcctgaggacactttaccattgatatcgcaaatcggacgaaattttctggacgcatgcttcgagataaatccagagaaaaggccaaccgctaacgagcttctttctcatccttttagtgaagtaaatgaaacattcaatttcaaatctaccagactcgcgaagtttataaagtcaaatgataagttaaactcttcaaaattaaggataacctctcaggagaataaaactgaatagctattaggatcgatctatacttaagatatttatgcatacgtaataatatagaacaataaacatagatgacggaatgacggaatgactgaaaattaagaacaaagaaaattaaaaaatttctgctgatacttattcagacgaaaaatggtgcacaataagggtgtcaaaacgacgattcgacccttcaaatattacagtcctcacctcttcgctgaagggctcactttcatcaggaaggtcctctccaataataaaggtagtctcctctatatcagctaaagcagtatctgataaaccaacatcaagcacagtctctataaaggacggcttttcaattgcttcttctggaactttcgtttcaaaggggatatccacaattttaatggtagattcgtttagccagtcatgctcagcaaatgcagttgacaaatcttttgcgaaatcaatattcttgctgttaataaatatactacaggatgcattatcattattatagccatctctatagcatatcaataagagaagatatagtccaagataatcggattgtgtcaggtatggttttggaagtaataaattgaaccgtttcctcttaaagcgatcagcatttaatctgccataggtatttgaaatttgaacggcaaaatttgccttgagtgactggaaaatagacttgaagaaagtagatgatagttcattcagacctaggagatgagaataaatgtgatcaaagtttgcgtatttttcatcaatgaagactgggctccctctatactcatacgaggccccttttaatggcaataagatcagatctgtggaatccattttcatcgtcgctatattagctgccttttcacgcattgtagaaaatatgacttcacttgaaaatggtattttgctcaggtttgaaaatatatcaaaaatttgtaatagtgaatctgtatttgcggtaaagtggggatcatcattatatagagaagatgattgcagcagatcagttgtccgttcagtgagcaatcgtaaatgaatggccctcaatgcaccgactccctcaaacggggtcaatttttcatctataacacttaaattggtatccacatcgtcaacgcttttagaccagatatgaaccatcttttttattttgaatgtgttagatttcaatgtggaatcagtagctgttgtcattctgctcaaggaggtttcgttcttatgtttattattcttaggcttgggagatacccctaaagacaggtaatttagcagctttagagatggagagatcgcttctgtagtgtttatcaccgtggtcagttcaccaattctatatttgctaacatctgccaatgaattaagttgagtgttaatttcagtcttgtccacaccctcagaatcgagaccatctgctgcaccatcatcttctgcaggtgtagataaggatttgcgaacaccatcccggtatgaatctgggtaaacaagctgagtcagaggagtagtgacaaaagtagaaactaatgccatcaacacaaacataccaaatatttttctactgataatgcccgcattcaaaccaacagttaagacaacgatttcaacgatacctttgcatgacatcaaaacaccggctgcagtggcttctctccaaaataagccagtaagtttagctgtaagagtacctgaaataattttggtgaaaatggcgatgccgattgtggcgaaaacatagccccaatctcttccctcatttaatagagtcaaatcgacatttaatcctgcaacagcaaagtagattggaatgaaaacaatgttaggaatatcttccatcctttctgttaatttaacaacgtagtgatcatctctaggaactactaagccagcaatgaaggcgccaaaaataggatgaactccaataatatccgtaaaataagcagaaatgaacatgatgaatagaatgcacatcgttgccaacggtgaaggcttgcttctgtccaattcatgggtccttatgagcacccatcttaataggtattttaagggaaagaaataaatcaaaaaccatgcaaacgtgataagcagaatataaacggtattgacagggctcccttctgcactagaaagaataatacttaatgctaacaaaatccatcccattatatcgttaatgatacccgccgcaaggacaacgatacctgctctatccttgatcaagcgcaattcatttaaaatacgacataaaactggaaaagccgtaacggagatggaaacagctataaataccatgaagacagagaatttaatatgcctttcgccttctgttttgtttgcataagtgtgaaataaaggaatcgccagcagacaaccaaaaccgaatggcactgctaaagtgactatacctatcacgagtgctttctttaggtgtttcttgatgaaagcaatatccacttctaaacctaaaaaaaacataaacagtattattcccaaattcgccactaaatttagccccgggatcgatgatgtagggaaaattgtgtttgtatagtttggaatttgaccaaatatagtaggccccaaaataacaccagatataacttctgaaatgactttaggctgcctcatcattgaaaagggaatgtgaattaaattgcataccagtagtatgagacatgcttgaaagagaaataatgtaagcggcgaactggagttgtagtggaacggatttacacccgacagaattcctcctacagtgtttgccatttgatagaatataaataatacaacttcgtaataataataatcgttggtatcatttgatgtgtgctttagcaacaagagatgatataataagcgaacagtttttgttttttattttcccttactggagctcagccacattaatgcgagacgcaacgggtgcataatattgaaagcgcatttacagcagaaaaatgctttcagtatttattttgagatgctgaatataaatatttagagaatacatccgtagtagtctacagtaagatataaatcaatgcttcgggtgtttgtatatcaaagtgtctttctatgctcacccaaaaattttcttttgcttataactttataaagctcttcgtcttctactagattaccaactaattcttctatgttcttgaaaagcatcataaaagcaaaatgaggttcatttaacgggaacttgaggggcgtatcaggtgatatccaaaattcgggtccgcgtgtgtactcctcaatatctgtaatgttcctcaaatgtagtttatgaatgtacgaccagtcggaaaaactaagtgtgtaatctttatccgccagacatatccgatgtagttttttgacggctttaagtagctcttgcaagttccttaaattacaggtccccgagtcctgtagtgcatattcagcagaagaaacatattctagaggaagtattccctctgggctagatgcttttgataatgaagaaaatgattcttgcaggcttgcaggaggggatgtcactccagaatcattctcttctgaattattatcgttgaattcagaaatttgactggattgtgagctcgttgtattttcttccagatcaccatcagctgtgtcagattcttcgaaaatttctccagtgttcaccataaaggaaagtgctctttgacgcccattaaaaacgatggacttgactttattattgaatgattcaccgatcttaatatccagagaagtggaaatgtcaaacaacagatcaccgactgtagataggatagcccccattaatggcacggctcccaacgcccaaatcacaaaaaaagcacggcctgcaccagtccttggagcatagtctccgtatccaatggttaataagcacaagaaacaaaagtaaatacaattgaagtacgaccaattttctgcgaatttgaatacaagagctcccaataaccaaaaagccatgaaaattgcaatagtcaccgacaaagaaaaccaatgctgcttccttgaggccgtttgtcggatacacttcattaagtcgaacgcttccctttcagataaatttttactactatccatataatgtttccacgatttggacctgcctttttcaactctgtggaaaaagaaaattgggccagaggacttttgaatgatggatcttgtcataaacactattaaacccatcaagacaacaccagatagcgaaaagattaaaaccatgattttggcgccaaccgacttgggcaggatgtcacctagtcccacggttaataatgataccgtgcagaaatataatgcatttccgtaagtgatgtgcaataaaccgctaaacatacccgcaccccaaatcaaccataaagacaatagtacagtgtatgccatgatacttctttcattgggcaaaaggttgaacgttggaggatattttcctaatttatatccaataaaatgtattgttaaaataatggtgcataccaaatatagaccagaactgatacaggcaaaccaaaatccgatagtcttactgtagatgctgggcatgtcattcaaggagcatacaatcacgtccaccaaaagcatccctccagctattgtccatcctgttatatttattaactgagatttaagatacgtcaacttcttactgaaatgtagcattagtataatatttgacgtaaaacccagtaccaaagagatgatattaacggcaaaaataccaggaggatcaaaaactgtctttacttgattcatcaaaacatcggtgtcattgcttcgtggatttgtcaccacggagttgttctttaaggatctccatttttcaactacacaggctatcgagatagtgttagctacgggacccaagcaggcagtaatcacagggaaatagcatgaaaccacaaaccaaaagacgaacagtgttgaagaaggctctgcattaataatactaactctttcgtcccggaaccgcaatgcatcctttagttcctctgcaagaacacccttagcttgcttcggtgtgttgtttgaatgagaatcaacagcctgagctgagctctcttgctccactgtcgccatattgccatatcccagcgtttgtttggcaaagctgttcatgaaccttgtcatatatatagaaatcggtaaaataaatacaagaaatatgctttgttatactgctagaaaggagtgaagacatctgctcacgatctacgagatgcggctatttttgatggaaaaagatacatagggtcaggcatttttgccatattgaataaccaagatggtactgagtactcaggtaatgtatattacattgagtacttcacttgtatacacaaccactgcttcgtattgtatatcaagtatctaactgttgataaactacaactttctcttcaaccataatgatagcgccgcttaaaacatgctagggtaacgagacgcgaatgcgaaaaactcccaaaaaaaccaaaacaaacaaaagtgacaacaattagaacgatgctgaagaagaataggagcgagtttagagttacctccagctatcctgatactactgcttaggctaccttcgcagagtctcgataaatttgcagtcggcaagataagaatatttctctacagcttttagacagcttcctgtccctctagtttcttttgccatccataattgtactctgcactttgagtatcattccaatttgatctttcttctaccggtacttagggatagcaaatgtcgtcgaacaatgatctttggttgcatttagtatcccagttaaatactcaacagagagcagcggccctctttgattacactagagggctgcaggtcattgccggtcccggcacagggaagactaaggttttaacttcaagagtagcgtatcttattctgcaccaccatattcatccccgcgatattatagtgactactttcactaacaaagctgctaacgaaatgaaagagcgtttgcaagaaatgttacgcggggcaggcgtgaatatttcggagctcttaattggtacttttcatagtatttgcctgaaaatactttatagatttggccacttggtggatctacagaaagactggagaattattgatgagaaggaaatagatgtcattttagatgatatgatcgaaaaagttcccgaccaaataagggattatgcttcctcaatcacaaggaaagtaaatctttgtatgccgagtaaaaatggagatgaatggactattcatccgaagctgatcaagaaacagatatcaaagctaaaatcaaacgcaatattacctgaggaatacatcttagattcgaatcatgacgccgcgcttggttacttttaccaaatataccaatcagagctaagcaagaaaaatacgttagattttgatgacttattaatgtacacctttcgtttgctgactagagtgcgtgttttatccaacataaagcatgttttagttgacgaatttcaagatactaacggcattcaattggacttgatgtttctttttgctaagggaaatcatcatctttcgagggggatgaccatcgtaggtgatcctgatcaaagcatatatgctttcagaaacgccttagcgcacaactttctagaaatgggcagaaaatgtcccatcgagtactcaactatcatacttgttgaaaattatcgttcatcacaaaaaattctaaatacaagcgaaattttaataacgcaacaaaacaaaggtcggcagaatagggctccactccgtgcccaatttgacctggattttccaccagtttacatgaatttccccgcttactttttggaagcaccttctttagttcgggaactactatatttgaaggcattgccaaacctattcacatttaatgactttgctatcctagtaagacaacgaagacaaattaaaaggatcgaaagtgcattaatagaacatcggataccctataaaattattaggggccacagtttctgggattccaaggaaacaagagcgatgttaaatttattaaaattgatattttctccgaatgacaaacatgcaattcttgcttcacttttatatccagcaaggggccttggtcctgctaccggtgagaagattaagaacgcattggacacgttagctaccgatgtgtcatgtttccaaatattgaaagacataagtagtaaaaaaataatgctagacataccgacgaaaggccgttctgtgattgctgacttcatttcaatgatagaaaattgtcaattgttgctccagagcactttactagggggtctttcagatttatttgataagctatatgaattatcaggtctgaaatacgaatacttgtacaaggatggtaagaaaaaaaatgatcagcttgaaaaatccgaacctaatttattaaacgcaagacataagaatattgaacttttgaaaaactatttcctggctcttctttccaagtcagaatcttcagataaagaaaaaaatgaagccattaaagcagcaacagatgaagccgaaccaatagagaacaaggtcatcactccaaaagaatacctccgtaatttcttcaattcactttcccttcattctgatgcagctgaggaggaagagtcggaatccaataaagatgcaaaaataaaacgtgagaagaatgggtttgtcacgatatctacaattcacggtgccaaaggtcttgagtggccggtagtttttattcctggatgcgaagaaggtataattccttgtgtgttcaacgatgataagaaagacgaatcagaggaggacgaagaagaagatcaagaaaatagtaagaaagatgcaagcccaaaaaagactagagttttatccgtggaagattctatagatgaggaaagaagaatgttttttgttgcacagactcgtgcaaaatacctgttgtacctatcaaatactgtaactgtggaagatgtcgatagaccaagaattgcaagccgatttttgactactgacttgataaaagccatgtccgatagccaaaaattatttgaaagtacgaatagtatcaaaaaactataccgaattttgaacaaaaagccgcctgctgaagatgataaactattctcccttgaccaattgcgcaaagactataaccaattcattgaaaataggagagaaaggatgatttggcaagggatacaaatgaatgatgtctatggaatacagttgtctagaaataaattattgggttctgttagtgatttcacgtcagctgcggaccagttacgactcgaaacgcaaaactctatattcccacagaagaaacttattgaaaaatcacgcccatccaaaatcaatggcaattacgctcctaaaagtagagttaaaagtccagaaaaaaggtacgctccagaaactacatcattccattctcctacaaagaaaaaggtgtatgcacctcaatacgtttcaacaactaatgtacctagtaggcaggagtttcattcttctactgggaaaaatattccttttctgagaagagaagataggtccatcacagacatatcaccacgatcatcaacgaggtcgttaaaaggagcatctccaaataagacgagccacatgtcagatgatttaatgagaccatcacctacgaggaaggacaaagttactcgtaatattcatttcgcaactgcaggaactttcagaatagaaacccagtcaaatgttgatgaactgcatcctccggaatactccaataaatcagggcagtcgcttacgtcgagtgaattttctgggttttctagcgcgtgcagtaattctgatcagccaacgaacttaatagaagatataaacaacgaattagatctatccgatgaggagttattaaatgacatatcaatagaaaggaggagagagcttttgggctcgaaaaagacgaaaaaaataaaaccaaaaactcgaaatagaaagtctaagagaggtgacaaggttaaggtggaggaagtgatagatttgaagagtgaatttgaggaagatgacagcagaaatacaacagctgctgagttattacataatccggatgacactacagttgacaatcgtccaataatctccaatgctaagtttttggctgacgcagcaatgaaaaagacacagaaattttccaaaaaggtgaagaatgaacctgcatcaagtcaaatggatatattttctcagctgtcacgtgcgaaaaaaaagtcaaaattaaacaacggtgaaatcatagtcatcgattagtagcactttcatgcctgactacgtcaactattggaggcggtttataatttttatttaaagcacataggagttaattttattttactggtagggtttgtatacgaactacatggaaatgtggatggtgtgttattatagcttaatgaatattctttttctatacaagaaaaccgatatgacagctatgaatgagcagtatgccaacaaaaccaggaatgattttaagggtgaagaatctatcgtgaccatagacatattgactaaaccagtagagacatttgccaacaaaaataaaaacaacccattggagttgattgattccaagcattcggcaactttataatattccgaagaattaccgaaaattttgtcagtcaagcagtacccagtcaaaaatagtaaattataagtaatgacccacaaagtatatggtaagttagcaaaccttcttgaaacactataaggatggtattgaaaaaccaactggctgataacaagaaaaattgtactccatatacagaggccacttaatggggttactgaagtccaatagtcccaagtcgaagacttctttgatgctgcaactacgtcttgcgtagaaggcttataaagattgtttaaagttggtttatttcccaacaagtaaaatcccgtgttttggccccaaagaaaaatcgagcaataacctagaaatgagaagatgccttctctattagcactgaagaaacaatttctatcagccaaaattaaaaagtttaaagtgcgatcgtcctttaaaagtagccattcataaatgcatgaaatgaatattgcaattgagcagcgtggaaccattcttgtgacgggatcaataaaggtcaatacaagtggcaacaatgatagggtgataaaaaaattccaatgaaccccatattctgtgacatgttcttgatattccaaattttttacaaaaaacaacctcagcaatcctaggaacaatagagttcctcctgattttaaggcattaaatgcattttttaagaagctgggtttactcttcaagcttaggtttttcaacagtgccctagaagaaacaataccgttactgaaaacgaatgatcctacaccaagatccatcagggatgtcccccaagtttccaccttggcaaacctccttgggaaaattggaaaatctacagccaagatggcaatagcagtcagaataagcatcccaccacgatacgcagtaatatacggctttttttctagttggaaccgctgtgtaatcattttttttttattgtatattggattagaaggtttactcgagctagtaaattttccatatatgaatgcgagcaaacaaggtaacagtattagcgtgtttagaaggtatggttcactagcataaatagtaatagatagaagcaaagcaacccagttcaatgcaaaatcaattatgtattgcacgctggaaatgccaggaggcataaggttggaatttttcaataagttccatgatatgtaagttaccaaagcaattgatgtcactgcgttaatttctgttatagaaccgccattgagccctgtcacaaagtcctcttttctctgttttaaagtcgacatattcttctgatgtactgttgccatttatttagatatttacgtgtcttcttattgcgatcctctttttctcatgctgttttttcacgcgagcatgtcatggaaagtattatcatacaaaacggtaatacatatagatgagtagatttgaataatgctgtagatggcgtatgtaaatgaatatcttataaaattacggactacatttcaagaatctaattcctttgtctgatttcttgtctgtcgtctcataggtttttctaaagaggcagtacgtttcttatcttgaatggagccataggtaacttgagtatgtgaaacttcctcagttcttgggatctcttctggattagaaattgcagtcggctgctctgtaggcacattttctgacattattgtgccccaactcgtggttcgtttaatttgtttaggaacgaaattttttggcagtgactccaacttgatccttttcgtatccggcatttgtctctctgaagaaacatccatgatactcgatgagacactacgcttttttcttccagaatcagtttctctaattttctgcaataattcgtttttggtatctttcatagagtgctccgataatgaggaattgtttcttttcaaaagaatagttttgtcgatttttggatcattgttttggtactttttttctgaactaatgctggtatagtatggtttttttatcttacatttaaaatcgtccttgtgtcctcttgggcagataatacaccacttgatattgtttaaaaagatttcattattttctccagatgcagcggacaataatttaaaaataaatgctggagtaactaccggtatggagtggaatttcttgatatattcaattttccttttcatcgaatttctcaagattgaattattttgaaaatcttttctgttattatcaccaggatcatcattattgttattaatgcaaaactgagtaaaaagatcgctaaattcattcgaccataacggatgggttttcgggatactgggtaaagctgctaagttgattagcagaatgtcagtggatttattgaggtattctacataattgatgcccattggttttagaagatttaatactttagtcagatgtaacagctctacgccagagaatccagtgatagtaacattcagaaaaggggaagaagaaaattcatgatgcaataactttgaagaagacgaaacttgaaactctattgtgctgaggaagggttttgaccataaatctattgggtgtagtaatttttgataatacaagcagcgttcaatgaaaaattctgtaactataccatcattatcatctataatctcaggtaaatcattgaaggagtcaagagctttattacttggaatgatgtaataagaatgatcgtaaatgccgctcaagtaagacgtctcaattttacccccattttgaacaacaattttggttagtattgaacggtgattgccaggaaaaatatgatgaatgataaacgcacaatttttgaaaatcaaagtactattatcacttaaatcttcttgtttgttatttatcgataatggtgactgccctagtactgaaaaatttgtcttactatgctgctgtagagacattgccttgtcccatattttttcaccctttggtttaaatttattcaagagggatgatgttttcgggagcgaaggagtcagggtactggaggattgctgccgctgcagagaggattgggcatcgatattggttggaaaggtggtgtttattttatcccagcaatcgcaagagtttgatccgattgaatcatagggcaggtctttaatatttggtaaaagataatagggatcgtacggtaacagtgcgcttcttttttggcaatcgagaatccatttgaaatgtacaataggtatattttgttcaatagcagcgttaactcttgctcctagtaaagtatccgtaacaaaaatggatatctgcccattctgaccttgatcatcgtcatcattgtgtgaagaggtatctttgattacaaagttttgatagttataactagaacaccctaactttttaatactcctaaccaatgaatcgatggaagttatgttagtgtcggttattctgccaatgaagatattgaagttatgcaaatatttaaacgaaaatcgccggtaaagtatcttcagcatctcataggtggatcctgtcattgttgccgtattagagtccggcaatatattttctccagacagccagagctgataaatgtcatcaatggcttgaatgtcaataaatatgatatcgaatctatgcttcaccgcaaatttaaatttgtttgtattggtggtggacccaacaacaaggacattaacttgtctggtcaaatctttagaaaatatacctcctaacttaataattttctttgatatttttttagctaagatttcattatttattgcagtcggacaaaatgttattccttgaaagggcttcatagtaatattaatgctactgataaaatacctgccatactagaaatagaagacttatatatcacgtaaaatttgtctcttcttattcatcatgtacataaaacagtacaaacattaccaatagtactatatagctttaccaggcaatacgcgaatagtccatgcagtttttcttctcttatactgatgagggtaagttttgcatttgatcaccgccgtatgcgaagcggaaagagcaaatgcgttgaaagaaacctggcgacaataggaaccacgagttcaagctaataatgatacctcaatgattatgcccagattacgttatgtgactaaagtagaaaggtgaataaatataagtaacgaaacaaggttacatggactcttcaattaaagaaggaaaaggaaggattcttttgcaggcagaaaacattgaagttatatcgcaacaataacgatgtagttattatgacctcataatatgagaactttttcctcaagtatttttaagttattctgtgtgtcatgactctcacttcgtcatattttatgttagtgcacaaaatgcgaggtgtgggtgcaatcaagactccgatccattttcgccgttcgaccggtgttttggcggctaaatttaagggcgtgatctcagaactcggcggcaaaaaaaaaagtatataaggcagaaagctttctgcctctccgatttcctctcctttgttttcttttccgcttcaatttacaatctagttcagcggctaatcctctttaccattgttttccgtttatcctttgctcattctcctttgctcgatttcttttgctcgttttttttttttttttttgcttctttttttcttctcgctactctgaatagacgatggccaagaggaaatatggcaggtcttattccctcgatgatacagattcctgcagcaataaagtcctgatagtaccaaccggtcaaagctcctctaacgcaatcactgatttctctgtcagaaaggcgcatgcttgcgatagatgcagactgaaaaaaatcaagtgtgacggtttaaaaccgaactgttcaaactgtgcgaaaattgacttcccttgcaaaacctcggataaactgtcgaggagaggtcttccaaaggggtatacagaactactagaaaaagaggtcgtccgtttgacaaatatgaatgcgagttccagcgccaatgcaaattctaatttgccgttcattaatgatacattttattgttttgataattacaacactcagtctgaaaatcaaaggtttttgggacatttgacatggaatattctaactaatacttttcctactcaaaaagcagtagtttttacagacgatcgaaataatattgatctacaactgcaactgttaacaaattttttgaacctgaatggtgactttaatcatctcccaaattttcttttacttaaatatgattataaccttcagtttttgaaaaatttgttgtctgtcattattaaagatttttttaaaaggcaaaattctttgctacttctattataccctacaaatttatggaaaaatttgctattagacaagattaattcaaccgcaatgacaggtgaacccataactctactggcgttactttatattattcaatttacttggtcttgttttgatgatttcaagctttttaaagtcacgaagcttattgtttctctgacaacaaacagcaaattagacttgaaagttttgcaattggttaacttatccatcttttattttatgggcgcctctgttgactcttgtaaaagtaaaagctcgttaacagaacattcaaatgtaaattcagtaatatggaccaatgatttgctaaacctaaactttacaaatattttgaatatgggattgtacataaatcccaaaaatttaattcctatatcaggcaacaataataataataaatctaatgaagaggatgatagaatagtgacattttggtgctttcaattcttaagctcatggtggtccttaattcaaggtttaccaaagtccaactttttaactgaagaatttcaaccgaaatcaatctcggttctagaaatccccaggctgaagccctttgaaattttgttaaacttcatcatatattctttggatggatgtaatttgttgaatatctcatctttaaatgtttcggacccaaatttccaatttttccagaatgaactggaaagctttaaaaaaaatttattactgtggaacctttatcacaatttgagtgatcacgataacttccgattcttaacatccagttcaaataaaaaactaacaacaaatttactacttaagaatttgacgggtctaaatcacaaactcaatcaacctgattttgtggagattcaattaactttattttacttgagtttaaaattaatgactttaaaggaaggggaccaagatttgaagaaagaggatatctcgttagagatattgtccctatattttttaattcttacagatgactctaataatgatgataatcaacagttacaaccacagcaactaaatctctaccattttacgcccttcaatagtattgacattattgacttatgtttaaacaatttaaacaattggtcattatcacttaaatacgaaagtggtcaaaaccagccccactcaagtaaaataaagtttgaaaaatttcaaaactttttaaatcactggtgtccaatatggtactatgatgaattttccacaaacccttttttacaaatcctcaaaatcaatttcaaattacttccttttgagacaatccattactcacaagaagagcaacgattgttaataagtttgaataaattgagatatttggatgccgtatcgagctttaattcaagttcagtcaagtcgaatttcgcgtctaaggtcaatacccagctaaaccttttgcaacactcgagttctaactccaatttcctagatgcgtcaccatacgattttaataaaatttttatgaacaactttgaaaactatgactacgaaacagatgaaggatatgcggaagatgatgatgaagaggatagtgacagtgacaatagcttaccactagaaattccttttaaaaaaagtaaaaataaatgcaagaataggaataaagagctttcacaaaggttatccctatttgaaaacagagatagcaattcggtagatttcaacacagatacaaatttaaatttaaaccctgattcgccatcagttacgtcttctaagaaaaaatatttagatcatattattttagataaccgagacatcgttagcaaccatgactccagtaaacaaaaattcaagatccagaatattttgaactcgaccttctaacattacgctccttcgtattactcattcagctcttcctctgatagcagtgaattttcgagggtcacgtcgtgactcatatgctttcttgttccgtttcgtttcgagatgacaaaaaactggtcattttttccgttaagtgcaactcacagcagtatcggccgctgagaaatgcccggacaaatttttttgagccggattggtcaccgtttctttcttcggcgcggcttcccattcccgtccatccaaaaaaatctacctatataaatcgacttttcacctctaaaggcagtttattccttgtatgtcctttaagtacagttaataacgagcaatttttttttttttttttagccatctacccatcaacttgtacactcgttaccatgtcaaccacagcatccacgccttcatctttacgtcatttgatttctataaaagatctttctgatgaagaattcagaatcttagtacaaagagctcaacatttcaagaatgtttttaaagcaaataaaacgaatgatttccaatccaaccatctgaaactattgggtagaactatagccttaatatttactaaaagatcaactagaacgagaatttcgaccgaaggtgcagccaccttctttggtgcccaaccgatgtttttaggtaaagaggatattcagcttggtgtcaatgaatcattttacgataccaccaaggttgtatcatctatggtttcatgtatttttgcccgtgtgaacaaacatgaagacatacttgctttttgcaaggattcctctgtaccgatcatcaactctctatgtgacaaattccaccctttgcaagcaatttgtgatcttttaacaataatcgaaaacttcaatatatctctagatgaagtaaataagggaatcaattcaaaattgaagatggcatggattggtgatgccaataatgtcataaatgatatgtgcatcgcatgtctgaaattcggtataagtgtcagtatttccactccccccggtattgaaatggattccgatattgtcgatgaagcaaagaaagttgctgagagaaacggtgcgacatttgaattaacacacgactctttaaaggcctccaccaatgccaatatattagtaaccgatactttcgtttccatgggtgaagaatttgcgaaacaggccaagctgaaacaattcaaaggttttcaaatcaatcaagaacttgtctctgtggctgatccaaactacaaatttatgcattgtctgccaagacatcaagaagaagttagtgatgatgtcttttatggagagcattccatagtctttgaagaagcagaaaacagattatatgcagctatgtctgccattgatatctttgttaataataaaggtaatttcaaggacttgaaataatccttctttcgtgttcttaataactaatatataaatacagatatagatgcatgaataatgatatacattgattattttgcaatgtcaattaaaaaaaaaaaatgttagtaaaactatgttacattccaagcaaataaagcacttggttaaacgaaattaacgtttttaagacagccagaccgcggtctaaaaatttaaatatacactgccaacaaattccttcgagttgtccaatttcaccacttttatattttcatcaacttcagcagattcaaccttctcacatagaacattggaataaacagccttaacaccactttcaagtttgcacagcgtaatatgaggaattttgttttgacaacacaaccctttaattttctcattgttttcatcaattatgcatccatctttatctttagacagttccactacaatagcaatgattttttcatcccaacatagtttttcgagcctaaaattcagtttgtcggtcgtttttacctgcgtattttggttattaccagagccttgtgcattttctatgcggttgttattgtactccgttatctggtcagtgtatctgttacaatatgatttccacaacttttttgcctctttttcacgggacgacatgacatgacctaatgttatatgaagttccttctgaacttttccactagctagtaaatgcttgaatttctcagtcagctctgcatcgctagcaatacacctcttgaccaattcaataatttcatcgtagttttctattttagctgagatatatgtaggtttaattaacttaggcgttttttgttgattattgttgcctttaccaactatttttctcacagtaggtttgtaatctaagctccttctgaacgctgtctcaatttcatcatctttcgggatctctggtaccaaaattggataagctttatgaatttcattgaggatttgtttcgcattggttaatgaagagtctgcttgtccaaaatctaactctatcattaaatcaaacatattatctggtgatttgtctaaattaacaggttgatatcttttcaaaaacccattcatgatgcctaccactttcttctctcctaattcgtcccatttaatactttggtgattgttacctcttttgattactctttgcagtgttatgtctcttatttccgatagtttgtcatatggcgcgaatgacacgccgattaccttgatgttcgtatcatacaccaaataatcttcttttagttcattcaaccattcaaataattgctttctttcgcggaattggtgattgtttctgtcaactatgacacatttgatttcttttttggataatagttccaatgattttttcattaattgagatttatctttacctgtaatatcatcattttgaatatgaccccagctgtcagggaacaaattcactaatgtctgggaagttgttgttttgccacatccaataactgatattggaaagattaaaaatttagtgcgttcgtctactttatcataatcaatggcgttttttaattccaactcggccactttttcgtggtttaagatttccagcccactcatgccatatgattgtagaaacttatttctcaattcaatcacaccaaaacctttcaagtaattctcacagatcttgggtgatgactccaatattgggattgcgaaatcaagatacttgttggttataaatttatgctttctaaatttaaacactcttgacttgttggaaatatagtctttagtaacttctctccactgacggtacatcaaatacggttcttcaaatttatacttgaaaaaaaatggcttttcagtactcttcaagtggcacctgataacaaaaccttcaatctcttgcccttcaaaagatccggttgcagagcagttatctaggaactttttcaaatcctccaaggtgttcgatgtaatgcattggacgcacctgaatccgtatttactcgccatttgcgaaacatctttcatatcccaagtttcaaattccgctttattaacatttacaccatgtaagtataggccagctttttcaaggggatactctaagatgtgttcttcaaatgaatcatcgcaatattctgccacagcggtgacattatgggtatatagcattctagcaaaatcacttcgattgatgttcattgccgccagttgtcttaaaagttgcttctcacctgcttctgcatggttcctgtctacgtctgctctgggtccagtagaatgcttcgaacaaactaccaaggtaccatcttctaaaccagatataaaaatgatacaaccattggcttttatagtgacatcgtaaggccctgtacagttctcttcaatccaattccacttggtaaagttgacctcgcctacattgaaaaacttatcgtatcctctagcaacaataactggattcgttgtatcatcgctaataaataagcctcttgcattacatggcaaagtgatagtatttttgccataatcccattcgttaaatttccatgaaattactttcttattgctgtgtgataagtcacaaacccttctataagctctgcctctaccggatagtttttctgccttttctaactcgttaacaagctgagttactgttcttttaccgtcatatgggctaggcatcgcttcttcgtatgaatacttttatgatcactaaagtcaaagtgtagattttcaaagaaagaaagactatgcaaatgcgtaaaatttgctcgaagcaattctcaacagaatggaatgaattagatgctcttctgtatactttctttgggataaactcatagtgaaattttatcaatggaaaagtacgcggccggcccgctggaacataaagataatttactgaaacagtgtgcttaaacgtatttgaaaaccaaggtgaatgtacccttaaagtgctggcagtgaatagcaaaggtccattaaagtgttctggttttataatatcaaaagcatttatagaaatgcccgctgaaattgacattgatgaagctgacgtattagttttatcacaggagttacaaaagacaagtaaactcactttcgaaatcaataaatctttgaaaaaaattgcagctacatccaatcaatccagtcaactcttcactcctattcttgctagaaataatgttttaaccacattacaaagaaatattgaaagtacattgaattccgttgcctcagttaaggatctagcaaacgaagcttccaagtatgagatcattttacaaaagggtattaatcaagtcggtttaaagcaatacacccaagtagtacataagctagatgatatgttggaagacattcagtctggacaagccaatcgagaagaaaactcagaattccatgggattttaactcacttggaacaattgatcaaacgtagcgaggctcaactaagagtatattttatttcaattttgaacagtattaaaccgtttgatccacaaatcaatatcaccaaaaagatgccatttccatactacgaggaccagcagttaggcgctttatcgtggattttagattattttcatggaaattcagaaggttctattatacaggacatactcgtcggtgaaaggagtaaattaatcctcaagtgcatggcattccttgaaccttttgccaaagaaatcagcactgcaaaaaacgccccgtatgagaagggcagtagcgggatgaacagctacacggaggccttattaggcttcatcgccaatgaaaaatcactagtagacgacctctactctcaatatacagaaagtaaaccccacgtcttgtcacagatcttgtcgcctttaattagcgcatatgctaagcttttcggtgcaaatttgaaaattgtacgaagcaacctcgagaactttggattctttagttttgagctagtggaaagcataaatgatgtgaaaaaatctcttcgaggcaaggaactacaaaactataatttattgcaagattgtacgcaagaagtacgtcaagtaacacagtcattattcagagatgccattgataggattatcaaaaaggcaaattctatttctactattccttccaataatggtgtcactgaagcaactgtagataccatgtcaagactaagaaagttcagtgagtacaaaaacggatgtttaggcgccatggacaatatcacacgtgaaaattggttaccatccaattataaggagaaagaatacactttgcaaaacgaggctttaaattgggaagatcataatgtattactatcatgttttataagtgattgcatagacactttggcagttaatcttgagagaaaggcacaaatagcactgatgcctaaccaagagccagatgtggctaatcctaatagctctaaaaataagcacaagcaacgtattggattcttcattttaatgaacctgacgcttgttgagcagatcgtggaaaagtcagaattaaacttaatgttagctggagaaggtcactccagattggaacggctgaagaaacgttatattagttatatggtatcagattggagagatttaactgcaaatttgatggattctgtgtttattgatagtagcgggaagaagtcaaaagacaaagaacaaataaaggagaaatttagaaaattcaatgaaggattcgaagatttagtatcaaaaacaaaacagtataagctttcagatccatcattgaaagtaactttgaagtcagaaataatatcgttggttatgcccatgtatgaaagattctacagtagatataaagactctttcaagaatcctagaaagcatatcaaatatacccctgacgaactaactactgttcttaaccaattagtgagatagattgcgaacatcacttttcaaaaagcaaaattaaagaaaagaacgtaccataaacagatataaacatatatatgtataacaattagagtttctaatattttatgtttgctctggacgccagatgtaagaacaggaagggatgacgtaggaaccttgtgctagactaaagggtactctcatttatactttgtaatccagattcattatctaacgtattaatcagtactttctcgggtgaagaaagtcttgaaataaatctttcctcggaatcagaattcttagagctttccgttaatcctgagccctgtgtgaaaatgtcattattatgatctgattcggcagaattttgtgcattagctgcattcaagaaattctcgttacttcccaaaagtggagaaaactgattgttatcgttatcgttttgtaaaggatgccaagcagaggaatttctagcgtacggcgcagtgatatcaatcgtagtatctactgagggttcaagtagatcaacgtatgaatcattaggccttaaaaaggagtcttcattaactttattagtcaacgtttccgttttactcagtaatggttccatgttcaacttgtccttgcttatattaattcctgaatagtcaaaagaggatctagctgaggcgggggtgctcgaagtatttgtagaatgtcgatttagttcatttttatcatgatttttaagttcgtcttctattaaaacttgatttaaatctgtgaaaaaaccattatcgtgtcttattgtggacggtaaattatcttgaacactttcccttctattcaatgatcttaatgattcattgctcagatttcctaaagctgaatgcgcaaatccgctattatttggtgagctatgtaatgaagacgataggcttaatactctttttctgttcttttcgttactttgattcccagtggatgtcgagtctttgctttcctcgcgttgtggggttgataaacttttcacgtccctattttctctctttttaggagttgtctctcttttgtgtttattttcttctatctttgacatcgattcttttttattcaaagtttctgaagaattcttatccgaatttttatttggatgggaagcttttaaacttggaggcgtcggatgtttggaattaggcctccttttttgattgttgtcatgcaacacagtatccttataagatggtggatcccgtggtaagatgctcgactctgatgaagatacctcagtagtagtggttccggaagcagcatcagatatgaaatcggaagaaaagtcaaaatctggcggaggcacttccatatttgacattggcgatgttattggagagagcgggattgcctggggtgatgctaattctctttgcaaactctccggttgatatatgttggatttcaactttgcagaattgaagatggtattatcactcggatgggattttgagttcctattgaattgcctagagtttctggtcaatgaagtggaaggtaaatgtgggattaaaatgtctaatggttggacattgggcgaaagtactggagacgaaaggacttccttgggaaagaaaatattagagttatggtatagatttatattgtcatcagacgattccaatattgaggaaattgaggaatctgtttcttttggaaaagaagcaggatgtccatcatagctcggtaaaagggtatttgcatgcgagcacaatctatgtaaaacatgtattggcgagtcaatactaatttcgtaatgtttccttttattatctactactctagacagtctcaggcaaattttaatccaatggtttgctttgatgttttcataagaagtatctggatgcaattgctgatggttgttgaaacgactcggaataaaaatctggtactcatactctttattcactaaatcaccattctttggatcctgcaacaggttccccatattcttggcctttgacaaatttgcatcattgggcaagttcggtaatttaggacctttctgttctgtcaataaaaatttcttggtgggctccatcctatgaaccttcttttctctacaataatactccattgtctctgtcacataaattcttattctatgcaacgtaactttatcgaggggagcgaatttgaacgtgataggcagaaaagcatctaaaataatatcctttgatgctataacgatatcataatataattggttttcccaatctctagatatgataatcggctcactttcttccacagaattatgagcctgtgtccgtacgatattaaccacttgccgggcgctaatgtttgatttaaaggcaccaggtctctctatactggcaaataagaagtattccacaaatccgaaatcagctttaatagattctgggtatgcttgaggaattagttcttcgaaagcataaatatagtcgcctggttgaaagacaaaaaattctcctccagacccgctggtgaagttgttgcttgtcattgccagatgattgctactggtggggatatgatgaccatgatgcgatgctgcatcattatgggtaaaggtgttattcaacaagtcggaaaagatggaagtggtcgtaggtttatagttgtggtgagacacggaaggagacgtggctctcttcaataaatttatcggggataggtttcttgatggtccattggaagaagtgactgacgaagatctagatctttgtctactttctctgtcttttacgttgacagaggaatttccaggtgcacctagaggtgacaagttcaacgaggacaaacctgatatagaattttttctgcttgttatagtttcattatcagacagtgttctataaagagaggcaccactttccttcgtcaaaaaattattagctgcattgttgctctcattaggtgcggaagcatccatctttttcttgctcttctgttcagttggcggatatagagcccatgtatggtctacaatatctttgatttccacgaattcttgtcttttaggagggataccttcaggccattcagttctagaatatcctttgaacgaaagacttatgcttttcagctttgtgggtttcagtattcttaccactagacagccccgaagaacaaccgagggatattccgtcttctgagggtcaaagccttggaggaaaacaactggttcagctaaatgaataaaaagctgtaatgatgaactttgtgccaagggtgtagcatcgagggggatatcaatatccttttccatgggaaacaatggagatgagatagattggtccatgggcatcttgaaaaatgactgatctacaatgagaaaggctggaaaaaaaaaaaagatgtttcaacgttaaaaaaataaaggactaacggtaatgaatagcgaagtctacagactaatttgccctttttagtctctctcaatactcacagactgcttgtagcgtaattagtacctattcttaaaagacgaaaaggagaactagccaagtcttttttttttcccaaattggaccatatcggattaaatttcttttttccgaaactgcaaatcctccagagaatgttttaataaaggaaaaccaatgaaagacatttagcagaataacaaagcaaaaagaaatgacagtgaagagtgataggtgaaggcgttgagaaatgagagttgttgccatggaggaatgggtactgaaccctctcacagaggcgtcactaatttaaaaaaggaaaaaggtgttatatgtattggggaaaggagcgatgaatttttgggtgatgaatgaaacagtgggatgagatgaactacagcaatatggtttggtcttaacggctgtcatgacaaactattgatcagggccagtatttgtatcattattgttataattgagaatgaagaaaggttagccgctgagagaaccttcttcaaattatgttttttttgctttttttctttttgggacggcgcgcgatagatggcgcaagggagttgctctccgttcgacatcaataaattggttataaagtgacgtatttggttcctttttagtaattgatgaagagtgcgggatggcctatacaaggaagagtcgatttagtgccggagaatacacgccctgacgtttgtataaatgcatttccccaaaaaaaagcattccggaaatctctccgtggtggaattgccgaaggaagctctccaagattctttaactgctgctcagattactttcaagagatatgcccaccccaatggcaatgccggtagcgcagagaggccgagacatctaaaggtggaatctgcgcctgtcgtgaaatctgagccttctttgccgaggatgagacaaccggaaccgagaagtataaatcatcaatactctagggaaacgcttccaggccattctgaagccttttccgtaccgacgactcctctgcagacaatccattatgatgtaaggaataaagcgtcaaattcgccaagtagtatagcagctgcagagacagctgcatacctagcccacacaaattcatttagtaacagatcatccggtgtcggcagccgggatccagttatggatactgaaacaaaaccgccacgtgctccttcagccttgaaaaatgagctgcaattgaacagaatgaggatacctccgccgtcatatgataataatgttcgttcacgatctatttcgccacaagtatcctactctacctcgctgtcatcatcgtgttccataagttccgatggagaagaaacttcttatagagaaaaaagcaccgatgaggcatttcctcctgaaccttccatgtcttcttatagtcttgcgtccaaagcctcagcaaaggcttctctaacggacccctcacagcggcagcaagagtcagactatacggcaatgaataaactcaatggaggaaatataatatataaaggcactttacccgacctaataccgcgaagccaaaggaagacaagtaaacccaggttcaagcacaggcttttacgatcacctgagcagcagcaagaaaacttatcacgtgtgtattcggaccaaacgcagaatggtagggcaatcataaacacgcagcaaaatgtaaagttaaagacaactatgaggcgcgggaagtacgcaattacagacaatgatgaaacttttccctacgacagaaagtctgtatcatcagactcagacacagatgaagattctaatgtgatggaaatcaaggacaagaagaagaaaagtcgtcgctctaagataaagaaggggttgaaaacaacagcagctgtagttgggagtagtacctctgtccttccgttccctcatcaccatcatcatcaccatcagctccataacccgaattctcatcacttacacacgcaccatcatacaagttctcacaaattcaatgaagataaaccgtggaaatctcatagagatctcgggtttattaccgaacaagaaagaaaaagatacgagtctatgtgggtatcaaacagatactcgtatttgcgcttgctgccgtggtggccctctctcgcgaatgaagacgacgagtctcacttacagcccttaaatttaccgcaagacggcctgatgcttaacttagtcgtaaaagatatatggtatcgatcaaacctacccagggatcttctagtgcaaatatacaatatggtcgacacaagaaaagacggtaccttagacagaaaatcgtttatagtgggcatgtggctggttgatcaatgtctctatggccgaaagctaacgaatgagctggaccagagagtttggaatagcgttgacggctatgttctcggtacaattaacgtgaagcctgccacttccgatcactatcacaacgctaataaccctctagataagccatcaaagctttcagtccgacaggaattgaaaaacatcaaacgcgatctcagaaatgtcagaatatgatgcctggcattatttgcagaagttctcttcctgtgttaataatgaatgacgatgagttaacaatgacccttatgtatacaacgaaaggacgaatgaaagaaatgaaaatattatctttttttttttttttctcaattttccttcacttttagaagtttttccgttccgcggattttgttcgtcggaccttttgctttatttgtctccagatctctcgagcataatggtcgtttttcatttcatgcttatagtctttgtctttccagcggtacccccaccccctatcttgggctattttctaatttcgtccctcggattatttaattcatattctccccacctttgtattactaaatttattttccaatgctcttttcactcattcttccttttgcatatttctatcagtatatatagcgaattgtatatataagcgtcttgttaccggtataggaattacctgatagaaagaaatagaacataataggaggaagggcaaacagtgcgccaaaacgaaagatagtagaagatgtttagagtatttggttcatttggatcaaagggtaatcaatcttctggtgaagagcaatcaacaaagacaaaacaggttctgaagcaggctaatgactttgagatcgccttaaaggcaatggattttgtccttgatgatagaacggatgaagggttgaatttgctgaaaaaagctgaaatggaaactggttcagatcaaactatcttgactttggcaagaggtgttattgaatttcttcaagccactttgagttttgaaactgaagaaatgaaaagagctgcaattactttaggcaaagctgagcaaatgtcctggaaaagtaagcaaaatgctgaaaagaccaattttaggagcagttcaatatatcctcccggtactgtctatgctgtaacatatactgagtcatgtctgttgcatgccttgttgatgttatttagtgaaagcatgatggaagcagccaaggctttgctaaagttaaggagggcttatacaatgttacaagatatcatggttactgtcaaaaaagctgaacgatcgaaaaattcgagctctccctctccaagcgaaaagagccaagagtcatgcggaagttttgtttctgcagagacaactttcatatcggttgatataccatacaaattgtcttccgaggacaagtccaatccactcctattggaatttgctgaaaaaatctacacgatgagaatgggaaggttatcaggtgcccatattggcaatactccatcttttcataggttaagggatgatttgggtttacagacgactccgtctcaagcttccgaccgccattctgtttcagatgatttcgatttagaacaggctaccatcgacgaattcatccattcaggtgctaatttatgctatggtatcttgcaagtcgtcttatccttacttccacctgcaatcggtgctgtgctatctattgttggattcaagggatcccgtgaagaaggtttgaggctagtttggaaggctacaaaggagagaaatgttcacgggtgtataggtttgttaggtctgatgttttattacgacggtcctttccaatttacagatgctgactttgatataccaccaaacgataatggatcgagggctttaaacaaaagcagaacaaacgatagtagccttttaccaggttatatggacagtgcaaccttattgcatcctggaaaaattctggaggacgcattactaaaagcaagagcactttttcctaatagtgccctgtggctgctaaatgaggccaaaatgcttgctggaaagggcaggcttcgtgattctctggccctaatggactctattgatgtcaatagtatccgtatgagacaagtgaaatcgttgatggtgtttgaacgtgcgatccttttagtcaacttacacgaatacaacagagctgccgatgatttaataagtttgcttgatattagtgattggtctcacgcattgtacacttattttgcgggttgctgttacttggaaaattggaggatgacacaattaggcttattaaatgacggtaaagaacaattctataaagagcgggctcgagaactcatatttgacgctccatctttgttaggtaagaaaacgttcaaatccaaaaatcttccattggatagattcatgcttagaaaagttcaacaatttaataatatgcagaagaaattaaacctacaagaaccactagactcaatagcaacatcacctgtccatgaactggcttatttctacaacggttacaacaggatgactgaaaacgatttaattttgaccaaaaagatgttgacagagtatcacaaccccgccattgattcggaagacccagatcaagagctgatcagaaacttactactatccttgaccttaagaagattgggggatgctgaaagaggtttagccttgttagatgacattgttctgccaaaaatattctacattcaaaatggcaaagtcaaatatttcaaaaaaaccgaagacccatgggcatatccagccgctctttatgagagagctttattctgttggaaactgggtggcatggaaagtttgaatgaatgtagggaatggctgctaagagcccaaaattatgccgccgattacgaattgagtacgcgtatcggtatgaagatcaaagccgcccttgatagagttgaaaacgcgcttgcttaaccttttgcttcttccgccccaacattttagaagtatgcatttttttttttctttcgactacttaccttcccttgctagcagttattacaaccatcattttttcgtgacgtttcatagtttttttatatttttacgcaatgggtttcccgagtagttagttctacggtgtcgatatatatagtgttatgattttaaaaatgaacatatttaaatttttgaacctccttcttagttataggccaagttcattactccctaggaaacaaaaccggtccatcgtagaaattttttttattttacaaaagggttatagtagaatcaagacaatttatttatcactgagatattgatcgagtagatgaatggtcgctcaaactgctaaactgaaaggcgacttgtcattcaacaacgttttctattcctatctaaacctatcgttaagcaatctttcgacgcccacctcttcgtattcctttttcccaacccacagttggtgaaatgttcccagacttgtaagtatactaccgccaagccatgactggtattgcctttcgatagtgtgccctgttgttaatattctaaatttaagggatggtagtattttgtttagttctgtcattaacctatcacttaatccaggaatagaggatgtaccgcctgtaaggacaacattatgagctagtgtcgctcttagatccacatcactgctcattatagacgaataaacaagatccgctagaccaatcaattcattattttctttaggaggcttttcttcttctaacggtctcttaccggtttcatttggagtgtctgcactatttgcagccggagaagtagatttgcttacagcttcctgttccttttcttcagttggtgtaactttcttgtctgatttgttcactccgcttggcttggttctttttagcggcacgtaatcattccgccaagttttcacaactccagagttcgagcgaggccaatttgctgggatgtcatcttcttttggaaggaaaagctcttcagcaaagccgtaacgagtttcgttgtcaaaaacaatctcctcattccaaggactttcaatagatcttttagccgtagaacttaattctgttttcgtttcttccaaagtttttgttgggcatatatgacaaagtgtttctttgcactcttgaaagaaccctcggttattggcgtaatcatacagcgatttatcaacctcatagtcgaatgttttttttataaactctggttttctttgcttgattgcgaaaagtggtatgatttctttgggttccaatgcctttttaatcaagtgattgataaatttcccagcaataaaatttcttcttgtactctttgataatgtcataccatccactattggactgacgctgcaagtatcatgtccaatatcaacaaccaaacaattgggtctacctgctgcaaaagaaacgcatgtcgatgtgggtgctaagtaacaggcttcaaattgcatgccttctaagagcacttctaaagattttttcctgttttctgtgctattccaaacgggctcagttaacagagctggtattccggagttggaattcaaatagagttcgttctgcaatgcccattgccactgttcttgtgcggtatcccagtctatgactagaccgttctcgataataggtttcagttcataatcttttcttggaattccaattgattgttcagaaaatattttcttattgccttcatctgcagtgtatttaccgtaaacagagggcagaattgattgagggaagtcagaacccgaatagccaatatttgttgtgtatgagccaggatcaatgactactgcggaaacttcgtcgccgccataaacttgcaaagcagcattggacatagttatgcttttcaccgccttataacgaagactctttttttgcctaaaatccttggttttctgtacatcttgttttcttttttttcttctcgctgtttcgtcgtcttctccatttcttatgttcgtgttacttcaacttcaaaatagctttaaatgggaacttttcaaagaaaaactaatgtaatctaactattttaaaaacgtacacatcgtagatattaatggattatataagtaagtaaaagccaaaatctatattgaaaaaaattggtttcaaagagcttgtctatcttcttaaggatttcaaaaccatttcaccggccttttcgacaccagctttggtacctctaatgtacacaacatcattgactttgtcagacttccttgggacgttgatgataacgtcggccgcttctctaatctttttgatgttagaaccacctgggccaacaatcatattgaatcttctggtatcagcaccccagacgtaaccggcatatgtagcagatggtgccttggcaattctttctttaatcaacttaacagcagtatcgagagcttcttccttcttagcggaatcgtttgaagtgtcctttgtgacttccttttcttcaccgtcagagagaatgctactcaaatcaattggttcatatgtcaacctcatggtaatatcaccttcctcggaagaagttggtgcaccgacttcttcgatggtaaatttagtcttttctgcattttcgccttcggtagatccacagactttctctagaggaatttcgattggagcacgagctaatttgttagccttctttgaggtgttaccaaatcttacattgacggataaatccattctcaacttttgtatgaaagcaccacgttctgaaacatattcataaatggaggcaggaacatcgacttctcggtcaaaattttccctgattatttcattcaagattttcttctcagctttctcgacattttctggtgcaccggtaatagttattttgccgctagggtcatccttattaggaacgaataagttaatgttaaattcggattctagttgacgacgaacaatcccaccagggccaatcaaagcaccctttctttctgctggaatatcaatggtcttagtaacactattttcagcatccttgacaatcttgttaatttcctcgacaacctttttgacaaacttttgaggaccttgtacggtaatgtctttattttcggagtctgcgttaggaatatcaacagacttatttctaatttcttcaccaccagccttggagataatttctcttaaaatatgaccaccgctaccaacaattgacttatggtatttgtgatcaattttcaagacttcagtgacaaaatcggaggcttcggcaacaatggattccacacgtttggcggcatcttttatgttttgtctagaaccagtgatctccagttcaacctcaccagtttcctgagcctttggatcggtgctcttttgtaagaaatccatctcaacaccgtattcagctctgatgtcgttgatattgtcaccattcttaccgataattcttgggacgtgctcagctggaacattaataaccatcttatgtccgttctccatttcaaaatctaacagagctttcaattcttcatgagctttattgacaccacgagaagggcctctaatggtgacaatttcattgtctcttgggaagttaatgaagacattgtatttttcctgcaaacggttacgataagtaccgtgtggaccaatcagactaccatgaaacttaactggaacaattagttcctttgtgatgatatcagcccattttttggcttcggcagccaaatatttcttggcatgagtcaagttgtattctaaaccagtcaaagtaacttcgacagtcttatctttcgaagcattattgttctcttcgtttggaatatcaatttggcaggcaaacttctcacgaatttgttgtaggttggagcccttgttaccaattaatctggcaactgagttggctggaatattaacagtcattttgcttttgctcgatggagaattcaaaatagattcaaaaattttgttagcagctttggcagctttttcatcacctctaacagttaactgattttcttcaggggtatgtagtttaatttgaaggtggccttcttgttcagaaatgtcctccataatcaatttccatgtagcggaagatggtttaaacaatgagtcttgaacctcctcggaaaattcgtaagttttagtctccatgttgttttgtttagtacgtagagagtttaatgactcattggccttgttcaaagatgcttgaatctcttcaatagatggcttgaaatcttcatcttcagttaaagcaacaagtaaaatactgttatcatttggataataatcaccgaattgaacaaaggcaacgctgctttcggaagctaataaacaatgtttaatagacccgccgaacaactcgtaatccaaatctgtgataaccagggtttcggaaggtggaatattgttcacaaaagaaatcaattctttacgaacggccttgatatcgtttgcctcatcagattttgcgctgatgtggatggtaacagtttcagctgttggcaatgactgtatggatggtaaagatattttaacattaggatgagattcttcaagaccctttaaaacggagtacttggtgaaatacatgattagatttttggcatgggtcagattcttactatgagccttggaaatatctaaagattcaaccacatagctctttgaagacgatctggcataggtgatagcttcaccaaccttatcgcgcaaaccgacaaatgacacaagctcatcatcaggagttgatgggaaagtgacaatgacattgtatttttcttttagttcttctgcatcaatcaaaaactggaacttggatggaatcttgaccttttcttcgtccaaattagaagctaattttttcaaataatcttgaatagatgtcttcgtggcttttgctttttcacgaggacccaatatgacaatatcacccgattttttatagaattggactttgacctcttcatcaccctcatcggaggcaaactcggaaacatcaatgtatggtaggtatttttcatcttcaacgactaatttgattgtggcattcttggtttcttccttaacaatggccaagattttagccttagccaagttgaccgattcaaaatcaccaaataaagaaacgttacttgtagtatcatccatgtcttcatcatatgagttttcattgacttcctttgagacattgattttaacttcgtaggcatcactaatttcacgaatagttctaccacctgaaccgataatactggctttacatttggatgggacctcgatgacagcattgattggttttgttaatttcttcactaactctctctttgcttcatgaacgttagcagctacaccagaaaccaaaaaggtacgagcattcttagaaagagttgattcaacagaaacatcatgatttttcttaacagattggacaatacgagataattcaggtttggtgattgacaactgagattgcaggtccaaagtgaaagcctcttggatgttctttgaacgcatcctcttggccccaaggccagtagtcaatgaaggagcagaaggggaaggtgatggcgagttagagacagcaggtttcatgtttgggccccagctaaccttaacgttcgcgaaggcagcatttgaacccaaagaaggaagatccttcaaagatggcaatggagttggctttttctccaactgaggatgttcttcagcggtagcagcaatagtggaggcagtagtacttggcgaatcaatggtagttacggtttcaacagatccttcgacagtggaagggggagagtcaatagcggtttgttcttcagacattgcagttataatggaaggagggggtgtgggaagtatattttaagcgtggtaaccaaaagacaatagacggaaagttaggaaatcagaatgattcaccttaaaaattatgctagataaaagacagcaatttcaaaggaaaatagaaagtgctgttgtgtacttagacgttctttttcaaagacgttcaattgaaaagctaatagccaatgtttcgaaggaagttctgtacgaaatgtaaaaactataaattagtaaatatactatccgttgcaagtctttaagagctacattaaattgaaattgtcgagtgtcgccaacaacaattcgcgaaaatgagcgaaaatttttcaagcccaccgctaaaaaaaaaaaaaaaaagaaaaaaagggacataaatacgtatatctccagaaaatgcccagtggagtggatgaatacctgatgggctatattactacattattgaaaacgtttaccaaaagtttcgttactgtataaaaaaattggggtatataggcgggtatatatgggtatacttagtgaacaaggaactgctgaagcagaaaaatcctcgtaaaacaatgaagataaaacgaacattaaatgaaggaatgagaaagaaggatcaatgaaaacttttcttgaaagttaagctaggggctcgacattatcggcgtattcgccttcgtagtttcctgcggggtcgtaactacagatgacatagtcaccccatgcaccgccacaggttttgatgccacaaccaacttgggtggtggacttccaaacgacttgagtaaagtggccagtgttacttgaaaagcctggattcgagaagtcgtagttggaaatttcattgtaccaagcgtcgacggcagctgggccgtcataacccaaagccaagttttcaccgtatggaccgccagaatgggtcaaagtgccggagcaatcatagttgtcagcatagtcttgagcgtaggaggccaaagtatcggaccaggacaaagctggtgtgtccttgtgcaaagctctcttcttgttgtgttcagccaacacagaagaggcaaaatctgacaggtcactatccgaagacgatgctgagctagtagcagcggcttgagaagtggtggtggtagcagcgggtgtggaagtggtggaagcagcagcgggtgtagaagtcgtagtagcttgagccaacgattgcgatgtagattcagaagatgtcaacgtggtcgttgaatcggtagttttaccccaaacagaggctaagttcttcaaagcagacaagaccacatcggaattgctggaagcagaggaaggagcgacagggggagcaaccaaagctgtagctgtagaagttggagtggcagtggaagcaggagctagtgtttcgtaagttgtacgtgtttggccgttttcgacataaactacgccttgcacagtaacgactgcagcctcatgggcgtgttcagtgacagtaacaacggcaggagcggccaatgcagacgtggctaaggcggaggttaagatcgataatttagaaagtttcatgatttatcaattacgggatattaaaaacgaagaaaaagtaatatcaaagagcggaagagtgtggcggcctataaaaaaagaatgaattgaaatagcttacgacgtagcgatagacctaacggtagcaactaggattgaaaagagagcgcgattgaagattccttgcttgttttcagaatagaaaaatagagaatacgaaaagaataaataatacaatttcgggttcgttaacagaggtgggtttatatatggtatgggtaaaatagagaagttagaaattatatagttctaaagaagtagagagtcaatagctgcaggaagcacacgagtgctacagttgttaacacgcaataaacgggtccctctatctaaagcgacacaggtaatgggtatgcgatccctccccttcgagcagacaggcaatttttatccacatcgggaaatgactctgtgcgtacatattacctctttaggaataataattactgtgattggcgcacgggtgtggaggtgtcgctcgtttaggaaaaaaaatgcatagttgggtgttgttcgaggagtctagaaggcgaacagaacagctacgacaaaagcggcaatcgttccagctagactattgcactggaaaatggaaagaggtgttgcagcaccttcgtatgcagaaagttttgcggtggttgatgtgccttcttttagttgagtgtagatcgaggaagttggctgatgcatggcagacccgtcttgttggctggtagttgaacgaccgttgctaccagtagttgttcttgcacctaggcttgtgctggagggcttggcatacagtgtagcaacagtctgttggtaggttgttgttgtggaagaggtgccttcgtttgaggtggatttgacagaagtgggctcgtttggcttttcagatgtggcgaaatcgctagcgagagaagatgtttctccggggttaatgatagttgcggcgttgacttcagtgtagatactagaaaaggcagtgtcatcattttctagacaagtggttgtagttgaagggaaagaagaagctggaaccaccgtgttggttttcataggcgatgtggttagctcactggtttgggttgaggcgccgttcaaagtgctacaagatgtcgagattgttctagtgaaggccgtctcatctgtagaagaagcagcggaggtagggaaattactatccgtactacaagaagctgtgatggtgtttgtgatcagattgctttcagtggtggtggcagtggagatggcgaagctaggactatcggaataatcgctctcggaagtgcaggtagagactaactgtgtggtgttgcttgagacactaatactggtggttgtgcgtaagctatctaaagatgcgcctgtggaagaagatccatatgtagaggtgtgtttagcattgtcggttggactagctgagttgtcggtagggtccaatgtgggatctatggttactgcggtagctgcccttgtggagttgttagcagtagtggccaaggttgtagtactcttagtaatggctgtgatggttgtggtactcgaattttctaaagttgtggtcttcacgatactagagcaatttgtagcaggcacagatgtggcaagcgcagaggattgctcggatgtaatggcgtattcggcagcgtatgttacaccgtgtcctgacacagaagcactgttggagtaaatgctactcgatgtggcggcactgttactaatattcttctctgttgaacttgaagcctgagcagtttccgaagtgatactttctgaggcggttactgaagtggtggcggtgtcctttgtggtatgggctgtgctactaactgaggttacagatacgtcggtgttgacggctataacggaattcagaacagattgcgacacagctgaggaagagacggccccggaagaacttctggaagatgacccaagtctcgttgcatattgggcagcattagttgcactagttactatactagtatgttcggaaactgagcttgtggcctccttggaagtgctaccctgaatatcgtcagcagctacagatgatgataatgaggcgcttacagaagaggttgtttgagcagaaaacacagttgtgtttgcaaacttaacagaattaactgaattggaagttacacttctggagcttgcggtggaagtagtaagagtactactcaaaggagcagaaaccattgatgaagagctcgagatggcgctgctagaagaagcggcgttctcggtactcgcgctggaggaagcggcagcggaacttgaggcaggatcagaagaagaagcagcagcagtgctcgaggtagggtcggaagaagtggtactggacgatgtagcaaccgatgaggtggtggtagtggatgaagtagcatcactagagacgacggtactcgaggaggtagcataggaagtagtgacagaagagcttgaggctgatgagacagtggaggatccaactgattctgtgctactagtaattacggtagaagaggacgcagtgagggtagcggtcttggcagggtttatggtcgtcgattttaaagaactgctgctagccgcagacgataccgttgttgtatacccttgcgctacagcgggcataatactggatgagatggtggagactgtgtctgatgtagttgaggtagaagaggacgaggatgaggacgaggaaacagtgcttataagtggttccacttcctctgcaaactcacccaggtagtttccaggagggttgtaggagcacacaatataattgttccatgtcgtaccacaatatttataaccacatccaatctcggcggttgacttccaaaccacctgtgtgaagtgacccgtggattcagaaaatccgggatttgaataattatacttgcttatctccccgtaccaggcgtccaccgctcccgtgtctgtgtaaccaagggcaaggttctcaccatatgggccatcggaatgcgttaagacacccgaacaatcatattggtcggcgtagttctgcgcataggtggccagagtgtcggaccaggtgagcggcgctgtgtcaacatgtagcgctctgaacttgttatgctcgttcagcacatcgctctcgaagtttggaaacgtggtttgtgccttgacggctactaggcatcctagcagaactgatattggaaactccagcataagcgttttcgttttaagttgttttaagttgtttggagttgcaggggtgcagcaattataattttatgccgatattggtttggcaactaccgaaaagcaagaagctaaaaactttgaagtatagaatatgttttagagaattcttcgaccgagttgaaacatgagaactgtttcatcggccctatatagcaattacatccttccgttgctgggtccctgcctagataccatatttgttgttgaattaaccgcgggaacccgcaatatacgaaagacgaacacaagagagcaagcacacacagctagtgcgtagcgttgctagctatattgccatggtacctacctttcacctccttgttaaatccataagtggacggttttcctaaaccagtatttatcagttctcgagcacgcagagaaaagtaaacgaagcgacctgcattgcggtaactataaacacccagccgcctccagcagaaccagccatgtgcgaagaaaaacaatttttcggccaaacttaccaacaatagcgacgcgttcctcacatcgttgggtttttttcgcctctcttcaagtttcctatacccgagcttaacacaacacaacggaccctcttaattagaggtatcctccgttcttttcttccgctttcctaatcgagataccagagcacggaacaggaccctagtgcatcggagaggagatccgtggcacgctcactgcgcctttcactatcaccgatttcgtaattcgaacaggagtatttcgctgcaggggaattactgtttgtagacgagggaaagcaattatcagatacatgccagggatagcgttcaaggggaaagacatggttaaggcaatacagtttttagaaatagtcgttccttgccactgtacgacctgaactttactcaacgaaaaaaaaattggaaaaaaaatagtgcataacgttgctattaacagatgtagtactgatatgtccctgattggtgaagagtcagaatgatataagcctatttgatatgtacgtgtacgtattcgaaaataagatttgtttctcgtagggagcgatatgtgcattatgttacccgttccacatgttttgaactttttttctttttcatggtaagcgtcaataatcaatttgaataactagtgaagagtagctagcacgatgaaataagtgccggagctgatcgaatccctagtctcggttcgcctgaaacagagagaagtcgattactgtacaccgtgcctccttctatgtacaagctacaagtggtcttggtgcctccgagtcttcaggcgacgatgccaatacagtttggctacggaccaaccatcgccgaatcttctcaattgttgccaaacagaactaatatggcgcaaagcgccggagatgcctctttgcagtatgctaatctgagatctgccaatgtgagtttcacgccaagctatttcaaccagtctaggtttaggaagtttcttttgtttaccaagccgacaaacacgctgttgaacttgagtgatgaaatcatcgataagtgtgaaaaaatgtacccgagtttgcaagaagacattgaaattttgagtttgcaagataacagcggttgtgaccttgatccggattttttggtaaaggacgttttcaatgtaaataatatcgtaagagttatattgaagaatgagatagatctggacgattccgcaccagtgtcactttataagtcggtaaaacgatccaagttgaacaacgggtcgccccagtcggtgcagccgcaacaacaaatcccgtcctcttcaggtgttcttcggattgccaagaagaggccacctacaggaaccacgacaacaacaaccattcgtagtgccactaatggatccatgagggtttctaccccattggctaggcaaatttatcctccaccttcttcgaagatcgtctccaacaactcagatgacgaagacgaagacattggtgaaagatcctttttgccgcctccaacgcagcctcagtcacctcccataagaattagttcgggcattgacgcaggtaaaaaaataaaatcaagcatcgtcgaggaagatatcgtgtccagatcagcaaccgtggatccagataaaacaaagcagcaacgtctattgtccggaactcctataatgtccaccatgactccaaacagagttactcttaccggtcagagagtggtttctgaacacgcacataaaaacgaattggttttctctgcttcagcttcttcctcttcatttgctaatggtggcacagctgctgtcactgctcaggacattaataggaaaccacccgtaaccactccaagaataacatcaggaatgttgaaaatccccgagccaagaatctcagagattgaaaaagagttaaaagagggaccttccagtccggcctccattttacccgctaaagctgcaaagattccaatgaaaaaaccttacttggaaaatggcgagaactacgaatccgacgatagctcaagtagcgaaaaccaagaaactcctgaaacagaaccacattcaaaggcttccttgcaacgtagtcaaagctccatcgcagataataatggctctccggtgaaaaatagtcctctcggtgatgccatgccacacaatgtgcatttagcagaacttcccaaggcaagcaatacctcgatcaccaaatcttcaaatggcgaatcctggggaaagcaacaagaacatcaaccaccaagaaagagttcactggaaactatagtggaaaagaaatctcaggcggaaccttccggtattgtggaaccgaaaagaatgactaatttcctagatgataatcaggtaagagaaaaagaagatacgaatgataaacttttagaaaaggaaattttgccgacaattccacataatgatcagccaatacttgcatcatctgataagtctaatgggacgttgaaatcactagctgggaaagttagttcaaacaacaacgcttcaaaggaagatggcactatcattaacggcaccattgaggacgatggcaatgataatgatgaagttgatactacggttcgtattgttcctcaagattcagattcctctagtttcccaaagtcagatcttttcaaaatgatcgaaggtgatgatacagatctaccgcaatggtttaagggcaaaaattcgagaacttccggtaattccaaaaattcaaagccttacacaacggttttgaataaagacatagacaattctaagccagatccaagaaatattttgccccagcgaaccccaagaagtgcggctaagagggctgcccaattattggcaggtgccaagaaaaacgaagtcccacagaaaagtactgaagattctagttcggcagcgtccacagacgatgagtcagagagtgggattgaaacagatttctcatcagacgatgattttaaaaggaaaaatatgtcggtgcctaataatgggcccaaagacatttctttacattctttgaaaggcagtgttgttccagtgaaagactcaaagataatcaataaagaagttgatgaagaaagaaacgacaaaagagatagtcaaaaaaagtcagccgtgagtgaatcttcagtaacaaatagcaaaataagtgaacaaatggcgaaaagcttttatccgaattcaaacaagaagcaaaatgaagctacaaaggtggaaactaagccagcaacacaagcatcgtcttttcctgttgttggtgggtctccttctgttgctactaaaggaactacctctttcaatgaagaaggaaatcgtaaaaatgttaaaacgaaggccaagaatgagtctgcgcagattgataggcagcagaaggaaacaacttctagggttgcagatttgaaaagcgcaaacataggaggtgaagacttgaacaagaaagcagaggggtccaaggaaccagaaaaagcatctgccaatatacaggatgctaacgataaaaataactcgaaggaaaaagaagactccaaaagcaaacaggtatctcagaaaaagttaaaaatgacagatcacttaaaagaaggcaatgttcagcttcctaagcccagtgcaaatgataaattgaaggatttgaaggctaaatttactaatagtaaaacactcgtgccacctggaataatttctaatgaaaaaaataattctagtgcaaacgatgatgattctagctcctcaggttcttccacagaagacgagtctagttcatcttcctcgtcttctgatgaggaaacttcaacatccaggaaggctagaagagttgttgtaaatacaccaagagaaccagttagatcttcatctaagattgaagccccctctccatctgttaacaaaaaaatcaatgccacccctgataaaattccagttacacagctaatggacatgtcgtctcctccgtcagttaaatccaagaccacctcaaatccgtctagtatacttcatgaccttccaagaaaagttcgtccttctttgagttcattatctgatcttgtttcaagaggcatcccagatgtaaaggaaaaaacttctaaatcgaatgagaagtcacaaacaaaagccccttcaagtagtgatgatgaatctagctctgattctgactctaactccagttcggactccgtatcggattccagttcagattctaaatctgagtcagattctgatgactcaggggattcatctgatgatggaaaaagttttattagtgcgaaatccgctagtgctgctttaggtaagaagaagaagccaagtggtggatttgcatcattaataaaagatttcaagaaaaaatgataccagaaagtctcagtagaatacacgtcacagaaagctagtaaaaaaaaataatcaagcatataaaagtattaatatattaaaaaatcttcatgtaaaccaattcttatttacctcttttcccagcaagcgggcaacttctttaagaaaagtaatcttttttgtacgtcgaattatcaaagcttggttactatatttaacattattgtttagtaacagtatcatcttaaaagaaaattttttaaaattccaatataggagacaatggtaataattacatacaaatagctatttatgtaagcaaaactgatatttttatatacaaatcgtttcaaatatctcttagacttcagcgaatttattgctacctctaatgaatccgattgcttcttctctattgacctcaataaccgtggaaatcttattctcgtacttaacacggaaaaatttgtctgcaacttgcaacatatctgttctgaacgtcgtacaaataaactgggcattttttgacagttcttttagaagtgtagcgactgcagttctatactgcttgtcgagtgcagcatcaatttcatcaaacagatagaaggaagcagggtcaaccatttggattgccagaatcaaagcaatggcacatacagtcttctgaccacctgagagctgttcaacatgcagttgttcgttttgtttagaattgaaggaaacagaaattgaaacacctgtatacataatttcactatctttaccgttttggctttcattggattctgcatccatgtcaacatcaatactttcatcatggtcgttagcgttatcattcttacggtgaataatcaacttagcagtacctctgggaactaatctttcaaaaacagcttcaaagttttcagaaaccttttggaaagtagaatcaaccgcgttaaccttttgttgttttaacttaacaattagatcttgaattgagtctttagattcatccagctctgaagctctctccgcaaggtctttgcgtctttcgttaaactttttgaagttttcaaaagctctcttgtttacattcttcaaaccagaaatctctgtgttcatatcattcagtctttgtaatagctgatcacttgtgatgtcgctaaaatcatttactaaagcatcctctggcagaagcccaatttccctaatcctttgctgtaattcttctcttctagtaaccaaagttgttttcttaatcatcgttttttcaacacttttttggaaattgtcaagcttctttaatagtaatcgctgttgattgtttgctttttctagcagtttcttattattagtttcttcagcaatgagactttcaatttctctttgaacggtacctagttccaacacagcgttttcatgctgcttttcaacgctttccttctccaattgtaattctttcaactcatcttgtagaccaaaaataaatgcgtcacctacttctgacatcttggattctagatcattttcttgtgggataagtttggactccaattcggcattcaacgagtcaatggttgtagttataccttctagggcgtctgatgtaatatttagcttattgtgcgctgcactaatctcctttgttaaagattctaatctttccttttcttcttttgagagttcgctatcaaactcctgaagcaaatcattttcgaatgtatttagcttttcctgagcaaatgtacgatttgtattcagcttttctagttttagtataattgcgtttaatgattcttcgagaattaatttttcattctttttggtgtttagcgatgttctatatacctcgatatttgttaagacagactccctgtcattagaaacctttcttatattcccgtttacttgatcaatcttagtatcaatatcatttagttcatttcttacgaaatctaattcttccagtatttttttgtgttgacttcttgattcatttaagtttttcaatgattccaaacgtgttcgtttgtgctggtcaagatacccacctgtaagtacacctcttttgtctgctctatcaccatctaaagtgatggcattgagtttgtgtttcttagctaattttaaaccttgacctaagtctttgacaacaatagtttttccaaaaacgtgtttgacagccttctcaaacctgggttcatattttatcttctttatcaagggagtaaactggatttgtgtagtagtgtttgaggggaatttaacatcactgtccaaagataacctgttcaagggaataaacgtcactctcccacccttcatacgatatagttcgttcataatcaaagtggccgtttcttcggtatccacgacaatgtggaagagggagttacctccaattacttcagcacatgtcttgtacttatcattgactttaatcagttcacctaatgtcccaaagacagattccggtgatatttttagtttttctgtaatttctttcacatttattataccatttgccaatgatctactcatggtttcattaacatttctttgattttgattgacgtcacttaataaagtttccaagactgtctgtaatttttgctcctttctccacaattccttacgagtgtctaaactttcactcagcttctgtttgaggtgtattaattccgaatcaaaatcttctaattgacccttggtatctggtccattgatagaatcaattagctcttcaatctcttcatcaatcgcagagtactgcttccttaaagaagtacgatccatttgcaattgactttccagttcatttaagttttgtattgaagatttcagttcttcaatttctgaatgaatccacgtatcgcgttcatcctttgatttaaaacgggcatattctcctttctttaagataagatctctctgcttttgttgcaaggaggccaattgaagtttgtacattgcttcttcctttgtgagttcttgatatctaggtaaaattttagacaacttttgtttcctttgctcaattatagatttgatctctttcaaagttgcactatccaaatttctctgctcctcatttgactcaatttgctgttgaacatcctttatttttacgttgacgtttgttaatttctgagaaatctcagattcccgtagttttgcctgttgtaaatcagtcgcatttttgatcttcagtgaagcttcaatacttgatagctttttggagacttggtcaatcatatcctctcttttatccaactcctggatgtattgttcggaagagtataccgtgttattataatcaccgtccagtctttccatttgattgataacctcatttaattctcgatcatacaatgtgaactggtagatctttctgttgcgttccaactcgttgtatttctctaattccttacgttcctgttccatttcactcaatttagagtttagttcacccatttccttgttaatttgaatctttttctgctctgtttcctccatttttttcaatgaagctttcaattttacttcaaatgacttagctcctacaacatcttccaataactgcaatctttccttatccttggcattagttaaggcgactattttaccttgtggtactatattatacggattattcattgaaaaaccagcggtttccaacattctgactatgtcccctttggtcacgtttctgtcatttaattgatagtcatccttcttcagccctactgttcttctaatggtcacttcgtcatctcctctcgaaagtacaccggagggcaatatcatagaatgatctggatcgtggaacacaatttctaccgaggcactcatcactgaaccaccagaaccttggtggataagcccttgcctttcttccctcttaagattagagtaatcgtcactaagaacaaatctaatcgcagcgaagaaattcgatttacctgaaccattggagccaataataacattctgatgcggcgagaaattatcaataatggtttcgttcctgtaggttttaaaacccttaattatcacccttttgatatacattgcagacgtgaactattaccgttactccagcaggtcgtcttgtaaaaaaatggtgaaactgtttaaagatgaggttgaaaactcatctttaattagtttaatcatttcctaacgcgtcgcgtcttttcctattcctgagactttttttctttaggttcctaatagtgaaatgtgacaggtgtacacttcgatggcaggcaaaaatagagccaaaactgcttataagttattccaagtgaaaggagttggttgcgagaagggcccagaaggtttcattcattgttggtttagtgtattactaaggccgatcttaacgtctacgaaacgaagtatgatactgatctcgggatactgtcttttagtgtatagcgttattttgccagtactgatatcggcttctaagttatgtgatttggctgagttacaacgattgaacaagaatttaaaagtagacactgaatccttgccaaaataccaatggatcgctgggcagttggaacaaaactgcatgactgcggatccagcaagtgaaaatatgtcagacgtaattcaactagccaatcaaatatactacaaaattgggctgatccaattatccaacgatcaacatctaagagctattaacacatttgaaaaaatcgtttttaatgaaacttacaaaggttcttttgggaagctggcggaaaagaggctacaagagctgtatgtcgattttgggatgtgggacaaggtgcatcagaaggatgatcagtatgcgaaatatctgtccttgaatgaaaccatcagaaacaaaatatcatccaaagacgtttctgtggaggaagatatttctgagctgctacgcataacgccgtacgatgttaacgtcctctccacgcacatcgatgttctttttcacaaactagctgaagaaattgacgtttcgttagctgctgctatcattttggattacgaaacaatcctcgacaagcatttggctagcttaagcatagatacaagactttcgattcattatgtcatatctgttttacagacctttgtacttaactcagatgcgtcgttcaatataagaaaatgcctttccattgatatggactatgataaatgtaaaaaactaagcctgactatttccaaattgaacaaggtgaatccatcaaaaagacagatcctggatccagcaacatatgcatttgagaacaaaaagtttagaagttgggatagaattattgaattttatttgaaggataagaagccatttattacaccaatgaaaattcttaacaaagatacaaactttaaaaacaactacttctttttagaggaaattatcaaacaattgatagaagacgttcaactgtcgagacctttggcaaaaaatttattcgaagatcccccaataaccgatggttttgtcaaaccaaaatcatactatcataccgattatctagtatacattgattccattctttgtcaggcttctagcatgagtccggacgtcaagagagctaaactggctgcgccgttctgtaaaaagagtttgaggcattcactaacactagaaacatggaaacactatcaggatgctaagtccgagcaaaaacctttacctgagacggtattgagtgatgtatggaattccaatcctcatttgctgatgtatatggtaaactcaatacttaataaaagtaggtctaaacctcattcacagttcaaaaagcaattatatgaccagataaacaaatttttccaagataacggcctctcagagtcgaccaatccatacgtgatgaagaacttccgattattacagaaacaattacaaacctataaagagcataaacatcggaatttcaaccagcaatatttccaacaacaacaacagcagcaacaacaccaacgacatcaagcacccccagcagcgcctaactacgacccaaaaaaggactattataaaattcttggagtatcgcctagtgctagttcgaaagaaataaggaaagcatatttaaatttaaccaaaaaataccacccagacaaaataaaggccaaccataacgacaaacaagaatcaattcacgaaactatgtcacaaatcaatgaagcgtacgaaacattaagtgatgacgataaaaggaaggaatacgatctttccagatcaaacccccgccgcaacacttttcctcaggggcctaggcaaaataacatgttcaaaaatccaggaagtggcttcccattcggaaatggctttaaaatgaattttgggctttgatgaaatacattctatgcccattaactaggataccacaacaagtacatatatatacatacgcatatcactgaaagttctaattattgcaaagccagcacttttttaaatattgaattcttcttcatcattttcagtaccagcggtaagagatgctgtgtgaatttctcgcagtttatccatgatttcagtaatgaacggcctcaactcattgatttctaatagacttaaattatccaattgtaaatgagattcattcaaatacttaaggccttttaacactttgatctgccttatttcccttaagtcttgtattttaccacgtaattcgtgaatggggtcatgaaaatcatccttagctttattgaaaagtatacgtgccaagacaagccagttccacggcaactcactaaacctatccggatgagttttctcatattgtatttttctatcaagctctttcgtcgttaaccactgtggtgctacaatactgcacttggattgttgcttcagtaatagagcgatccaaagaaccacttctgtagaacgcatggctaccatattatttaaagctttgtcatctgtagtaataagttgccagcgggtgtggtttccagttcctctatcatcgccacgaattttttggcgtgttgttattctgggaaaaatctttattggctcgttttccacaatgaactgtatttcttctggtgagaaagtctgctgcaaatgtgccggtagtgacatgcgtctatgaaactagtcttatttcagatcagccgttgatcctctctaagtataaaactcttttttgttaaccatttcatagttacactttaggcgactgatttttcattaaatggaaaatatcacaagaaatttcacgctggagaaaaaaaaggttagtcatcactgatcttcccatggagtcataagcacgttcgacataaattgtgaaagttaacacatttgaagctaggaccgtcaatctaggacactagtcggttacttttatcatgtggaggagaatattcgcgcatgaactcaagtatgatcaacccaatgcatcttcaaaaaacttgatcctttcagttctgaatacaaccgctacaaaacgagaggctaaggattatctctcaaaatatacaaatgatagtgggcagcataatcattgtttgttttttatcagggacctgcataaagtcgcaccagcgattttgtcccagttttcaagtgtcataaagagactaggaatgctaggtttgcgacctatgtttgtaattccgccgtcgccaactcatgtaaatatacaggcagagttacttgacagtatcgttacagaagcagatttaaagccacttcaccttaaggagggtcttactaaatcccgcactgggttatatcattctgttttttcgcaagagagtcgtttctttgatattggaaattccaattttataccaattgtgaaaccttatgtgtataatgaagagactgcttcagaattcatgacaaaggatgttgtaaaatttatggattgcctgtgccaagggaatattccacacattgacaaattcttcattctaaataatgccggaggtataccttcgggagagagaaatgataacgctcatgtattcatcaatctttctcaggaactcgagcatttgtcctcgtcattatctcacaatataagcactctaaccaaacgagagccacgctcccaaaacctgttacacagaatggaggtgtacgttaaaaaagatgagatatcttccttagaatgtgaataccatgatcatttagaaaacctgttattgatggacaaagttttatcaaatctagcggctacagcaacgggactgattacaactgtcaaagctgccgcactatcatcagataggaaaaatcctttagtatataatttattgacagaccgatcgctaatttcttcttctttaccaaggtttaaaaaaaaggacggcgagatagactcaccagccaacatgtttgatgatcacgcatggtatgaattgccttcccaacaggtaaatgcagctccttctaactcagatgcagttttagtgacaactgttctcaaaaagggcgtccatatcaaaacttatgactataagacgctgactcaattcaactcaattgggcttccaaagaagtttcacgtacctgagaaaggagcaaaaccctcgagcaatagtccaaaactagatatcaacaaatttaaatccatcatcgatcagagctttaaaagatctttggatttgcatgactacataaaaaggattaatggaaaaatagctacaattattgtgataggtgattatgaaggcattgcaattcttacctatgaaggctcggaggaaaattcctttgtttatctcgataagttcgccgttctaccacacttgaaaggctcgctgggtatatctgatataatcttcaatttgatgttcaaaaaatttcctaatgagatactttggagaagcagaaaagacaatgtggtgaacaagtggtattttcaacgtagcgttgctgtgctagatttgtcgattgacttagaccccgaacactgtgatgaaaagcaaagccaatttaaactattttactacggtaaccctcaatacgctaagagggcactacgtgacaagaaacgtttaagagaattcatgaggtctgtcagggacatcaagccaagttgggaaaatgaaaaaaatatttcatgaaacaaagacgcattctcctcctccttaactttcaagttttcattttcagtttttaaggtatctatataaatatatatatcttactatgcaaagttgttgatatttcactttaccctaccaaatggagttaattactccaaagtgatcccgaacgaagttccactcttgatccaatgtctcctttctatatcttcttctaatcatcggaacgttgtgctttatcgaggtatctttcgctgtatcgtaccaattatctatcccacccacgttctcctcaaagtaaggcgcctttttaactccaacgccaatccaatgagccttgtaccaaccttcatagccactagatagcacacttgttctcgacaactcgcacaaatctgttgggttcagcaagtaaatacttgctgctacactgtattcttcaatgagaggttctagcgtgtatgaactattgtaaagaatcgattttgatgataaagaaatttttagtcccatcttaaacattttcatgaaaggatttgtctcatatgatctttgttcgcccacagtgatatctctagaaggattgattttggctgtttcctggtctttcaaataatcatgttctagaagcacgtttttattcttcaaaaaggtcgatttttgcgaattcagtaatgaaacagatgataatggcgcagctaaaatgggtatttgaaagagataaaataaatattgaatcattgttgcagtatcccaaagcggttctacctgtagcagaccaccattacaaagcagtaagttgcacactaacgattcaacttgatctgtaaaatataaatccactccaaattgggaagttctgctggatagtggagaacaataatttcttagggtgattgtattttgaagattttgtgaccgcagaaaattaactttcgctaaacttttataaatataatacatgtaatgcgcaacagttggattgtcaccctgtgctgtccaaaattttggcttacaattcatatcagtaaattctttccagtaatattcatccgactctttaatgaccagatccatagaacacacatttgataaaaaaaactgcagaccaatgatatcagtatttacagatgaatctattggtaactgctccttttccagagtgaataaaggattgaagataagatccaaaaactcctggaaatttgacacgacattttccttgaatagtttgggaaaaatcctggcaatttgtatattccagcggatattatacgatactagcttccatcgtagcaaccattgagaaaatttcttgtaccagtcttcaccactggaatagaattgaaaattaactgatacttgggccaattggtactttgatttttcgaggatatgaataacgtattttatgaaaatttctgctaggtactcaccttcaatgaaattatcaaactccagaaacactttggctaataggtaaaacctcatttctttgccgaccaactttgctactttgttaggagttagatggtaatctattaggtaaatatttctataccaatccaagaattcatcatcaatcaatttcaacccaatcgcaatgggttggtcattagaagaacaaccaaactgaaaaatgtctctcaaactgagtttccttgacgtttccgggtcttgataaactatcctttcaggttctaaatttattttctcccatatatattcactcaattgacgttgagaaatacaaccacttaaagacaagtctcgatctaccttacgagaattataaaaatctctgtagggaacatttttattagctaaaatttctttcttagagtttaggtactgaaacaattcaaatttatctaataaataagataatcgctttcgtgaaacctcgttgaatttatgagattggattaactctattatgtatgcaaaatcatccctaaattcttgaaacgtaggcacatctgttaaaaattcttcctctagtgactcctccttactagaataaggtgaaagtgggttttgcgtattttcctgattacttaaatggtaaatgtattgttttttgtaatcctctaaatcgaaatattcaccggtgtatggtacttttatatttccttttcctttcaaaccagattttgtgtagtagtagtagtgatcggtaaagtaacttgggtaatagtagccatggcggtgcggtgtagcggctccggtcccagtactgtctccatcgtcatttaagtcagagtcagagggatcttggaatcgtttatcgtcttcaaatctccaaaactttggcagtggttttgggtataaaaaccacttttcagtgtcattttttatgtttgaaatgccatcttgtttggaagcagcaatgtatctttttctcatttgagaaaccaattcaaacggattaatgaaaagatctttagtttcttcacccgttttcagatttgagggcgtgtacgatgagacaaagctgtcactttctccatttccataatgatgggaaactgaaggaagtggatcaattttgttttcttcgtcttcaagatcgaaaaacataggtgaacctaaaaccatttgcctgtcaaattccgtgggcaaagaaatcatatccatatcatcgactgatatttccttctgtttcaaaacagatggggagacatcaccgtcattctctgacaagaccctggcttctttattcttcgtctcattaggcttagtaacagaattttgatattcgtcaaagagtaacgagggccttctctctaccgcctgcataattcccagcgagatgaataagtaaagtgagatttagataactcttacagaggatattgagaggacattttaatcaaattctttaaactcaatgtcccctttttttccatatattatatttaatttctcggacaatttttcatttctgactataaatgacagcaagaaaaaagtgggcagaatcatattcaatttcaagtttcttcgcaatttttttacagtgatattttgtgtatgtatttgtacattgcttttaatatctaagtttgtctataaatggaaatttagtagtggtttaatttccagagcctcactttaccttgttcgttacccacggccagtagcccaccagatggcgaaaatgcgacactggtaactttacccaaaggcgtcccgctggtaggccagttgctgaacacgctacaagaaggcagatgaactagtctcaaagcatccttgactgcacgggatgccatgcacagtatttgaccatcaggggaaaattgtagattagaaatggtagttgttagctggtccaaggcggcgacaggtgtaggggtcgacgaggtcatagcattatttctatcgtaaagattaacaaatccactctcactacctaccgcaagccacctattttgctttatcttacttatttgaagagccggacaagtagttgttgtcccaccaccaacttggatttttgttatacccacgccaccttggtctttccatcttcttataacatggccattcttattcaagtcaaattcccacacttcaccatacgcgtttacagcaattaaaatggtcctaaacttaccacgtgaaataggttgataatcgatacagaaatccgttatcacaccttctatcttgcagcccattaaccatagtccggaagtggaatgtaaaatgttaatccaaccattattaccctgtaaaaggacaattccatggacagaatttgtttgtgaattctgcaaatgtgcaactttgaaattctcaaatgatctttgagtggactcatgtccatacaatctggaaaatttttcgattttggcagtctgtgaatgagttaaattttctaaggataagtcccaggaatgcatatatcttcttctaccggcggtgaatatattttgttgattttggtttgatagagaagtatagaaagtacatgtttgtattggagacccaaccaggtgcaaacttgtcactagatggttcgttttcccgtcaatatgatatattcttaaggtcttatcatacccacccgttaacagtagaggcttagaaggatggaatgaaagagattgtatggcggaatgagacgggtgtgatgcatttgcatctttaagacgcacaatgtcaagtttcttagggggtaatagtttggaattcgataaagtgtctttataattgtaagtagtagacaggatcttcgttagagcattaatatctccattaataacattattagagccttcttcttcatcgtcttcttcgtcatctaattcagaatcagattcatcgtccacccatttgggccttggatatatcttttcaaactgagatctcaatctgttgatgtaatgaacaccgttgattttggactcgttataggaggttcttaatttctttgtcttattggtaacaagaataggcactttaattttttcatcatccgaatctatccaagcagcttcttcagagtcctcagaataatcatcgcttgaagagtcatcttcgtcatccacgtccatggtatcttcattcttatcttgactatcttcgttaccaccatcgtccacaaaaaataactgatcgttgttaacatggtctaattcaccgttctgcgcttcatcttcttcactgttatctgattcagatccctcatcctcctggtcttcaacatccatttcttgttcattgaaaatgaaatcggcattaaatttagcgagattttcttgtaaatctgttgtatcaccgaatacaaatttggctagtaactgttcttcttcatctggtggaggtacgctaacattcattgcggttgttgccattgtcattgtcgcactaatgtaggctgatatacactttcaagaacgataccacaacaggaccagagtgatcgatgagatgaggtgaaatttttttatttttcgtttttttcatttcatattattaaattcgtcggatgtgatgccaattaaccacataatagcaatagtaatggaagttacaggtgacataaaatctactgcgaataacctttgaaaggataactatgtttggccatttttttctacggacgtatatttcactaaatatgtacatagaaaagtcataaaaattaccataatgaaatgcgatgcctctcaaatcaaacccaagtttcgcgcatgaaattcagcatgttctggaacgaaagtgctgacaaagtaataggagtgatcaaagccgtgaactttttttatttccacgtagtcctgccatgaagtggctttcaccgcctcaagtagtaattccggtttcaagtgttcttccaaaaagggatcggagtctcctacatggatcaaaattctgtcgtcgcccacatgtctaatattcttgattaataaacatgggtcgtacgcttcccactgggctttttcttcgcccagataacctttaaacgctttttgaccccagggaacgttggaagggttcacgataggggcgaaggcagaacaagatttgtatctctttccggaatagcccttcaaatacccacaaattgcaccatatccccccatcgaatggcctgtgatggcaacattgtccaagaagtccagctttacgtcaccgttcttgttaaaatgagaatctaatgtttgtgggagttctttgtgaatgtagtcgtacatctggtaatgttgggcgtatggttcttgggtggcatttagatagaatccggcgccctgtccaaaatcccaggagccctcaggatcattggctacttcgtcaccacgtggggacgtatccggaaagactattgcaaatccgtacttgtcagcttgaaactgccaaaaagccttctcagaggcgttgtctggcgtgcacgtcaagccagaaaggtaaaacacagttgggatacgcttatttcttggaaaatcttgggcgtaatagtgcttaggcaaatagatattgacgttcatgctggtcttggtagagttcgagttatgtgacaacttgatcaatctgccaccacagacactaaattccttaacaaccttcatattgaactatgtgaatcgcttatatgtattttattgatgctatatattgtcaaaaatgtgtattgatcttttgtgtgtgtgtgtgtggatctccccttagcagtcgcatgttttccacacgcgcaaggtcataatcgtgcgatatatacaaggcatattgtgtaagatatgagtaaaaaaaggaaacgaaaatatgtcctaattgtcttcgtcaacactcaccactttatgcttcacctggggactggaacccttggaggtagtggtggtagtaatgtctaccgtgccatcgtcaaagtagattttttcagttttgacggtgctgggttttgcatcattggaatccttcgtggtactaatggactgtgcccttccaacaattttcttggatccatctgcagaagcatattcagcatcgttgcccagatgcaagtcgtcccaattcaacatgaggtcttctggagttctagccagaggctctacggcagtgctcctagtcttgattctttgtttttgtagtctattcatgtgcgacctccacttcaaaaagaggttgaaatcattgaagaacaacccatgagagtgcgacttgtcagatttgatctcctccagaggtaagaggaagtccaattgtggtagaggggggatagccttacttgggacaagacatttccaaatcccttgggtggtccatgcagactggcccttaagttcttcgcacttgtcaaactgcttcaccgtagggattccggacgccatggcaagtgcactatctccaagatctctgaagttgaaattgaagggcagtggtaggagtggattatcgtattcatcaatatcccttaactttggaaagaggttccagaagggtgccgttgcgaacttttgatctttgatatatttgtcattaaatgccttggtgttggcatcattgtcatcgccttcataaaagcccatatcgagtaaacggtttgtcggtttcctttgtctttcttgtccttttcgtttgtaacctcctaaattcaaggcttaatattttttttttcccctttacttaattaacgtataaagaaactatgttgttctacagatcgtgagagagagaagaaaaatccttctatgcaatgtgcttgtgtagttattcttgatcagtaacgtcttcgtcgtcgtcttcgtcattatcaagatcaatctcgacaatgttgggcttcggagccgtatcgttcaccacataggcggagtaaacttcattagggggcatgacacttgtagtatatctaactcggttttcttccactagaagcctcaaattctttgttgttggtatcacatcattcaaaaactgcagatggccgtcagaagagtgcacaattgcggcagagatgtcatcgtacgacagcgtgagttcatctgggagcggcggtacctgttgttgttgctgctgctgttgcctatgtagggactcatgtgtcagcacctggacgaagaattctgtagcaaacgctgtggctacgaatgcgtcatccgaagtgtccatatattctggatcattcttggctattctctgcactttttctacaggtaacttgggcgaacacagaggtgcagacgccgtttctttaccactagtctcgttgttcattgtgttagcctgatcacatcgagcgagctatcctgacgctattctctcttgtttcttctgttttgtttctcttacatttttcatttttttctctagttggaaaaaaaaaaaaacactatattagaatacgcacattgttagcgctgttctttcaattgtcatctatatatttacaagggaatacacaaaatcctggtttttttaaggtctgggaaccatgacataggaggagggtttcttcgtcttctttggcaatgacgaagagtagacctccttcaaaagtgcctgcgtcctttcgttttcgagtgcctcatcatagggaagggacatttccttgagtaagacctgcttgatgagcataatttcaccatgtagctgcgcttctgctttaaacttggccactttgtgaagattctgcaatgtgagtgggttatgaggtagctggttggcgtcatcgttgatgactgacttgactaacagccacatctttaaattgcccctgttcaccgtatgcgattcggacatcacgggagagtcgactagttccaagacggattgcggcgctgagtcgttagccctaggctctaaccgcagcacacgcgtgtacccaccgggcctttccaagtaccgcggtgcgatctcgctgaacaaccgcttcatcaactttctgttgtctcctgctaaaaacaattggctctgaatttgggactttaattccgcctgtgcaacactattacttgtcgttattgccctctttgtccaggtaatgatccgctctgcgaccctggaagcctctttacatttggcatgcgttgacactatagattcatgctgaaacaactggcacgcaaggttttttagcagcgcatccctatgcgccttgtccctagagagtttcctagcaatacccactgtcattgttgcgctcgactgtgcttctcaccgttttttctccttggcgtagccaaatctcttgaccgttataagctgttttagcttgtcaaatcccacttgttcttgttaaccaacttttcccgcctcgtacgcggtgacagacaaagcagtgatttttgctcattgtataaagggagtctttactatggtggcataagcaacaatactacgtgagcagcaacgaaagcacatatatagacgacaaagtagtatggttttgaatccgtccaagtaccaagacacccgcacgtggaagatgacgcctgccatgatcagggcccgtaaaccctttttcaaaggcaatatgctcggtctcacgctgctgctgggtgtcacgggctctgtttactactacacatatcattttctgcacaaggacaacgactttgcagacgtgcccattccacccatcgatccgcaggagctcgaggctctcaaaaaggagtacgaagccaagaagaaggcatgaaaagaccgttaatgtggaggtacgctgtggtcttccatcaataggctttgcgctgttcttctctcctcttttgtaaatagtttacctacttgcgtatatgtatatatatatatatatagatatgcttatacggatatatacatacattctgtttgtttatactctttgtcctactctaacagccagctctttagtttaagaatatgatgaaaaactcagtttgggaaaaaaaaggaaaatgttaaagtataaacaatatcgaaataagttcatctaccacgcacacttcaccaagttagcaagatgaacttgaagcagttcacgtgcctatcatgcgctcaattactcgctattctgctctttatctttgcttttttccctagaaaaatcgtgctgacaggtatatcaaagcaagatccggatcaagaccgtgatctccagcgcgataggcccttccagaaattggtgtttgtgatcattgatgctctcagatcagactttctttttgattcgcagatttcccacttcaacaacgtgcaccaatggctcaatacgggcgaagcatggggttacacgtcatttgctaatccgcctaccgtgacgctgcctagactcaaaagtattactacgggatctacacctagcttcattgacttgctgctgaatgtagcccaggacatagattccaacgatctttcggagcacgattcctggctgcagcagttcatccaacataataacacgattcgtttcatgggcgatgacacctggctgaaactgttcccacagcaatggtttgacttcgctgacccgacacactcgttctttgtcagtgatttcactcaagtcgataataatgtgacgaggaacttgcccgggaaattatttcaggaatgggcccagtgggacgtggctatcctgcattacttgggtcttgaccatatcgggcataaagatggcccgcattcaaagtttatggctgctaaacatcaagaaatggacagcattctgaagtcaatatatgatgaagtgttggaacatgaagatgacgatgatacactgatttgtgttcttggcgaccatggaatgaacgaactgggcaaccatggtggctcttcagccggcgaaacatcagcaggattgttgtttttgtcacctaagctggcgcaatttgctaggccagaatcgcaagtaaactacacattgcccatcaacgctagtccggactggaatttccagtatttagagactgttcaacaaattgatatcgtccccaccatagcagcactgtttggtatgccaatccccatgaacagtgttgggataataatacctgactttttacaactgttgcccaataagttggcaagtatgaaagaaaattttatgcatttgtggaaattatcagaccatcacggcgaggttgctcttgacgatttcactgccgaagatatttatacaaagatgtacactattcaagaaacgttaaccaagtctgcaacaaattataattatcctcttttgacactggcttttgttggtttcctcataataacaatcatcgccatttatgtattattacgttattctgggcctgatttttggcagttgcgcgtttcttccctgtctgttctgttagtttccattatactaggcgtttccacatttgcaagtagtttcattgaagaggagcaccaactgtggtggtggatagtaactgcattctcggcggtccctctgttcgtataccgattgaatgtgctcataatcgtgcgctggtttataatgatggcatgcgtacgctcaatcaagttttggaataacagtggccagaaattcatttattctaacgttatgtccaatctacttaatcagaatccttcctggaagtggtgcttaaatatgttgacatttctagtgctgataatggcatctgctggttttcaagtactacattttattgtcactactattttggtggggttgtgtttcacgtacaaaatctcgtgggaaatcgtcaatggtaaccaggcagaaataccgctctttatgcatgatttactggctaagatagactttgcaccaactgaaagtaacttgattgtacttgcgcgcgttttcttccaagcttgggctattgttgtcatttcaaggttggtcctgacgaaattgaaagtacttaacaagaactacctcattaaagatatgaaagtttatataacaattcttttgatgttccaaacttcttctcagaacataggtcaatttctcgttttccaaatattagagtcccaaattttttactttttccaaaatattccaaccgcctcattaacatcaacaagtaagatttatttttcgaatttggtgtccttaattttacaaaattttacatttttccaattcggtggcacaaattccatttctactatagaccttggaaacgcataccatggtgtttcctcagactacaacatctacgtagtggggatattaatgtccgttgccaatttcgcgccggcaatatactggtccatgctaccgtggtcaataaactacgcctctattccagcacaagttaagttgcaaacgttcatcagaagtaagttacctgccttcacctatcattgtatatttggaacttgtttgatgacggcatgcgtcgttttgagatttcatctctttatttggtccgttttcagtccaaaattatgttattttcttgggtggaattttgtgatgggattgctgaatggctggttacctgaattggccctcctttgcgctcttgattaacatagaattgttcacgtggtctaaatatgtatacatatatgatagtttatagattcatactgagacaagtgaaaaaaaaaaaatctactatcgaccttctctcttttcgcggcagcaaaaatgaaaaattaacttcaataaaaaagttgaatactttcaaatattctaattgcatttaatatttaagcaacaaaaggacagcgataattgagtggtggcttaattctatactccaaagtatgtcccaatctagtaggttaagtgcacttcctattttccaagcatcgctttcggcaagccaatctccacgttacatttttagttctcagaatggcacaaggattgttttcattcaagataacataataaggtggtacaatgtactcactgattcactttaccacagtttgaactttagtcgtcatctcgtcttggatgataccttccatgtaatatctagtacgtctggtgacctactctgtcttttcaatgacaacgagatttttgtaatggaagttccttggggctattccaacgttgaagacgtttccattcaagatgcattccaaattttccactattcaattgatgaagaagaagttggtccgaaatcgtccattaagaaagttttgtttcatccaaagagttatcgtgattcttgtatagtggttttgaaagaggatgacactatcacgatgtttgacatccttaattcgcaagaaaagcctatcgttttgaacaaaccgaacaactcctttggtttagatgcacgtgttaacgacatcacagatttagaattcagtaaggacggattgacgttatattgtctaaacaccacagaaggcggtgatatctttgcattttatccatttttaccgtcagtattactgttaaatgagaaagatctcaacttgatcctaaacaaatctttagtaatgtacgagtccctggattctacaacagatgttatagttaaaaggaatgttattaagcagttacagtttgtgtcaaaactgcatgaaaattggaattcaagatttggcaaagtcgacatacaaaaggaatatcgtttagccaaggttcaaggaccattcacgataaacccctttcccggcgagctgtatgactatactgctacaaatattgcaaccatactaattgataatgggcaaaatgaaattgtttgtgtcagttttgatgatgggtctttaatcttactcttcaaagatttggaaatgtcaatgtcgtgggatgttgacaattacgtgtataataattctttggttctaattgaacgagtcaaactacaaagagaaattaagtctctaataacgttacctgaacagttgggaaaactttatgtcatttccgataatattatacaacaagtaaattttatgagctgggcttctacattgagtaaatgtatcaacgaatcggatttgaatccacttgcaggattgaaatttgaaagtaaacttgaggatattgccaccatagaaagaattccaaacctagcgtatatcaactggaatgaccaatctaatttagccttgatgtcgaataaaacattgacttttcaaaatatttcaagcgatatgaaaccgcaaagcaccgcagctgaaacaagtatcagtacagaaaaaagtgacacggtaggagatggttttaaaatgagtttcacacagcccataaatgagattcttattttgaacgataattttcaaaaagcctgtattagtccatgtgaacgaattatcccatcagcagaccgccagatacctttaaaaaacgaagctagtgaaaatcagttggaaattttcacggatatttccaaagaatttttgcaaagaattgttaaagctcaaactttgggtgtttctatccacaatagaattcatgagcaacagttcgaattgacgcgccaactacaatcgacatgcaaaataatttcaaaggatgatgatttaaggagaaaattcgaagcacaaaataagaaatgggatgcacaactaagcagacagtcagaattaatggagagatttagtaaattgagcaagaagctatctcaaatcgccgaatccaataaatttaaagaaaagaaaataagccatggtgagatgaaatggttcaaagagatacgaaaccaaatattgcaattcaacagctttgttcactctcaaaaatcccttcaacaagatttatcgtacttgaagagtgaactaactcgtatcgaggcagaaactatcaaagtcgataaaaagagccaaaacgaatgggatgagctacgcaaaatgcttgaaatagattcaaagataattaaagaatgcaatgaagaattgttacaagtttctcaggaatttactactaaaactcaatgagtaagcgacttgcatagtctgctatcatatatgtacgctaagaaacaactgggcaatggtataatatcatgtagcaagaggacattatatatgaattggtcaatatataaagccttctgtgcaccaaatcgttaggatgatttttcagtatgctgtatcattgtatcgtatattcattcgtatctcttttacctcactaaccgctgccaaaatttacatgtatacaaaataaaagtcttttttatgaccttatttggtgagtaatgctacttttgtaaagagtgatggaaactattattccaaagggttagaagaaggtgaggaatacgttcatatcaccgctacagatcgtgtctctcggttatgagtaatcaaaccctctgcaagcaacacagttactttttttcggttttttcttttcgtgtgaatttttatccagtgagtttccttgttcactttcgagaatggaaggctgatttcgaatttttatattcaacaactgtatttgtattaggctttgcaatagtagatgaaaagtgcagaagacgaatctgctaccctcacaatacaaagaaaaacaaaatcgtcattttaatataggaagacaccgctcaggtaattcaatattgaatctggttgcacttttcttacgatgtaaatacccacaaacttcttgtacggtgagcgtctgacaacgaaatcaatttacggagcaaggattttgacagtagagcagattgttttgagtaggatttaggaatcaagacctccatctttgtcgcattattcctaaatgtaacgtaactcgtttgataagagaatgtctaatcgaagagagttaataacttaataagctctttaaaagaacgatggcatttatcgtctcctatgccaagataattactggctcaaaattgttcagcgttcataaaactttgatatcactttctggcgcacaagctaacctttatgtagttcttacgtagattctttttagcaagtgcctggtagtggttattacataaatgtatcttttcatttgataacaatttcttcagtagcatgtcgtgtctagcacgtgacgtagaactgtggcttttttgttgtcattatgacaatcaagataccaaaattcagtcatgtttaaaaggggaaggtacgatagagatatatataaagtgttcaatttactataattgcgtatagaatccattgttacttgctctcaatgaaacaacgattcattcgtcaatttacgaacctaatgtctacttcgagaccgaaagttgttgccaacaaatatttcacttctaacactgccaaagatgtttggtcgctaaccaatgaagccgctgcaaaagctgccaataactccaaaaaccaaggccgtgaacttattaatttaggccaaggctttttttcatattcccctcctcaattcgccattaaggaggctcagaaagccctagacattccaatggtcaatcaatattctccaactagaggtcgaccttcattaattaattccttgattaagttgtattctcctatttataacacagaattgaaagcggaaaatgttaccgtaacaacaggtgccaatgaaggtatactttcttgcttgatggggcttttgaacgctggcgacgaggttattgtttttgaacctttctttgaccaatatattccaaatatcgaactttgcggtggtaaagttgtttacgtccccataaatcctccaaaggaattggatcaaaggaatactagaggtgaagaatggaccattgactttgagcagttcgaaaaagcgattacatccaagacaaaagctgtcattatcaatacccctcacaacccaattggtaaagttttcacgcgcgaggaattaaccactttaggtaacatttgcgtcaagcacaacgttgtgattatatctgatgaagtctatgaacacctttacttcactgattctttcactagaattgccacactctctccagaaattgggcaactaaccttaacggtcggttctgccggtaaatcgtttgctgctactggttggagaattggttgggtcttatccttgaacgcagagttgttaagttatgcagctaaggcacatacaagaatttgttttgcatctccatcccctctacaggaagcttgtgcaaactctattaacgacgctttaaaaattgggtattttgaaaaaatgagacaggaatatatcaacaaattcaaaattttcacatcgatctttgatgaattgggactaccatatacagctccagagggtacatattttgtcctcgttgatttctctaaagtgaaaattcccgaggactatccctacccagaggagatcctgaataagggaaaagattttcgcatttctcactggttgatcaatgaattaggtgtggttgccattccaccaactgaattctatatcaaagagcacgaaaaggctgctgagaatttgttaaggtttgcagtttgtaaagatgatgcttatctagaaaatgccgtagagagattaaaactactcaaggactacttataagataaatttttttttatactcctttttctcaatatatagattttataaagcatgtatatttttatgcagaagtggtaaatataaacatcaatattccagaataattccatattttcttcgcgtactacaagaaaaagtgaacccttaatgaaaaatagacaatatgaacatttagtaatgttttgaacagtgtatttatagagtacttaaacacatatgaagatatagcgcaagtaaatataaatgagtgacaaatctcatcagatatattgctacttttggctctttggtttgatcaataatgtactttatgtggtaatactttcagcagctgttgatatcgtgggtcctaccttgcctaaatctctagtattgctagcagatatattcccatcactcgccattaaattgtgttccccattctttattgatagaatcaagtacagctatagaatatggtctttgatcacgatgagttgcttaggaatgttcttagtttcttttaaaaacttgtttgtttgtcttttaggaatatctttcgcatctatatcttccggatttggagaagtgacattcctacagctaacacactattacaaacaaatttctttgaatggatggtcgtcaggtactggtggtgcaggaatcattggcggagcatcttatatgttcttaacttcaatctttaaagttccagtgaagctaactttactagtatttagtctccttccatttgcatttttgttttattttaaattagaatccaatgataccaacctgacttaccaaagtcttcaacaaattgacgaagcagaggatgaccagttggtgccctttcctgtcgcctttacacataccaacgcttcgcaatccctgtattctacaagacagcacattttgcaaacggtcaagagacttcgaagattggtttttccatacatggttccattgaccaccgtctacttattcgaatatttaataaaccaagcggtagctccgaccctattatttccgattaatggtgatgaaagaagtaaatcgatgccatttttcttccataaatacagagatatatacgtaacctatggaacgctctaccaattaggtgtctttatatcaagatcctttggacatcttatgagaatgaggagtttatacatcttagcgtttttacaaggtgtgaatttgtgcataacggtactgcaatcatggttttatgtcacacattcgccctgggcggtgatgatattaatattctatgagggttttcttggtggtgcgtcatatgttaacacattcttaaatattctcgaacaagaggatcctgatgaaacagagttcgccatgggtgctgtgtccatcgctgattcctttggcgtttttttggctgcgttacttggtttggggctagaacccaaactttgtaggcatcaaattgccgatgacagaccttggtgtaggatggaataaagttttgttgtgatattaaataggagattgaaataaagtgttagatgctttctatatactcattctaatgcctgctaataactcttcgataattcgttgatttctatcattactttgaatggtactcaatatgccaaaacactgcagtaatgtcaatttatctgtttctgtgacattactttcttcttcttgattgaaaatgtaaagttgaaaacttttgctgataccatcgttactatttacgaagttttcataacaaggtaagactattgaatctctaaagcacataagcaaaagaaacccaatagaataattaccattaatgtgagtccgactttcattgcctgactttaaaaccgtagaattaccatcttctctgatactctgatccaacggtaataacacagcggctaaatcataatatacctcttgataaaatatccgccatataacgcctaatcttttcaatgcgttatttattgtgtcttcattagaatagttaaaaacaatttggttttctaaattgtatagggaactaaccaaaaattctttcaaatcgctgataattctattcatgccgctatgtgtgactcttggatctgtttttaaaatgcaatagaattctaaaacttcgttaaaattttctattttggccctgagtttccatattctttgagttctgaataattctgctacgttactacaaaatatattccaaatattatttgttagggttgtcagttcttgggagttgaagtgtttatagttagcttccagagatggtaaatttcttaaaaggtcgtgtaacattgagaccggattcggtgaggcaggatcagttccagaaagcggatcctcaacgattgtgttgggattgacaccagatggattaacattcaatgagtacacagaagttcctgagtccacaagttgccccgcattagtatgaataaattgtgacggagatttatgtcttccgtaagaggaatgcagaaatttactcaaggaatttggaattgcaggctcgatagcatcttgaccaatgtgcctgtggcttttattttggaaaaagttcttaatcacgtttcgaaatgaatgtgaactattatgtaaggtgcttgaatctgtcaaaaaggaggcaggatccgatgaaatggtcgtatgtgctctgtttctcctattaaaaaagccagaagcctttcctttcatatacctgccggagggcgtggagtgtaaacttttctgagtaatggatattgcatcagaagataactttttagatagattgttcgagcactccaccgtgtcaacgctatgagattcccctatctgagaagaaccagatttagatgttgcagctgaggcattgtcattgctcctcaaggaatgatttgaggccacactgaccttcgatcgaggatgatctactgtatggaatatggattggaagccaacgttagaaacactagggctaatggggttcctcgagcccttcaaattcttgatggaataaacgtcatcatttgatgtgtctacaagagtttgccggctaatctcgcttgtagtctgaaaattttttactggggctgtggctaattgcacattaaggtattgttcgctattgacagggcgttgtgtcgtagtagatgttctttctcgaaggagtatatcttctgctgtcataatgaaagaactttatttctacagaggtcaattggcgtttctgtcacctagatcttttcatttggttattccctctataaatttactcatcggtcaatttttctaacattatgcacctttgtcaccggcccttagaagaggtgaagatgattcgtgaacattggtgataagcgagaatattttctataaatttgtaaagtaaaaataaattacgtgctatttagtttgcaatgtgtacttattgttagtatatgtattttttgcatgcggcgatgaaggccagtaaaaccaacgctcttgcatgcttacctctttcatcagctggtgatttaaaaaccattcccaacaatatcagtgacatataagagagccacgaccccgttttggtacacttaaatatgattatcgttaatatcatagaaactagtttgtaacaaacctggattgttctatttaaagcagaatacttttggaggttttgggttgatacggtgctcaaattttcctctggtgctggtaatgataaagtaacgttgtctccgtcaatataatcatcagtaaaactgttggtattctcattcacttccgagattgtactgaagttcaaagtgctatccacattttctttccagaattttttgccgggtttggaatttattagcatttcatctaacgtctcctccactgtcttcgctgtgggtctagcatcattatttggttgtaaaagagcgtccattaggtgaaatattctacggtctattggtttcaatttcatcgcttgatgcttttcaatcataccttcagtgtcgaacctaaaatttttgatgcgtaccttcaaatcaactatatccaactgtggttcaaagggcaattcaccgaagacaataaaatagcaaatcattcctagagaatacatatcggaagcaaaggtgtattcattgtatgtgtgactcgatcttgaaggcaacgtagaagaagaaactggtctcccctggataataaggtctggtgctgtaaactctaatgttcctgtgcaaccagtacccaatctggactctccttccaactgactttcccccaaatcgccaataacaattgatgggaaaaactcatctgaattgtgttccctgtcgtatacgttgtcattctcattgtcacttttaaatggagtcaataataaacagttggatggtttcaagtccctatgtattaggccaatactgtgcagttcgtgtaaacctcttgcaatatcccttataatggatacgagctgttccgtagataggccaacttctcctgatttaccgtgatttttcttgcgagttctaaatttttttttcctctcttcaggtgattcggtatctgagaacctattgaacacttttcttagaatacagtcttctaaattgccgccactgcaatactgttgtaaaatgaaaatacaaggaacttcttcttgtgaatccgattggctcccatcaatggatctgacaaatccaaccgaagaatccatttcgagccacacatgattatacgtaatcaaattggcacttttgtgagttagcgaactcaacgctttcacttcccgtatgcacttattaaaccattccatatcatttccaataggtattttttttagtgcaaaaacacctaattcagtattaccaattgtgtgtacaactttgtaaacagaacctcttgcaccatttcccagcaaagacaatattttgaaaaatttacgaaagtatccggggataaacaaatcatctggaataaagtatttgtttttgctgaactgtccctgcttattgttactatcgttttgtagggcgtagtgccgatgatttctttccaatgactgaaaatatcttcttgaaaagcttgaattggcaaattcaaatccaagtggcacagtgttctctggaatactgagcctactgctttctgattctactccagcagaggctcgacgatgaagttgtcttctgtttataatatcagggttaatttccgtaccacattgcgggcacacataggaagcaatagggcttttgtattgatgaatccctgaaggaaagtccagtgctgataaagatgcagtctggtcttcatttagttcagagtcattattactgttgtcctgttggaaaaatgataaagttcctgaggttggattaacaaccaccactgatttagaattaggatcatctaaaatcagcgaaccttcttcatatggtactaaactcatttctaagttctacttatgctatccctcaaactatatatctaatagtgtttcttcggttacctagttgtcactcataggatctatatatacaatgtccttcccccccacccccttttctgaaacgtatacaaaaaataaagcttgaaatacgttattacgtaaaaaaagtgtactgtaaaagcttacaaaaaagagtttgcgaaaaattataaataaaaagtagtctaggtaaaatatgaaatgtttctaattatgcatttatgtgatcctgaaaaccgcccttcttacgttggaccatgatgatcacatttataaatatggttttctttccaatgcgcatttcactttctgtgagttcaattttcccaaatcgtcaaagcttttggaacagtcagagcacttgtattttttctgatgggtcttaatatgtttgctcaaatttgacgattcgttgaatctcttaccacaaatcttgcattgtaaaggtttttcaccagtatgggttcttatatgaatcttcaaagaacttgaaatcgcgaattttttattacaaatgtgacatttgtaaggtttttcgccagagtgtgtcctggtatgctgaactaaagtttcttcgcttgaaaaacaccttttacatgtcttgcacttataaggtttgtatttcgaatgcacttttaaatgacggattaatttttgtctttgggggaacgtacgatggcagtcatgccacaagcattggtattcagacttaccccgggttaaatgtactgcttctaaatggtcgtttaattcctgagcactggaaaatgacttattgcaaccatcccattggcaaatcacctgttccggctgcttgattggcggtatattggaaacatcatttgcagacgtcatatcaggtgctccatctgctttagaaacttcgtgtgtttgtgggttggggcaatgtagtaagtgatgtttttcctttgatatactaccaggcaaaaatgagtctgggttggcaaattgaatatcaaaattgataccatgttgacaattaatatggttcactatggaacatgtatcatctccaaggaaatcacagtcctcccaattacaagctaatggttccatagggtgtttgaaatcttgagagacatgatccttcaaaagatgtctttgtaggtcaaatagtgagctacaagactcaggacattctttccatttgcattttaagtcattgtttttctcttctttaaaacaccagttgaaatttatagtgcttgttgtctgtataggaggagagatgctagaaggtaatgagtcttccaaagagctgaaatcagtagattctagatcttttgtaggccaagatctacgatttttctgattctgatgagtgactttgggtagcgaagggggctcactttgatttctaaatctttcataactatactctcttgaaattaagtcatttaaatcgttgttagttagatcggctgttgtgttcgccgcgctaatccctgaattgttcacaatattgtttctatttggtttgtgagaatgaaactgtattctatggtgatggtgttgatgatcagttgaagttgctccagccgtattgttattgcttccattaagattatttttagggttgcatctattaatgcttgataatagaagattcattgtttggttaccgttttcattatttcctgtgctcgaaccatcgcagccgttaccggcattattgtggtcgtggtggttaatgtgttttccaaacggtacttcatacaaagaagaaatattgcataaatcttccaaaatcttcaaatccatatcagtatttaagatatgttcgtgataagcatgatttgtaccttgcaaagtgtttgtaggttttcgtaaagatgaacatttgggtggtagttgaggtggctttgactctaaatgcatatgcttagaacaaggttgattatcagtgctctcctcacaaaatttgcagtatttatggaaaacgtcatcattatttgatgattgatgatcttgaacaaacttgtgaccactagtcgcgctcgtgctagccgtgcatggggtgtcacaggtcaaatcgcaatcaatctccgataagtgagacatcagctgagaaaagctatctggtacagtattattgtgattgtgagagtcgtgattggtactattacagtactgatcatgaaggttaaaatttggcatcaagtgatcgttctttacatctgtgaatattgcaacatcattgccgttctcagatatgtctttctttgtcggttgatcagattcaccttgttttatattagcctcacttttgggatgagtttcgtcacaacatatttccaaaatcttgggcgtacaataacaatcatcggatccaggtggtgggttcggtttatttttcttggaagagggcagcagtatcagatcgtcgttaaaccaagaatcttttctacgtggtaggtcgcttttagaattctgttggggacttgtcggatcagaagctaccgaatggaaattgtttgcaaaagaatgattattagaattatacgttgcagtatcattatattttgttaatgacggattattgtgataattcaagaactcgaaatgttggcagtcggtgtactccttgcatttctcattgacgtggcaatcaccacccatatcatggctagctccagatgcaaatgcggaagtagcggcatcagcaacagctgcggctgcaggtgttgccgaagcactactgtcgttcacaggcgcgctgtggtgaaggtgaccatggatataggtcaggttgttgtagttatggatgtgcccgtggacaatgccttctttacctatcgtcagagcatcaggcttggcagaagcagcagtggccgcactcgtggccatcgagtcatcgcgcttgggggagtccctgggagtcaacgcatccattagttcctatccttcttctatttaaaaaaccgtaacacataaaaagtaaaagtgtaatgcttccgtctcgccgctggcctatattcacagtgactgcagttgcatcttatattgccaagcacgtttcatcatgacctttagggtagatgactgctgtcaactactccgtctgcagtgatatataatcatgttttgggcgtttaaggaaggagaattatttccaacagttgaataggaagatccctagagtaaatcgcaggcaatccagtactaagaaacggcgatgacaatggaaaaaaatggaggtaatagcagccgtggtggccaagtaggcggcaagtctgtgtgtgtttactgcgggtcttcatttggcgctaaggcgctatactcagaaagtgcagaagaattaggagcccttttccataagctgggatggaaattggtatacggtggaggcactactggtttgatgggcaagatagcaaggtctacgatgggacctgatttaagcggacaggttcacggtatcattccaaatgcacttgtgtctaaggaaaggacagacgaggataaagaagatgttaataaagcattgttggagtctgtagaaaatcataagggcgccactcctatttctgaagagtatggggaaacaacgattgtaccagatatgcatacgagaaaaagaatgatggcaaatttgagtgacgcgtttgttgctatgcctggtggatacgggacttttgaagaaatcatggaatgtatcacgtggtcgcaactggggattcataataaaccaattatcttgttcaatatcgatgggttctatgacaaattattggagttcctcaaacactctattcaagaacggttcatcagtgtgaagaatggtgaaatcattcaagttgcctccactccgcaggaagttgttgataaaatagagaagtacgtcgttccagagggccgtttcaatttgaattggagcgacgaaggtcacgctcacgaggattgtgctaaataatagaaacgtaagtcatgtatctagtttaaacgatctgtatagataatgtggtgaaaaatccaaatttttaggagctgtctttctaagcccgaaggctggaaaaaatagtactgatggcaaagacatcatagctttaaagtccattgttctcaaaagaagctcaatagaccatgtcttctgaatcaggaaagcctattgctaagcctattaggaagcctggctataccaatccggctttaaaagcccttggtatacccgccttgaggctgccttctcgaaactggatgatcttttggtctgtgttaacagtatccatcggtggcatagcctatgacaaatacaagcaacgtcagattctgagccatgcaacagacttggtgaagcctttggcagaggagtccatggaggtagacaaagtgccacgaaagatcactgtttttattgcacctcctccaaatgattatctggagagttcgttgaaagtttggagacgatatgttaagcctgtactgtattatgcagggttggactatgaattagttcaagaggataggcaagggattattagaactaatgtagccaacagaatcagagaattgagaaaggaaatattggcatcgacggatgggcagccagttaaagagcctaaccaaacggtagcaaaaccaagtggttcttcaaccagtaaaatttcatcactactaccgttcaataaaatcattcaagatcctgctgaagaagatgactcgtttgatccagaaatcggtaaaaagttcaaggagaacttcgactggagaaacgttataggtatcttctatacaatgccaaaaccgaagcatataataagtgaagacgccctgacaaaggaccctatattatctggtggtgttatttgtttaggtagaggcgcctataaggagtacattgccggtattcacgaaggcttgcttggacccatcgagaagaccgaaaaaacaggatccactgagcctaagatgactggggttgtagaagcaaatcaaatagaatcaaaggtaagtgaatccggtgctacggaactggtggatgccgagaaagagactgctttggaagaggccaaagtacaagatgatctaaaggttgatgaagaaaacagctcagaggattcgcaaaaatttttgaagccatttatttcttcagaccaataccctgacctgcaaatcgcttcggaattacaaactccaaatggcgaattcataagaaaccccaatacaaatatcccgcttctgattaatcagccgttattggtcattccaatacctaacttgataggttttactaccattccaaggagaatacatcgtttttaccagaagcgtttctacgtagaggacgtgtgttcaagtgtagttaactgtgttcgacaaacccgtataagaccgtttgatattgcaaaggatattgatttggcgaaggacgaagaaaaagattggccacagaactgggtcaaacagggtaaagaaaagaacagcgaatggacccaagaattagtatgtgatcctagaatcacgaagcatatgtttgtttacgaaaaaccacccaaggaagagccagaatcagatatttaattggatatatattatgttttatcatcatgcacgatcgacgttatgtctgacatataccaaacccttttcgaagatttccctttactcatgttgaaatagtttttatatatgcacacatatacatatatataaaatctgtaaatataataaaatgtgtacattgtaaaagaatccaagcacaactattattagcattatgagtatttttttcaagccgccgattgatattgagatccttttcgataatgaggaatctcgcaaacacgtagacattgcaacaagatcaagtaattccagttacaaatcaatgaaggaaagcttgcccgtctatgaagatggcgaatcccttggtggaattgttactttgagagttcgggatagtaaaaaggtagaccacttgggcataaaagtgtccgttattggatccattgatatgttaaaatctcatgggagcggtaattcatcttctaaaaaagttacctctagcacatcatcttcctcttctaatggttcagtagatgtgcggaagaattcagttgatcaatttttatgccaaagctatgacctctgtcctgctggtgaattacaacattctcaaagtttcccattcctattcagagatttgagtaaaagatacgaatcttataaaggcaaaaatgtggatgtagcttactatgttaaggtaacagttatgaggaagtccacagacatctcgaaaataaaaagattttgggtctatctttataatagtgtaactactgcgccaaataccctttccgcaaatgagacaaaggcaaccactaatgacatcgctggtggtaactatgctgcagataatgcgagtgacaacacgcaaacaaagagcacccagggtgaggcggcagacgttaatcaagttttgccgatatcacattcaaataatgagcccaagcctgttagattggatataggtatagaaaattgccttcacattgagtttgaatatgccaaatcccagtacagcttaaaagaagtcattgtggggcgtatatatttccttttaacgagactaaggataaaacatatggaattaagcttgatcacaagagaatcttccggcctacaaacttctaatgtaatgacagattccactgctatccgatacgaaataatggatgggtcttcagtgaaaggtgaaaccatacccataagattattcttgagcggctatgacctgacgcccaatatgagctgcaactactttaacgtcaagaattatttgagcttggttattatcgatgaagatggcagaagatattttaaacaatcagaaataacattgtacaggacccggtagaaaagctcgaccttaaataaggtgaagatgtggttctctgttctttcaacatctcgatatttaacttttcgtttggcattatagtgttatacataacaatatctagatttcagtagaagacttttgcgtaagttataacgaactaaacaagcaagaggtaaaatacgatatagtaagaagctcaagtgctaaaactttttttctctacgaaaggaggaatagcatatggttttcttcccttttacagtgcttcggaaaagcacagcgttgtccaagggaacaatttttcttcaagttaatgcataagaaatatctttttttatgtttagctaagtaaaagcagcttggagtaaaaaaaaaaatgagtaaatttctcgatggattagtttctcacaggtaacataacaaaaaccaagaaaagcccgcttctgaaaactacagttgacttgtatgctaaagggccagactaatgggaggagaaaaagaaacgaatgtatatgctcatttacactctatatcaccatatggaggataagttgggctgagcttctgatccaatttattctatccattagttgctgatatgtcccaccagccaacacttgatagtatctactcgccattcacttccagcagcgccagtagggttgttgagcttagtaaaaatgtgcgcaccacaagcctacatgactccacgtcacatgaaaccacaccgtggggccttgttgcgctaggaataggatatgcgacgaagacgcttctgcttagtaaccacaccacattttcagggggtcgatctgcttgcttcctttactgtcacgagcggcccataatcgcgctttttttttaaaaggcgcgagacagcaaacaggaagctcgggtttcaaccttcggagtggtcgcagatctggagactggatctttacaatacagtaaggcaagccaccatctgcttcttaggtgcatgcgacggtatccacgtgcagaacaacatagtctgaagaagggggggaggagcatgttcattctctgtagcagtaagagcttggtgataatgaccaaaactggagtctcgaaatcatataaatagacaatatattttcacacaatgagatttgtagtacagttctattctctctcttgcataaataagaaattcatcaagaacttggtttgatatttcaccaacacacacaaaaaacagtacttcactaaatttacacacaaaacaaaatgatcagaattgctattaacggtttcggtagaatcggtagattggtcttgagattggctttgcaaagaaaagacattgaggttgttgctgtcaacgatccatttatctctaacgattatgctgcttacatggtcaagtacgattctactcatggtagatacaagggtactgtttcccatgacgacaagcacatcatcattgatggtgtcaagatcgctacctaccaagaaagagacccagctaacttgccatggggttctctaaagatcgatgtcgctgttgactccactggtgttttcaaggaattggacaccgctcaaaagcacattgacgctggtgccaagaaggttgtcatcactgctccatcttcttctgctccaatgtttgttgttggtgttaaccacactaaatacactccagacaagaagattgtctccaacgcttcttgtaccaccaactgtttggctccattggccaaggttatcaacgatgctttcggtattgaagaaggtttgatgaccactgttcactccatgaccgccactcaaaagactgttgatggtccatcccacaaggactggagaggtggtagaaccgcttccggtaacattatcccatcctctaccggtgctgctaaggctgtcggtaaggtcttgccagaattgcaaggtaagttgaccggtatggctttcagagtcccaaccgtcgatgtttccgttgttgacttgactgtcaagttggaaaaggaagctacttacgaccaaatcaagaaggctgttaaggctgccgctgaaggtccaatgaagggtgttttgggttacaccgaagatgccgttgtctcctctgatttcttgggtgacactcacgcttccatcttcgatgcctccgctggtatccaattgtctccaaagttcgtcaagttgatttcctggtacgataacgaatacggttactccgccagagttgttgacttgatcgaatatgttgccaaggcttaaataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctttgcaaaacgcacatacccacaatatgtgactattggcaaagaacgcattatcctttgaagaggtggatactgatactaagagagtctctattccggctccacttttagtccagagattacttgtcttcttacgtatcagaacaagaaagcatttccaaagtaattgcatttgcccttgagcagtatatatatactaagaaaggaatcatactctcttatgtgccataattctgttaggagcggaaataaggctggttttttggggatcaagttcggaagtgctcttctctcaattgccacaggtgccattgctatcgcattgctatgcaagttccacgaccacgaagcggtactgatagttattgtatgctcgacattgttatatggaataccgtcactgatatcgtttatcacagagactgtttttgcgcctagcaagtttcatattggatacttttacaacgttcttaattttgcattgccactgatcaccatgggctgcacagtggactattttcataataccttgaggagcccaatatcggtacaaagcgagtctcacagagtctatataacaactctggattctttgttaattttcacacttttcattaatggcatacaattaggattcttcctgaaggatggcaatgcgaacaatttcggcagctcatctaacaatattagtacggatcaatatgacaaagaagcaaatgcggtggaaaatggtagatttgtaccccttaagaactcttcacagaccttaacaccagatttggaattattacacggtagtcccaagagtatgaatggggtagcgtggctgattaatgaactctccacaaattcaaacacaaacgcaaacaaaaccatatcatccgatgaaaattcaaactcttcagttattcgacacaaattaggaccgattagcaccagcaagtgtcctaaaaagccatctcattcgcatttttctaaattgaaaaaatataacagtttctttttgggtcctaaagaaaatcgatacaaaagaaatacacaacaagctactaaggttccgacagaaaagaaaagcaaccaccgaagtagccagtatgtatccagactatcaaccatatctgacatctcgaaaagtttcctgaatttcttagcattaaacgaaaaaaacgggaattcgacttccactgcgagaacaccaagtgaaggaagagtttcaataataattaacgaaggaaataatactttgaaatacaaaactccccatgattcgcatactattgattctccaaacttggagttagaaagagaagctattgggagaattaatagtgccttacttcctgcatgtttgagagtaacagataaaatgatatccccacagcaaagcactcaaaatgaggactcataccaagcaacaccattgataccccaggtggaagttgacgatgatttctatgtaggtgatatcttaatgactaatgaactacaagacattccacaagtcccaaggatatcatctgatatagaagacgatttcgaacaacaatataccaaacacgtggatttgccagcccgtgtcactttagagatgtgggaaaaggatcaggagaaaatacttcaaaaagtaaccacaaaccgggataaaagcaaattactaccccctttcagattcacctctgaaagtgatatggatccaagtacatccaccgaattggaagttgaactgcatgcccaaaacaacttcagctttccctttaaaagtgcaggattacaaattgctacatcagaccaatttaaccaacaggagtttaaaacttcagatactattagcgaactagatgagtatttacatgatcccagcattcaagaagaggatgcaagtcagctgattgaaagcagtttgaaccaaaacaacctatcctcaactactattgacaatggcccaaaggatatgagtagatttagtacaaggcattcaccaaccaaatcgataatttccatgatcagtggatcaggaagtgtcaagcaccaacattcacacagcaccctaagcaacttttttacgggtcattcaagaaacaattctcaaataaatcagctattacagggttcttcttctaatatgatgtccaacacctcaccgcattcatctccaaccaagtcgttgagaatgagatttggaaagaaattgtcattatcaaatatctctgatacaatgtcgccatatgagggtagtacaacagatccgataaactactcgtttggccatggtcacaataaaaaccagagtattgattttagctacgtacgtactttgcaaagcagtcattcacctacaaaatcaacctcgggaaattctcgtcgggattctttaaacaatgatagaacccagagtactgttaatgaaagagcgcttagaactgcaagtacattattctatctccagcacaataacgccacatgtacattgaacggagaggagccagttctggacacaccacaatctatacagtcatcatcaagcggttctgagcaagaatcggcgggatctggttctggctatccagaagtagtgttcagcgagtatgatagagaaaaatggaatgttttgaggaatctaaaagagatagcgcccgaaaaaactatagagagcggacctgttgaagaactagtctctcccagtaaataaaccaaccgacttattcatatgtatcaaagatacctatgggaactgctaaaagcaactattttgatcccgtagaacacgatttatttcattaaatttttttttttttttttttttttcactttcttgcgatgagatgcacatagtaaaagaaaagtataccagtgtagtgcgtaaattaatacctatataataattcattttcggtgactcaacattccctgcctatattttaagcacctgcaagaaatatagattatatacgaaggatggattctactgatctgttcgatgttttcgaggaaacacctgttgagcttcctacagatagtaatggagaaaaaaatgctgatacaaacgtaggagatactccagatcatacccaggataagaagcatggccttgaagaagaaaaagaagagcatgaggaaaacaacagtgaaaataaaaaaatcaaatccaataagagcaaaacggaagataaaaacaaaaaagttgtagtaccagtgttggcagattcgttcgaacaagaagcctctagagaagtggatgcatcgaaaggactgacaaattcagaaaccttacaagttgagcaagacggtaaagtcagattatcgcatcaggtccgccaccaggttgcactaccaccgaactatgattatacgcctatcgctgagcataagagggtaaatgaggctcgtacatatccattcacattagaccctttccaggacactgcaatctcatgtatagatagaggcgaatctgtgttggtttctgcgcacacatcggctggtaaaacagttgtggctgaatatgccatcgcacaatctttaaaaaataagcaaagagtcatttatacctctccaattaaggctctatcaaaccaaaaatacagagaacttttagcagaatttggagatgtcggtttgatgactggtgatatcacgatcaatccggatgcaggctgtttggtcatgaccactgagattttgagaagtatgttatatagaggcagtgaagttatgagagaagttgcctgggtcatctttgatgaagtgcattacatgagggataaagaaagaggtgttgtgtgggaagaaacgattattttactgccagataaggtccgttacgtgtttttatcggccaccattccaaatgcaatggagtttgctgaatggatatgcaaaattcattctcagccatgtcatattgtctacacaaatttccgtccaactcctttacaacattacctgtttccagcccatggagatggtatttatctggtggttgacgaaaaaagtaccttcagagaggaaaatttccaaaaagcaatggcgtccataagtaaccagataggtgatgatccaaattccactgattcaagaggtaaaaagggtcaaacctataaaggtggctccgctaagggtgacgcaaaaggtgacatttataagatagtgaaaatgatttggaagaaaaagtacaatccagtgattgtattttcgttcagtaaacgtgattgtgaagaattagcattgaagatgtctaaattagattttaattctgatgatgaaaaggaggctttgacgaagatttttaacaatgccattgcactattaccagagacagacagagagctaccccaaattaaacacattttaccattattaagaagaggtatcggtattcatcattccggtttactgcccattttgaaggaagtcattgaaattctgtttcaagagggatttttgaaggtgttgtttgcaacagaaacattttcgattggattaaacatgcctgctaaaactgttgtctttacatcggtcagaaagtgggatggtcaacaattccgctgggtttcaggtggagaatatatacaaatgtctggtcgtgcaggtcgtcgtggtttagatgatcgtggtattgttattatgatgattgatgaaaaaatggaacctcaagttgctaaaggaatggttaagggccaagcagataggctagactcggcttttcacttaggatataatatgattttgaacttaatgagagttgaaggtatctctccggagtttatgttggagcattctttcttccaatttcaaaacgttatttcagtaccagttatggaaaagaaacttgctgaactgaaaaaagactttgatggcatcgaagtcgaagatgaagaaaatgttaaagaataccatgagattgagcaggctatcaaaggttaccgtgaagatgttcgtcaagttgtcacccatccggcaaacgccttaagtttcctacaaccaggcagattagttgaaatctctgtcaatggtaaggataactatggctggggtgctgttgtcgattttgctaaaagaattaacaaacgcaacccaagtgctgtctatacagaccatgaatcctatattgtcaatgtggtcgtcaataccatgtatatagactctccagtcaacttgttgaaacctttcaaccctaccttaccagaagggattcgcccagcggaagaaggtgaaaaaagcatatgtgctgttattcccataactttggattcaatcaagtcgattggtaatttgagactatatatgcccaaagatattagagccagcggtcaaaaagaaactgttgggaagtctttaagggaggttaatcggaggttcccggatggtattcccgtgctggatcctgttaaaaacatgaagatcgaagatgaggactttttaaagctaatgaagaagattgacgttttaaacacaaagttatcctccaatcccttaaccaattccatgagactagaagaactatatggtaaatatagtagaaaacacgatttacatgaagatatgaaacaattgaaacgcaaaatttcagaatcacaagccgtaatccaactggacgatcttcgtcgccgtaaaagagttttgcgccgtttaggattttgtactcctaatgacattattgaactgaaaggtagagttgcatgtgaaatatctagtggtgatgaactgttactaacagaattgatcttcaatggtaatttcaatgagttgaaaccggaacaagcagcagcattattatcatgctttgcattccaagaacgctgtaaagaagcgcctagattgaaaccagagcttgccgaacctttgaaggctatgagagaaattgcagcaaagatcgctaagataatgaaggattctaaaattgaagttgtagaaaaggactacgttgaaagcttcagacatgaactaatggaagttgtttacgaatggtgtagaggagctacttttacgcaaatctgtaaaatgaccgacgtttacgaaggttcgttgatcagaatgttcaagagattagaggaattggtgaaggagctggtagacgtcgccaataccattggtaactcttcacttaaggagaagatggaagctgtcttgaaattaattcatagagatatcgtatctgctggttctttgtatttatagttaatcacacacaattatgtatttttattggtatatataataaacaaatagatttcatcaacatttattatataataacatttttgtttgggcaagcacactattgatacacccatacaactcaatgaagtgcagcgttagtagagacaataagaggagttttaaattcttaaactatatctggcaaaacaccaccaaagccagccaaatagtatctcactgtatctgaatgaaagtagatttaccagaatccagactaccatctttatatagagattttaggccattgaaagatttaaatcccgatgggtacgaagcaaacatcagtacatggagggatttcttcttgcaacaatacatcagcaactccaacagaatcatatttactatagggacaaggactttgcaagaattaactcatgaagtttatggcgtaccgaaaagcattgatatagcaattgacgttcttgttaatgaaggaaatttgatacctatggaattattcaatcttggtggaatgtacactgacaacagtagaaaaggattttggaagtgggttagaagttggaaggagtctacaaacatgtataaaagccggaaggatgaaacaaatttctacttgagagaagacaaatttattatcaaagcaaatttggaaaaagagtatcaaaggtttcatgaattactcaaaagaagtgtttttatggaggcttcatctattacagatttagtattcacaaggaatgaatttgtgaccacagaaagtttgcagtcgttcttttcaacctatgatgaagaaacgaaaaacgtgttcctgcactttatagagaattataagcacataatagtttcaaaagacaatgttatcaaagtcattgccgctgaagtagaagacattactagcaggttctccaaaggcatcacagaaaatgaccttcgaattgctagtgttaaagtgggtattataaacatcaacaaacaaattacaaggctaagaaaagaaattaatgaatctaacattaaactgagaggaccagagtttaatgagctgccgaagagaataaggattgaatataaacaggcgagattactatctgaaaaacatctttctaggttactaaagtttcaaaataacctcgctcaagtaagaactcaaatagacaccagtgctactaatgcggttttaattcaaactttaagtgaatccaacgaagtaattaagtcaattaatggatatattggttctaccgaaaaagtagaagacttactagatgagattaaagagggtcatgaccgtaccgaagaggtcaatgatttattagctcattataataaaggtcaagacgaagaagcagaagaagaaattgaaagagaattagaacaattagaacttgatgaaaagaataataataaggaagaaaataagaaccaggatttgcacgagccaaaagaaagcagtagcgaggatctattaaagagattgaataatctgaagataaatacaaatgaaggacctgtgcaagataatgaaaaccacgataatgagataagaaaaatcatgatggaagaacaaccacgttgacgaactgagtgactaataaataaatatatatgtataaataaaaaataaatatgaatattttaatagacggaagaaagaaaatatgtgtgaataaccaaataggaaataaacaaaagcacatttaattgttgccgttattattagagtaacctaatgtacgaactttggtattagatgcagaattattggaagacaagtttagttcagacacgttttgtcgcaattgagaagtaccattagaaggatacatccttggggtagtatatgctgaaggagtcattgaatcaccaccacctcctcctcccccgtccgacaccatgtctaagctagataatttttgtaaagagtagttggcgctgtttgacacatttgtgcccaacctctggtaaccaagacgggaggaggaagcatctacttccggttctttcgcccaaaaagatgtcaaacctgagtaaaccttgtgtagaagagaagattgttccatgtagtcgaatgttttgttattggcttccagcggttctaagatgagagtcgatctgggcaacagatccaactcttgcaaacttttgagttcgtcatttcgcgtaagagtcactcttggtatatttctgtggaaaaggtaaggtgttccatcatcgtagcaattatagtctaaccacatccttactttgtgtaattttgtttgaggagggaaagtattagagattgtgtaaccattgggcagtttcaattgtagagtacagtagttctgggcgagaaaccccttttgactcttgtaactaacattatcagtaactgtcaactgcttccacttctgtggctttctttgcgggtcattagtattttgaaaaacatacttcctctccaacttgtcgttctgaatcattcttttgactctttgatattcttcattgctcttggaaaataacttcctctttgttacttgacccttaaagactgattgtaacccattgataaaggtttcccaaggatcctgctcacgagaaaggctattaccttggatagaacattcgagtagaccgttctgtaatatgttaatgcttggcgccgatgaggaggggaaaatgctcttgaaaagcaagcactctttagtaccatttactaaccttacccacagtatgttttcgcgctcctcgtcactaagatttcctggtttgaaccactgatgaagccaagaattgtccccggctgctgaactaatgtaaacgacgataacctgctcactagtatgagagtaatcatgaacaactcgatcatgaaagaggctgtctatacctgacatctcgtacatttctgttattcaatacctgtaattcacttcctttgagggtcaaaaatgtcccctgtaagcaagtgtataagtatataattatatatatgtgcatatatatgtccctatacaactactaacgaatcttaaaagttgactattcatgtggaaaaagtccctcttctagggttgacgcgctagaggtaaatccattaaggttcctcctggcttcgttaactccgaaaagaatagcatgtgcaagatgagttaccgaaagaagcaataaagaaagcacgagtacatgtagaacaggggcacagataataccagacagatgagcccacttttaagagtttcaaaacttccacgaatgcacagggagaataaagtacgcgctgggtccgttacgattcgtgctgcaagaggtttaaaatcgctccacaatggtctcgcccctcggcccttctccaattacaagcatattactaatacagttttcgtttcttttgtaatgttcagataggagcgaaagactaatttcgatggaaatttttatcttcatttcgatagtatgttcaatcagttgaactatgcatctttggttatcatcattaacaaattgaaacgaaaagctatcctgccaagaaggccggatagagagattgaaaaagatatataaagtgtccttgtcacactcatacaacacctgttgtatgtcaggcatacggcaaattgactacagtttgcatttgcactaatgtcgtttgcagtgtaactgttgtattgaacgtggacaaggacaagaaagatagtttttatctcttgatgtttttttatatggaggagaaagcgacgaagtcgaaaaaaacgaaaggaaataaaatgctgtcggaaaaaaagttagggctggtacggattataaactatctcagtagttaggtaatatataagatggcaccagtcttagtacttgtaagttgctgttgattcgtccctagttatgaatttgtctcgtaacaacttggccaaggcgtctttgaactcaccaacactaaagccttttatctgctgctttaccgtttcaaataaatggtcgtagtctagcccattcctctcgctcttaacggatctagttatgcatgcctttagtaattcttgggtccattgggaattacttccttcgtggtgtgcagaactggttctttcaccgcctgtgttgctactttggagagacgcggttctcggtagaaccacacgtagtttcccatttttcacttttttcatatcaggtttgaagctctcgttgatactgtatgtgttgtcaatatctcttgtcagaattttataattgcagaaggattttaagactagcgctaagtctttgtacgccagtttcgtttgctctgatataacttgcaaggtcaaatgatcgctttcgttgaataaagtcagcacacatgtttggaaaagggtcaattcaaatattaggttagttccatcctgtatgatataaggcgactccacttcgcagtggtgcaagttccacatcggatatagctcttttttggaagcatctgaatcttccactttattctgctcgtgataattacggagaaattggttccacgtatcatccatctcttgaggtaggacaaaatttttctttacttcgttggattgctgaaaaactttgggaattctttctctatcaaagataagtgggaaaaatgacttgctgttgttttcattgtatgtcttcccgaacttcacagcagcctcgatattctcataaaacgacaagaacgatgcatatttgattctcagatctgccataacctctaccggctgaaagaattgcgataaatagggttgatattgatctcggtatcgcatttcatcctcttgtgagacatttgttatgattctttgtttgaaaagttccatgaggctgtctttgtaaacaggtaatatatccttaataaatgaggaattttgatcactttgtaagatcgtctttctgaaaattgatctttcgaaaaaattaggaaatgtgggaaggttaacgaacttcagtctcaatataggaagattttcgttgagatactttattttcatatctctgggtaggtcttttttagttgtttttatctttctgacgatgatgaataaatgtgactcaaaatatttgacatactgttctatggctttgctggtacttccaagtaaattacataaatggtactcgatggaatcggagtatattttgaggtgatctacattagctagctgaactacctcatcaaatagcctttcagtatcatgattggatccatatgctgcctttaacttttctgaaacggcatcatcacagaattccttgaattttgacagcatattttttgcttcaaaagcatttctaaacatcaataagctaaagtgtgtctcagttttgaaatatctctctttttcttcatcataagtgtccttcccaatttctatgtattcgctaatagacttcttgttcaacagtagatggcttataaataggtcatttgcatcgctgacccattcaggggaaaataaagatgctaataatgcattcctcgtcaatagtaccttaaaattcttgaaagtttccagcctcggccttaaatttgattcctcacagtaatattgtctgagagttttcatataaaaatctttggggctcaagccctctatactaaaattgcagttagacattatacggagcataggaacttccttctctaacattgtattcgttattggaaacatatgaatatagtgatgaatagtagcgcttacaagggtggaaaattcccttccaaaatgtgacttcatacattcgaaaagtttggaatcataatactgaaatatcgttaaggtctcaaatcctagttcttttcttatcatgggataatttaccggcacatacgatataataggaccaacggcacccattacgtactgaaatagcttgtaaaaagaggtccaatttttgggtataatttcataagaatagtcgcatctggtcaaaaagctaaggacgtgcgcgtcaattattaactttgccaattcatcacaaaattcttgaaaactcagcacaatttggtgttgatgtagcagctgaaacttcttttgcttttcgtcattcccattaaattctgagttgtaaggaatgtatgatttcctttgcgttaattcacggcaattgttcaacatcttaggcattagctttctaaatttagcggccttttctttattacactccaattctttcacgtcagtttcagttatagtttcagctaaagtaaggtgaaaaaactcgtgcagctcagcaatcatcgttcgatacctgggatttcgctcatcgttaaatttattgtatagtcctaaagcgttgcttgcactcgtctctctgcttatagactcgtggaatccttctctcttggaaacgctctcatttatcattgttcctgtgaacccgtacgagaatttataccagtaaaaaagattggtgggtttaatatcttgaggattccttcaaagtagtcttttagtgcaaagatatcgatgatcttcattcgcattgttcatattcatcattacgcaaaggatagctatgcgttccgcttcgtcatacttaatcaggaatattgaacatccaaaaatctccgagctcacgtatgtagaatttttgatgaatacaaaagaagaaaacactagacttttctttgatgtttacattatgtctatgatgctaagtaattgggcactctcccctcgatatgtgggacagcgaaacctcatacattgcaccactttatttcacacacttacacgatgggcaaaagacgcagacgataaatatcatgatataaactcaatgtatgaaaacatgtttacaccttcaaatgataacgtttcaattttgcaggatgaaggtaaatctgattatgatacgacgaaggccagctctatggaagaagatatcagtgcttttaataaagacttgtacaatttctataatattggatatgccaaacagatcatgtctgcttcacaattggaaaatatagtaaaggcaaagggcagatttgttatacaaagtttatccaccagtccttattataatttggcccttgaaaactatgttttcaagaatacaccaagagccaaaagaggtcccgataattgcagactgttattttacatcaatgataggtgcgccgttataggcaaaaaccaaaatctgtggcaggaagtagatcttgctaagctgaagagtaagaatttcgaactacttagaagattttctggaggtggcactgtactgcatgatttgggcaatgttaattattcatatttaacatcaagggagaaattcgaaacaaagtttttcaacaaaatgataattaagtggttaaattcattgaatcccgaactaagactagatttgaatgagagaggagatattattcaggacgggtttaaaattagtggcagtgcttataaaattgccggtggcaaagcataccatcatgcaacgatgttgcttaatgcggatttagaacagtttagcggcttattagaaccctcactaccgaacaatatggaatgggagtcaagtggagttcatagtgtaaaatcaaaaatcaaaaatgttggtataattactcctaatcagttcattgcagtggtatccgagcgttttcagaaaacattcaaagttgacggcgaaatacctatatattactgtgacgagtttaaatctataaacgatgagattaaagatgctatgaacaccttacagagcgaacaatggaaatatttctcggggcctaaattttcagtgaagattaaagataaaggcttaacaattaaagtcgaaaagggcatgatttatgattgtgatagaaatgatttaatcggcttggaattcaaaggatttttggagaatattgacagttacacataacgttgatgaatatttcaattcacttgtaaataacgtaggtaaatatcaaaattaaagtctttcaccggaaactgattcagcatatttcagcagacgcgtcctagattcacagcaaacttcaatataagcgatacattaggagtgttcgtactttagatctataagaactatattttgttacgattcagccgtctctaaatgtgaactaaatatttatactgttatttgagaaaccgacagatagtacttaattttatcgatcatctaagaatagcatcggtattgtggtgacatttattgaatttcttccgctccagaataaagttccttttcacttcaaaaaactgccaccagtaaagttgcaccagtggtttttgagcattttttgtcaatgtcgcttaaccgttcttgaactgtatcctcttgacgtcgataaaatcatttgtaaaaaccaggccaaatcatcattgaataatttacactgtgtcttcaatgtcgccatttggaccaataattatcaaactgttcacaattcactcaaagtcctttcagcaacattcttatgaaacaatactttctttgaatttgtatgatgaaacaaaattttttggttattaatcatttatcactctcggtagccaagttggtttaaggcgcaagactgtaatttaccactacgaaatcttgagatcgggcgttcgactcgcccccgggagatttttttaatgtgctctaaatagaatgtggatgaaatttctcttggccgccgtacccttcttcataattaataatttctttccattttgcaggattatatctgatcaataagtgattgtaaagattttgtttgtgagaaatatgtgaatttttaattttggttataacttaataattgttggaattccatttttgataaagatgaaaattggtgaattttgagataattgttgggattccattgttgataaaggctataatattaggtatacagaatatactagaagttctcctcgaggatctaggaatcctcataatggaacctatatttctatatactaatattccgttttattccttattccgttttatatgtttcattatcctattacattatcaatccttgcacttcagcttcctctaacttcgatgacagcttctcataacttatgccatcatcttagcaccatatatgataatatattggtagtatgactactagttgatagactgaagagaatgtggattttgatgtaattgttgggattccatttttaataaggcaataatattaggtatgtagatatactagaagttctcctcgaggatttaggaatccataaaagggaatctgcaattctatacaattctataaatattattatcatcattttatatgttaatattcattgatcctattacattatcaatccttgcgtttcagcttccactaatttagatgactatttctcatcatttgcgtcatcttctaacaccgtatatgataatatactagcaacgtaaatactagttagtagatgatagttgatttttattccaacatagacgatagttgatttttattccaacagtgttgacatataaatactagtcaactaaatggtaattggttattattcctcaacattctgctaccaaacgcaaatgtagtaggagagtttagattttcaacgttggtttgcgagattggtgaaatcaaagcatagtttacctttaatcccaatcttccaacaaacagtagctcgcgtggcgtaatggcaacgcgtctgacttctaatcagaagattatgggttcgacccccatcgtgagtgctttgtttcttccgtgatagtttaatggtcagaatgggcgcttgtcgcgtgccagatcggggttcaattccccgtcgcggagattttttttgaagctgttgtagttactactttaagatccagattgatacagtacgtatgtgaggcaacagatacttgcaatataacaagttttgtgaagagatagtgtgaatacctatggttccacgcaagaaatcatctatttgaattttcggcttctataagaatgacaaaactcataggaagctgcaatgcattaattttccgtaagctttattaacccgttagccgctcaagtcgcttttctcaggtcgcgctcctcttctccggacttatgtggctccctttagaatataagggtcttccctttaacggaacagtaaggttccacaaggtggcaaaaaaggcaatccaaccgacacttcggcaaatttctttcactctagtcagagctaagttcttatatatactttctaaataattatctgctaaaataagaaaagaaggagcctaaatacgtatatctatatacatgtatacacgtgagctaataaattatgttatctttgaaaaaaggaataacaaaatcatacatcttgcaaagaactttcacttcttcctctgttgttcgtcaaattggggaagtgaaatctgaatcgaaaccgccggccaaatatcatattatcgaccatgaatatgattgtgtggtggtaggcgctggcggtgcaggtttaagagcagctttcggtttggctgaagctggatacaagactgcttgtttatccaagttgtttccaacaaggtcacatactgtggctgctcagggtggaattaatgctgcgctgggaaatatgcatccagatgattggaaatcgcacatgtacgacactgtcaagggttctgactggctcggagaccaagatgcaatccattacatgacaagagaagcacctaagtctgtcattgaactagaacattacggtatgcccttttcgaggactgaagatggaaggatttaccagagagcatttgggggacaatccaaagattttggtaaaggtggacaggcctataggacttgtgcggtggcagatagaacaggtcacgcaatgcttcatacattgtatggacaagcgctgaaaaataatacacacttctttattgaatactttgcaatggatttgttgacccataatggcgaggttgtgggtgtcattgcctataatcaggaggacggtacaattcacagattcagagcacataagaccgtcatcgcgacaggcggatacggtagagcttacttctcttgcacttctgctcacacttgtacaggtgacggtaatgctatggtttctcgcgctggatttccactagaggatttagaatttgttcaatttcatccgtcaggaatttatgggtctggctgcctaatcactgaaggtgcccgtggtgagggtggatttttattgaattctgaaggagaaaggtttatggaacgctatgctcctactgccaaggacttggcaagcagggatgttgtttccagagcaatcaccatggaaatcagggctggcagaggtgtcgggaaaaacaaggatcatatccttttacaattaagccatctaccacctgaggtactaaaggaaaggctaccgggaatatctgaaacagctgctgtctttgcgggtgtcgatgtcacccaggagccaattcctgtcttgccaactgtccattataatatgggaggcattcccacaaaatggactggtgaagcattgaccattgacgaggaaactggagaggataaggtcatcccaggattgatggcgtgtggtgaagctgcttgcgtatcggttcatggagcgaacagattaggcgctaactcactactggatttagtcgttttcggtcgcgccgttgcaaataccattgctgacacattacagcctggcttgcctcataagccattggcttcaaacatcgggcacgagtcaattgctaatttggataaagtaagaaatgctcgcggctcactgaaaacctctcaaatcaggttgaacatgcaaaggacaatgcaaaaagatgtttctgttttcaggacgcaagacactctagatgaaggtgttagaaatattactgaagtggacaagacatttgaggatgtgcacgtttctgataagtcaatgatctggaattctgatctcgtagaaactctggaattgcaaaatttacttacttgtgccacacaaacggctgtttctgcttccaaaagaaaggagtctcgtggtgctcatgcgagagaggactatgcaaaaagagatgatgtgaattggagaaagcacacattatcatggcaaaaggggacatcaacacctgtaaaaatcaagtacaggaatgtaatcgcacatactttagatgagaatgaatgcgccccagtccctccagctgtcagatcctattaattcttatttatttatttatttattttggagggcaaacttatttattgatctggcaaaaatgatctttcccttttttcttatttttctctctatctctctcattgattcttggtcaatagtactcgtttactgtcaacttacaccttatctattatgctatataattttatgcaagacattgaagtacaatatacgtcgagctgcaatatgcaaaaatatcagagggaaaccagctcattaggaaatatgacatgtgggctatctgtttgttggtggtagctgggtttttttttttttttttttgattttgtcgtgcgggtgtgcaggctgggatttcaaacaaataacaacgagtaattgacaagaaaaacttattggcttattttctttttgttcttcaaaattgtttgccttaccctctccctcagtttgttttcgagtgattgtctattaggatcaatagtcaactttgctgtttccatacttaaaacatcactagtctttatgccgaacttcgcatttataaaagtgtcgcaaatcaatctcatatcgtcgtaattttttccataccacaattcacataaatttccagtgaccttacacaggtctaaaaacttttcatcatctttactggcatcttccttttcaaaaattttcttgaaatgcaaaatcaattcaacaaattcatcgttattattcgtatgttcatagtcaccttggctcactagttcgtgaagctcatcgtaaatggataacaaaagggtgatgatagtgcatgcaatgaaaatatccaagggataattgaacgtcaggacgtggtcccaaacgattagcacatattttaagggtaattctcttaaaaataacaaccttgtccatcggatgagccagattaggttggagtgaatcagatggtctacgttttttttcttcccgctgcccgtttttggtggttggtaaaaaacctttgaaaacaagtctggcaaacaaatcctaaagattttcgtgaatactctcttatcccagttaatcaaattttcttcgttataaaaaatcggttcgatttggttcattagcttgttaaagataatcagaacgttttgcaaatcggtattatcgagatctgtaccgtgatataattgcagataaatgacgcttaatatttcgtggaacccttgtttatactgtaggtgttcgctttgatgtataagcaggtaattgtacaaaagttgtctcatttgagcatgaaccttgggttcctgaaatatatcgtcaagcattatccttgagaggtccaaatctataatttccagagtttccctcagtgtcaacggcttttcatcacttcccttggacaaagaacctttagttttgtcattgtcatcagacaagggatgtttttcaacagcctcgacgggagtcagcctcctgattcccactgaggaggaaacgttcgagtgcaagacccttttaggtacatttgcattatgattttcgtcatagttgtcgccatctgccagcataggcactggcaccaagccgaactggttaaggtccaaacctttaaagttatcagttaacaagcagttgttgttttcatcacacagaagcaaagctttccagagccagcctctactattttctttaaagatagagtcatggtagagttcacctttccaaattcccttctgcaccagttggtctcttgtctcgtagtggtcaatcgcccattgtaagacatccttcatggttgcataagcgaaaaaatacaaacgcacgacagctaaccctctctatgtatgccaattctcttgacaactctcccccattgttctgaaaaaggtaatgaaattaaacgctgctgtaccgattatggaaaactcaatggaaaaattgaaaaaaaaaaaaaaaggaactagtaatgccgtaggagaagcgggtaacataatatccggttttcctttacgaccgcttacaggcctaaaccagcgcaccatccagttacaataacacttggagcatgcgtacacgtgtgcgtattctacggctggcatgggcaaaataagacgtggaatttttctgtggtcagaactttgcgtcagtaaataattcaagaaaaaataataattatgtcgaaaaaaaaatagaaaaaaaagaaaaaaagaatactaaaaggtgagtgttcaggaaaaccgcaagccatgtttgttgattattccggactggagcgttacacggatataaatgcatcttttggtaagttggtcaacacttactgctgttttcagcgctgtgaagccatcagcgaacaattggagattctgaaaagtctagtaccaaagtgccacgacattgtggcacttactgacgaagactttgctagtggccgtactgccggactgacgcagaaattgtttgctatggcgatgaccctacaccagatcaccgactgtatcgacctcctgcagaaatgcaacaccataatacccatcgagatcgccaacccggctagctttgaaagcggcgccgcgacggcgccgctacgtcaaagctatgctaggctcttggatgactggtcccactacatgggcccatcaacggtaaaacacacaggctgtaccaaccgacccaagtggagatttccctggcaacagtcacggactatcatcatccccatgctgtttattggcgaaactgcaatgagcaccagggacctaaggtctgtgctgcatgattgtgagatcaggcacgcgagcgaaatgccgctgcagctactttggacgtcgtcaccggagttggtgtacgccacaccgcatgttgacgactacgacatttggtcgcgctacgggtctgattacaacatgcagatagaggacgaagacgaagcatcaaaagggcgacagcgcaagtgtgtggtgcagttggaggcactgttgggtgcgctacctactacggacccgttgttccaatggtagcccgggcctttttttttttcatcagcttctcttttaggccgtcggccccgttcgatgttcacccgtcctggacagcttgctctccccccttcctcgtgctgcgcgactgtttacgttattggcttattgtattgttttcgcatctagaacgttcaggttcaatttacgcaacggtgtttcactcgaagcatctggctgtacaagcaaatgctgcgttctcattctcctttatataacaagcttctgccttaaagcgttcatatgtacatacatatacaccactcaggcactcgcataatcgcacttaaatacgcaaaatatacaagatagccctacaactgctccatggactccaaggacacgcaaaagttgcttaaggagcaccgaatcccctgcatcgacgttggatggttggtcaggcccagtgcctccaccagcaagagctccagaccagggaaatccgagtccaaggccaacagtgtggctcctgacatccagatggacactgctcgcccgcccgttttcgaaacgtctgtagactcttccagcagcattctttcttcaaacgataagggacgccgtcactccgtagctgcgagcttgctaatggataatcagcgtgctaacgctgggtctacatccgttcccacaaacattcctccccctaggggtaggtcgaagtcagtggtggagactaacctgtctaacgttgaggctgactccggacatcatcaccaccaccgccaccaccatcacacggaagatgctcctgcacctaagaaggtcggattctttaagagtctgtttggccataggaagaaggatcaggaacaacaggagaaggaacgagaaaggaaagagcgctcaccctctccgactcacgtggaccgtggcgcggccataagaagagaaagaacggctaccatatctgcggaatcaccaccgcctttgcagtacaatgctccaccctcttataacgatactgtggtaccgttaacaagatccaagacggaatcagaagtgtattacgaaaatcatccgcaaagctactaccatggccgtatgcgcacataccactcaccagaagagggtaaagtcgacggaacttcccccgcagacgatcataactatggcggctctcgacctgatcctagattaatggatttcttgcgctactacaaatctaaggattacaaattagccgccttcaaagaagggaactttattaagtcatctgcgtctcccacaaccaagaaaaatagacgcgcttcgttctcattacataacgacaaaccacaacctgccaaatcacttgctcaccagaaatttgacgctaagggaagacccattccgccgcatcccgacgcacccaaattgccttccgccttcaggaagaagcatccaagcaacgcatcgatagtagacacagtggattccaattcggacgtttcctcgtcagcgcagaataataatcagacaccttcttctcataaattcggcgcctttttaaggaaagttacctcttatgggaacaacaacaacaacagcaccaatgcctcctccctttctgcaaacgtcaataatccagacacctcatcgacgtccctatggtcttctagttcaatggagttcgacccttcaaagataaccaccgtccccggcctcgagaatatacggcccttgaaacacgtctcctttgctacgaacacctatttcaacgatcctccacaacaaatatgcagtaaaaaccctcgtaaaggtgaagtggaagtgaagcctaatggatctgttgtcattcataggttgactccgcaagaacgcaaaaaaatcatggaatcgactagtttgggtgttgtcgttggggggaccgggcaattaaaactattaaatcccgaggaagacgacgcaaatgccaagagtaaagaggagatggcccctcaaaagcagaacgaagtggaggcacacgacgaggaggataacaattctcaaaggagaaacatcgttatggccgctgcagaagctgctgcagaggccagagccaaagaggcacctaacgaattgaaacgtatcgtgaccaacaatgaagaagaagtcactgtcagtaagaccgccagccatttgaccatcgataagccaatgatttcaagaaggggtgcttccacatcctctttggcctccatggtgtccagtgataccaacggtacgaacgcagatgatgaaggagaaattcttcccccaccttctttgaagatacctcacgacattgtgtatacccgttgttgtcacttgcgagaaattctgcccataccagccacattgaagcaattgaaaaagggctcgacggaccctatccccatcttacagttacgtaacccaagaccttctatggtggaaatttggtcgttcagcgatttcttgagcattgctcccgttttatgtctttcgttggacggtgtacaattaaccgtgcaaatgcttagaataattttgagttcgctggtttacaaacagcatttccaaaaactttctctaagaaacacccccttggatgaagaaggatggaaagttctgtgttattttgtctccaaggccaagtctctgcactctattgatttgacaatggtcccttccatcaagacaaatgtacaaaagccttctaaatcttctttgaagtcaaaaattctgagaatgcaatgcaacttggaaaatagatccgacatgaactgggaccttttgacagcttctattgccctcatgggcggtttggaggaaattgtcatttccggggccaagatgaattctgcacaattcaaaaacttcatcctcgttgcttgtatagcaaccgagagattgggcctcgcgtataatggattatctaagagccaatgtgatgatttggccaagtggatggttcaatcaaaagtgacaggtctagacgttggttttaacgatttgaatggcaaactttcctctttcaccgatgctgttttaggcaaaatacaaaaagctaacgagaaaaacgtcttcaaatttttatctctaaatgggacaaatttgagagtgaacgaacacgacacttttgagaataacgaggtcttaaaactgataagcgttttatgttatttggaaaatttaaaattcttggatatatcgaacaatcctgccatcttcccccactgtgttccgacgctgattgattttttacctgtttttgttaatcttgtccgtctgcatatcgactacaataatttaagttccacgagtgtagtgatgctggccgaaatattacccatgtgttcaagattgaattatttttccatgttaggaacggaattggatttggcatcgtctaaagctctagcagaggcggtgaggaaaagttcatctttgatgactttggacgtggactatgtgtatatgccagagaacattaaggaaaaaatttcattatatgctttaagaaatattcaaggggagttgaaaagggttaatagtgacgataaagatatcaaagatagccaattttcaagcctacaggaccaactatcacttttattaactgaaaaagcggataattccgaacattacaacaaaatggttgagaatttcatggccaaaatcgcgttggcacgtatcaagattagtaaagtggttcatgatctttttgatttaaaactgaatggacaattaaatttggaaggtaaggaagctttgattagattatgcttcatagaggcaagtttggaaagaggctgtgacctgctgaaacaaagacataacaacactttgaaatcaccagaggccgtctcaaaaagtcggaaagggggaaatcaagcacaacccaattccgaaagctgtcaaagaatgttactaagctcatctatattacaaaattcagatcatattgcgcttatgccattcggtagtgcaatagtcgaaaagtcaagcccagatgcagaagatgccgtcgaattcagagaaggtgacgactccaacgtaaatcacgaagacgtaccagcaaatgatcaacaatttcgagatgaagttgatatcaaaaacaaatactctatcattaaaagagaactagaacacgaaaagcttgtcggtggtggcgatttgccagtggacaaagaaatcttaaatcgtgccgcacaatccttagatagtgaccagataaaggaatttctgttgaagaatgacgtctctactatccttggcgtcattgatgaactgcatagccaagggtaccacttgcatcatattttcaaaaaacagggaaaccaagaagagaccgcgttcagaacaaaggatgaacaacagtcctcccaatccaatgattcaagtgctaatgcgtcccctaccactgatccgatatccacaggctccaatacttctagaacgaacgataatgctcatattcctccgaccgatgcgcctggatttgataaatttatgaacaatgcagaggaaaatgccattgacgctgcttatgatgatgtgctagacaaaatccaggatgcgcggaacagtagtactaaataataagggatttctcttaattttttaatctcttttttgtattgggtttcgaaaatataataaggagccctcagacatttacgtatcctttcatgtatgattattttaagtattttgtattttttattattattaatgtaagcataatgcttttgtagaacttgagacaacccggacgggtccgatgagtttttttcttcaaacttttatagaaaataataaatggtgttagcaccactcagatgtgatatttgacgtgtcgattgtgatacctgaagacgctattggagagccattgcaacgcacagtccaacagtaataagctctgatcgttttgaaaaagtatgtttctttccattggacggttgtcttccgatcaaaattttatctcctatacaatttcttcctatttactaacgaaaacctgcgaacctgtaaactacatgatttttaatattagtgaacttcaatacacctcaacaaaacaaaacgcccttttcgttcgggactgccaacaataactctaacaccaccaatcagaattcctctactggtgcgggcgccttcggaacaggtcaatcaacatttggtttcaacaattctgcgccaaataacacgaacaatgcaaactcttcaatcacacctgcatttggtagcaataacactggtaatactgcattcggtaacagtaaccccacaagtaacgtttttggcagcaacaattctacgactaatacatttggtagtaatagtgcagggacatccctttttggatcttccagtgctcaacaaacgaagagcaatggaactgctggaggaaatacatttggttcttcatccttattcaataacagtactaatagcaatacgacaaaacctgcgttcggcggtttgaattttggcggcggcaataacacaactcctagctcgaccggtaatgctaacacaagtaataacttatttggcgctaccgcaaatgcgaataagccagccttttcctttggtgcaaccactaacgacgataaaaaaacagaaccagacaagcctgctttctcctttaattcaagtgtcggtaataagacagacgctcaagctcccactacaggattttcctttggttcacaactaggtggaaacaaaacggttaacgaggctgcaaagccttccctttcatttggttcaggatcagctggtgctaacccagctggagcttcgcaacccgaacctacaactaatgaaccagcaaaaccagccctctcttttggtactgcaacatccgacaataagacaactaacacaaccccaagtttttcgtttggtgctaaatcggatgaaaataaagctggtgctacttctaagcctgccttctcattcggtgctaagccagaagaaaagaaggatgataattcctcaaaaccagctttctcatttggtgccaaatcaaatgaagacaagcaagatggaacggctaagccagcattttcctttggtgccaagcccgcggagaagaataacaatgaaacctccaagccggcattctcttttggagcaaagtctgatgagaaaaaggatggtgatgcctctaaacctgccttctcttttggcgctaaaccggatgaaaataaagctagtgctacttctaagcctgccttctcattcggcgctaagccagaagaaaagaaggatgataattcctcaaaaccagctttctcatttggtgccaaatcaaatgaagacaagcaagatggaacggctaagccagcattttcctttggtgccaagcccgcggaaaagaataacaatgaaacttccaagccggcattctcttttggagcaaagtccgatgagaaaaaggatggcgatgcctctaaacctgccttctcatttggtgctaaatcggatgaaaaaaaggacagtgattcttcgaagcctgccttctcatttggtactaaatcgaatgaaaaaaaggacagtggttcttcgaagcctgccttctcattcggtgctaaacccgatgaaaagaagaatgatgaagtctccaagcctgccttctcattcggagcaaaggctaacgaaaagaaagaaagtgatgaatcaaaatcagccttttcatttggttctaagcctacaggaaaggaggaaggcgatggggcgaaggctgccatttcctttggtgctaaacccgaagaacagaaatccagtgatacgagcaagccagcgtttacttttggtgctcaaaaagataatgagaagaaaacagaggaatcttctacggggaagtcaaccgcagatgtcaaatcaagtgatagcttgaaattaaattctaaaccagtagaattgaagccagtttctctcgacaataaaacactggacgatttagtaacgaaatggactaaccaactaacagaatcggcctctcattttgaacagtataccaaaaaaattaatagttgggatcaggtactagtgaaaggaggtgaacaaattagtcagttatactcagatgctgtgatggcggaacatagtcaaaacaaaatagatcaatctctacaatatatcgagaggcaacaggatgaattagaaaacttcttagacaattttgaaaccaagacagaggcacttctgtccgatgttgtgtctacaagttcaggtgctgcggccaacaataatgaccaaaaaagacaacaggcctataagacagcccagactttggacgaaaatttaaactcgttgtcatccaatctttcttctctaatagtagaaatcaacaatgttagtaatacattcaacaaaaccactaacatcgatataaacaatgaagacgaaaatattcaactaatcaaaatcttgaattcacatttcgacgctttaaggtcactagacgataactccacctctctggaaaaacaaatcaactcgataaagaaatgatctaaaagaaaaaattccctctattctacacttatttgacataggatgtgctatattaaataattatatataggtatcaaaatgtacgcgatggttcagaacctgcaattaatttaacacctcaatcatacttgtttttttcctttttcaagaagtttttgtaatgtgtcgtgccgatctgtaaacgacctggatttttatttcattagacagtaaatacgcaccaaatcagaaccaaagaaaggcttctgtagtgtatgaaactaaaagccactttttgtgatagtttcttcttagtacttagtacacaaccaaatattttgcaaaatgaaatcgattcctaaaagtaattcttaaaagtgataatgaatgacttaatcgttattttgatatcctgttaatgtgcataacatcacaattagcttcaccatttcgtttaaactttggttattaggatccgacgaatttttcttatcttctttttccctcaaaagatctcttttgaatattccgatcactagcctcttatacgtattcagtaaaccctttaccgtttgaacaacagctttgtttgagctccccatgctcactaaaacagctgatatcaattggaatataggaacgattaactcaaacaaggaaacaccattagcatctttgtcaactagtagcggattatccaaggtgacgttaacctttaagaatttggaattctgaacgtagacttcgtcaaacataaggtctagacccaaatcaggatcaacttttaaaaatgacaattccgcgattattcggaatagattattttcaattaaagcgctagctccacctctagtttcggcaacacgtattaaaaagaatacagtggctttaaaagctgtcaattcatataacaaatcatcaatgtttatgtgctctgtagtagaatttaacaaagcatctgtatttttcagcgaacgtattattaagagcagtcttgtagttttcatcagtgaatccaatataaaattctctttacttctattagccagttgaataagtgaatccaatagtaatatacctgtaaccctactagttccctcgccataaacaacatcgttccatatgatctctaccaattttttacttcctagtctcaaatcctgcagaaccttttcggaccctacttggtcgcttagaactctactcaaataatggtttgctaatatatagaaatcggaccttaatgccacagaggagagtggggagtttataccctgaatacatgtcttgaacaactgatatagcctgccgtctaccgtgcctttgtcggtaatcaacttacgatcgcggttatatatatcaaataggaaaacggcgagagaaaccaattcttctgaaaaagttatattaaactcaatataatcactaatcttcggaataattgtaccaaaaacctccagaataaagtttgatcttgttgatggttccaattttccatcagtaacaatgatttgcaccaactgtacccaagagtgcagcacagataggttcaactccaatgctttgtttcttgatataatattcgtgaaatggctttttgcttttatacactcgacatctgcatccttcaaaaattgttcttttgacacagtgagactgaaggaattagaatgtaagctttcagcacggactcttttaatcaggcgcataaggttttccattttgtgaaagtcatagatattgccggagcaatacttgttaagagtgacttgttccaaatttaaaggaacattggtgaaaattgataacgtctcttttggttcgcagatattgccatagtttaatggatccaagaaagaaaacaaccttaccgaatacattgtatttgatatcaagtaattcacatatgttaaaacctctgatttcgtgcccgaaaatgaaattttatgaatgaacagacccaaatattgtgtccaataattcctgtaggctaagaatgacagaaatgcaccaacggattcgctctcgatgaagttcttacatttttcctctgtagaattgtcaaaaggagagccgttccatgtcgtgaaccttgtcacttgtggatcgaggatcattattctctcaaaaaagttttctttgattaggtatgaatatagtagaccagatgttaacggattacgacatagtttgagaataatttccagtgctgctgtagccaatctcataggtgcataatcgatattgtccttagtaatgctgttcaatgaagcttccaacacgcttatgagggaatcaagtaatgaggttccggaagatataaatgttgctaggttaggtcccagggatataacgtttgagacctggaaacctaataacagatgagaaatagtcatcgttcgactataattagaaagatttgatgttaagaaatctaatagttctaacttcaaagcaaggacaccagcgtcggttattgagctttccaattgtgtaataaatgcatcctttattctggctgattcatctacggaatcgaatattgttaacaacttatttctcttagacaaagacgcaacggagccattagagcgttctgaaagtttcgccaaaatacgcagtgaatttgtggctaaaatttgatcatcgaccccgacgtataaacccaagtgtgcaacaagtggaatattgaaaaaaattgcatcgtaaaatgaacgtaatccgtgaagagaataattctttggcaagaaataatccgtcttgccatgcttcttaacaattggaaataattcttccacgtatgtctcctgataatccaatactttattgataattttcacagctaactgcaacaattcagcctgatttttgccaccttctaactctatggacaattgatcaacaccaacatcaactacattaaatatacttttgtaaatcttttccgtgaaaatatagttgaatatggggatagctgggcattcttgaacgtaattgaagaaattttcgcaatccaccaaagcatccaaattcgcagctgcaggaatagaatttaaaattacactgtaatcaaaagagcataagcccgtatagataattttcaaaataggaagctggacggctcttttatttctgatatcaacaatttgatccacgtgcgctaaaatgtcgttgaaaatgtagtcaaaatatggccatatacctaccttcctatatccctgacctaatcttgttggaaatgccaatttgccaaaaaccatgtattcactattattttcacgagaatgaatagaaatcagattatggaagagttgtaaaaaccccaaaacgtcagagtattttgttaacacgtttgtaaaagcatttctataagattcggatgaataattcagcgatgaatccttgaaaattagagagtctagaaaagaccaaaattttgttctagaagattcaagttttggaaccaagttacttataaccttgaaagcagcgcctacgagaggtgtatttatcttggtgaattcgaataggacatctgagaaaactttcgatagcgagctttttacatcctcgtcaacctggtatgtaactgatccaactaaagttaataaagaagacagaaatattacagcttcttcatttaagccttcttctaaggctaccgcagtcgaatcgatatcgttatgagttgactcactaaactgctgcctcttatggaggctcgagttaaaattgcttattttcttagtgtagtcactgagacactgtgcaatgtttttccatgaaatcgagctgttttcgccaaaatagtgatagacattcagggcattttcaggaccaaaggacaagctagaaaccatcaaatagaaacaagacctcatcaagttgtcgttgcatctcgaacaccactcaataaaaccataagcgtttgattccttatcagaccagaaagtacatgaatattcgggccttgatgcatagaaaaaatatattgacagaaaaaatctttctaagtcagcctttagtgagatgtcatccaaagttaagtcttcaccggacaacaaagagtcttcctcagcatccttaatctttgtaagcaaaaaggcacaatctgtaataatagtttgaagcacatcatcaaaggatgagaggaaaaattcttgggtctgatcggataaaactatagtagtgtaagaatattcgttgacgttattgggcatactatttagtcgagcggtacccgtggttgacatcatcccaggataagacggattccataagccgcgtccgctcatattatcagttgcggatgctgggttgtaggtagaattcgtcgtttgactgaaaattttttcatcatcaagtaactgtttaggaattagccttggaatatgcctttctaacagggaccttatatcgtagaaaagttccatactcttgtcttgttccacgatagatgtatctgcggcaaatattaaaatttgttcaatagcgcctagttcgacggcagaagtcattggctcatcaacatcagttttgaaatccatcgtgtcagcccttcttttagggtcttctttacaccacccaatgaagtaagcaaaaaaaatgaaaataagagctactttgaccggtttggtatatatggagtcgtcctttaagtctttcataaactgagaatgtaataatttgacatctgcatcgggcaaaactcttaaagatgcgaaaaggtggaaaaatgcaggagtataatatattataaaaaaatcattggaatccaattctgacacatgatgaagtaaggacagtataaaatccttatttttcatgatggctcctttatccactaaaccatataaaatttgactcagaatatcatattctctcagtaagaagtctctcctaaacttgatattttgttggaataaagcattatagttttctagtatctgagccttattgatttgttgtttaatctcagataattgagtatgaatgaacttaaaggctgagaggatattagaaactaaagctccattctttataagctcttggtataactcagtatcttcgtggaaacagttgactataaaagaaacaatttgcaggatatattgccttctcaaaaagtattgtactttgccattattagcggtggtatcaccagaaagtataagttcacatgcaacaatttcatccaagtttaattcatcggacaaagaaatagcttcgaaaataaactcctgattgaccttaaaagtagagccatcggatagttcaatttcacctttttctaattgtgatcggctagcattgttttttagtttgtctgtgtttaagttcaaattttgtaagtcaggaagtacctctttgaacagatcaaaatcgaactcaccactctcaatagagcgatacaatgtttggaaaggaattgcagaccatttcattttttcttatctgcggaacaaatcttttcaactaggttagatgccaagtgatataagttatatatatttcgtgcttaggaggcgtgttgttaattggcgtaccctgaggaaataatttattaagtatagtgtaaactaagtggctaagaaaggtattggtaaactagttgaaaggcaatgggcgcatttactaaatactacatcacacttacaaactaaccttgttattttccagcagaaaatttattttcatcaaaagacgaaaacggaatcatactacccggcccgagaaggactttgatgaagaccgtagttagaatgggctcactagactcgtgagccgtttcagtttaattattattatatatgtataccagtgctttacccaaaagagaatatttacgtgaaatactacgctcttgctgggaccttaacgtgtatatactatcataaactgagactcttcgtaaattgccccttaacaacacggtgctgtgaatgctatcacttgattatacgccaataaacttcatattctttgaagagccgctgctattgcatttaatgctaaggaaggttaacaaagcattaatgaagaataactacaggagtagccaaaaaaatctccgcgacggggaattgaaccccgatctggcacgcgacaagcgcccattctgaccattaaactatcacggaagaaacaaagcactcacgatgggggtcgaacccataatcttctgattagaagtcagacgcgttgccattacgccacgcgagctactatttgttgaaggttttactactttattatagtaaaacctaattacgctttcaattactacaattttcggattttcacggctggtgaaataatgcagcctgtattgcataaaatggccgcacttatgagaactgatacaagttgtttaccgttggggcaccaaggtgttattagtcagaaataaatgtaaatttcttatactgcaaagcagaggtacatataacacacatcgattggttcatcttggctacgactaatatttttgggatgcaggtgaataattagataattgttgtaattccattgttattaaaggctataatattaaaggttatttgggtctttctctctctcggctttattttatttatagtttctatctttcagctttcaaaaaataatatatatggcgcttcatgaaaagagagctagctacagaaatataaacagtcatggatgaataggcggcggcagctatgccggtgcatgcgcacagtataatggacttaaactgccttagtacaactgttcaagttattgaatagcattatatattagtgccaaccaaaatatgaaaccgatgcttccaactgtcaccccaagaagacacgcaaaaggtgctactgcacataaatcggccactccttgagctagacccaattctaacagacttacagttaggattctctttattctgtctagtcgtttctttttttccctcgcttctttttctttttcgtcttctctaccaccatttatagtaattcgattctgttctctactgaggttttctaaagcattaactaccttgcccctggagacttctttaaactttttgatatattcaaatggtgaaacattcaaagccgcatctagtgccttttccaccttttcatattctatttcgagcgactctctctcattattatccaaacttttcactttataatttagcaccgcttctaagcccttcaaaataaaagtatgctgctcatattttgcactaatgttttgaatttgtccctcgataataggcaccttctctgctgtcaatgtttcgtatgttccattgttgtccagatttctcaatgatgtgattaacctatcgcccgcatcgctgaactgttgtattgtgttagttcctgcaatcacaacaatggtgaaataaaaatatatgaaaagctggaacctcatttgaattagtttacttcactaggctcttttatcttcacttattgttttgtggtgtctattttttttactgacagtttacacttttatagtctttaaaaaagcaaaaaaaataattcttttatttttatcccaagataataaatatttatgtattggatagtagtataattgagtataaaaattatttttgtagtactttttcaaactaatctctgcaagacatatcttccatattttcacaattatttaagccgattgcaacaacattcaccataggtgccttttctgcggcaatgcgtagccctataattagctgcttgaatgagaaaaccacaaaaagggggattgaatacatagcatagcttacactgtatcttagtaatttttttcccttctactttgtttttcgcagggcctttgcctttggaaaagggtacacgagtcttaagagaaatgaaaaaaaatgacactaaatcggtgataataatttgtcgttgtgaccacaaaaaagaattcataaaaaaaaaaacttgatcattggcgccacaacctagtcatatttgaaatcatttttttcctttattttttaccacagggtgcgtttagaagagacacaaaatcactctagggttttctatcgaacataaagtaaatcatttttatattccaaaattgctcgaagtaaatctcttgttttcctcccaaatgaagatcaatattaaacctttctgaaaatcttttttaatacagattacattatagagttgtatactcttcgatcatttaacttctcttttatgggtcatatatctctaattgtctctacagtactttttttgcttttccaataaaaatcataatcacagccatagtcacaaaactataagatgaaagtacaaatgatagaaaggatttttctgatccagttgtgtttgcttaccgttgtattagcaagtagtagagcagtggttgaattcgaaagtaccggaaccaaactggtcaactcattaagggtcttggctgcttactcgcagagttctgtctgtgttgatgaaaaaatatctggaatcgagagacaaatagaggaagttaaagatatgtatggtaaccactcttttattctaaagggtttaaatggtatattgaataacaaggtgaatatgctaacaagggaaatccaaatggaaactgttggcaataacacatttgaaacagaaacagggaagctaactaagggcctaaaccgagcagtaaatatatctccgttcaagtacataaaaaaattcaagaccgtttcaacaaagaaatttgaaagcctcttgaataagtatgatctggttgccaagaagggcggggaattgacagaggaacaaaagaaaaagaaggaggtgctctcacggatcagtagagtagtcgctgcaacaacgatagaggctggtctggcacaaggtgtggttgatttatgtataacagtgacaactagtctatgcttagtctcggccagcattggaggcgtcggatttcttatttggctcaccattatataccaagctctgacttaggaaaatgttgccgattttgtttttgccactcctgtacattgtttaatctcagatcgttgtatatatatacatatatatagtgttttaacgacattcttatatttgcatttctgcttcttattacacctaactattctgtaactgccatgggtaagcatttttgaagtattaattaacaattaaactttcaaacatacccaccctttcgttggaataaaaatcaattaacacccactgactagtaaatattactagaataactgatgattatgccaattttctgacagttgttgggtttccattgttgacgaaggtcctattattagatatacggaacatactagatctctcgagcctatcggaacctactaagcggaatcggcaatatacatgttattcatttttttcgtttttcgttttacattattaattttacgtctcaacttggttcaatttcagagacagcatctcatcacatctatcatctttttgtaccacataaggtaatatacacgtaataataggcaatagatgtgtgcgaatgaacttccaatataatccatttagtagtgccttttgttactaatattcgtcagtttctcaagctgacacttgatttattctaaacaaatttcaatcttggacaattagttgacataaactacgttactaatttttgttgtattaagggcttaaataataccggatgtcttggcaattctatcgttaggagagtaatagttgtcagacttattgtcggcttgttcgcacatcgttacttatcctatattatacataagatctggtgaagcgaggagtcccatgtctaaaccgattgctcaggtatttacaggtttaactgcttcatttaagcaagcaattattgaattatatactcaatcttgtctctcccgttactattatttcattcgcgttttatacatctttattattataagtttgatacggtaactttacaatcgattaatttctgctgaaagcccaagctttcataaattaataggtttcgtggtctagtcggttatggcatctgcttaacacgcagaacgtccccagttcgatcctgggcgaaatcaattttttgtttttttaattcacaagaataacctggtattgttataagcaagccaccctttgcgtacgatcaaacaccctataaaatctatatgcaatactgagatattgtattttttctcctttaattgtttatagttcagaataacagttcaaaaatctatgccgcgctcacagggtcctgccgggtattcgccctccagcttgaaaggggtggcaatgcccaagagcgatgtatagtttagtatcaaggaattgagagaggtattacaccaaggatttccgtgaacgaagtgacgacgcaagattaacagattaaattctggtagtaggctaagccgttattaaactttatttacggtataccacaatactgctctttttgttgaggatatgacagacaaaggcaagaacgatttaacaagcaaagctaaggacaaagccagaggcaaccccgagaagccaccatattggtttgaaatcattgtttctgatccacaaaaaagaactggtgacccaggctcttcatctggctacgtgagttatcagatatcaacaaagactaacaacacgtcattttatgataatcgtggcgatccagaatctattatagttgtacatagaagatacagtgacctattgctcctgcatgatattttactcaacaggttccccacctgcatcatcccgccattacctgataagaaagtttttcaatacatagcaggcgataggtttagccaaagatttacacaaaagagatgtcatagtttgcaaaatttcctaagaagggtctctttgcatcccgatctttctcaatcaaaagtcttcaaaacttttttggtgagtaaagattgggaatctcaccgcaaagtcctccaggatagcttgcaaccaaataaagatgaagttactgatgcttttatgaatgccttcaaaacagttcacaagcaaaacgaagaattcactgagataagggagaaaagtgataaactagatcggactgtgacaaagatagataaactttttcataaggttgtgaaaaaaaatgattcgatgtctgaagactatacaaagttgggcagtaatttacaggaattacaagaattggtcacaggcgaaaacgaggaacttgctgcgaagttgaagatttttaatgaaggtgtaacacagctgtcatatggcttgcaagatcttacaaagtatctggattacgaatatattgttgatttgaaggatcttgaacactacattgatagtatgcgacagctgatcaaattgaaagaccagaaacagatagactacgaagaactaagtgattatttaaccaggtcaatcaaagaaaaaaataacttgatttctggatacggaggtagtaatttctttgccaataaattggaagaactagcgggaataaatcaggaggcttcacgtagagaaaaaatcaataaactagaaggcaaaataacgtcattaacaggtgaattagaaaacgctaaaaaggtggcggatggattcgaacaggaatgcttgaaggaaatagaccatttcgaaagtgtaaaaacggctgaaatcaagaaatctctgggctcactagcggaccatcatatcgaattctacgaaaggatacttgaagcatgggaaaaagtagacgatagtctatagtggtgctcttaatgttttcccattactactgataataccttgggcactacgattatctgatcacatttaacagagaaatttaaaaaaagaaaaatatctatataaaaatatgtaaatgttgctattattttatgatgttctgatttttttcgtcaaaccttagatttcttatgtacattaaacttaaacattttgcattgttcttccagttcttggattatattatcttggtgggagtcaatcaaatcccaatcgacgctattactggacaagtcaactttattcgcaaaacaagtcctgtaatcatcaccaaaagtctcaatgaatgcttcttcattaagatactttgaccattccataggcggaaacgtgtttttatccaacactctgtcactcttggaccgtggctttggcgccctttcattttgtcttacataaaagtatctcagcagcattattgcttctttcctcaagatccccggtatactctcgtaccctgccgcactattgttcttgggcactaatgtacacgtatcatgatttactgacaagacagtaccgttgcctccaaatctctcgttgccacaaccgaacaccacctttccaatgtctaattgcttgagagcagatgcacacattatacacggttctacagtaacatatagagtaatgtctttgaacacgtcaacaactcctcgggagcccaacatcgccttgatctgatcgatccccatgaactcagcatgtgctactccagttaatgacttgttcgtatcgttcatgccataagccatcacctggccagttggcgtatgtacaaagatgcaagctaccggtgtctcatcgtggtcaagagcgtatctagccaaacggacagctgtcctcatatgtttaatatgctgcatagtgtgagtcctctagtttttaccgcagccaccagccgcttctcgagcaaagtgtagatcccattaggactcatcattcatctaattttgctatgttagctgcaactttctattttaatagaaccttctggaaatttcacccggcgcggcacccgaggaactggacagcgtgtcgaaaaagttgcttttttatataaaggacacgaaaagggttctctggaagatataaatatggctatgtaattctaaagattaacgtgttactgttttacttttttaaagtccccaagagtagtctcaagggaaaaagcgtatcaaacataccatgtttttcaacagactaagcgctggcaagctgctggtaccactctccgtggtcctgtacgcccttttcgtggtaatattacctttacagaattctttccactcctccaatgttttagttagaggtgccgatgatgtagaaaactacggaactgttatcggtattgacttaggtactacttattcctgtgttgctgtgatgaaaaatggtaagactgaaattcttgctaatgagcaaggtaacagaatcaccccatcttacgtggcattcaccgatgatgaaagattgattggtgatgctgcaaagaaccaagttgctgccaatcctcaaaacaccatcttcgacattaagagattgatcggtttgaaatataacgacagatctgttcagaaggatatcaagcacttgccatttaatgtggttaataaagatgggaagcccgctgtagaagtaagtgtcaaaggagaaaagaaggtttttactccagaagaaatttctggtatgatcttgggtaagatgaaacaaattgccgaagattatttaggcactaaggttacccatgctgtcgttactgttcctgcttatttcaatgacgcgcaaagacaagccaccaaggatgctggtaccatcgctggtttgaacgttttgagaattgttaatgaaccaaccgcagccgccattgcctacggtttggataaatctgataaggaacatcaaattattgtttatgatttgggtggtggtactttcgatgtctctctattgtctattgaaaacggtgttttcgaagtccaagccacttctggtgatactcatttaggtggtgaagattttgactataagatcgttcgtcaattgataaaagctttcaagaagaagcatggtattgatgtgtctgacaacaacaaggccctagctaaattgaagagagaagctgaaaaggctaaacgtgccttgtccagccaaatgtccacccgtattgaaattgactccttcgttgatggtatcgacttaagtgaaaccttgaccagagctaagtttgaggaattaaacctagatctattcaagaagaccttgaagcctgtcgagaaggttttgcaagattctggtttggaaaagaaggatgttgatgatatcgttttggttggtggttctactagaattccaaaggtccaacaattgttagaatcatactttgatggtaagaaggcctccaagggtattaacccagatgaagctgttgcatacggtgcagccgttcaagctggtgtcttatccggtgaagaaggtgtcgaagatattgttttattggatgtcaacgctttgactcttggtattgaaaccactggtggtgtcatgactccattaattaagagaaatactgctattcctacaaagaaatcccaaattttctctactgccgttgacaaccaaccaaccgttatgatcaaggtatacgagggtgaaagagccatgtctaaggacaacaatctattaggtaagtttgaattaaccggcattccaccagcaccaagaggtgtacctcaaattgaagtcacatttgcacttgacgctaatggtattctgaaggtgtctgccacagataagggaactggtaaatccgaatctatcaccatcactaacgataaaggtagattaacccaagaagagattgatagaatggttgaagaggctgaaaaattcgcttctgaagacgcttctatcaaggccaaggttgaatctagaaacaaattagaaaactacgctcactctttgaaaaaccaagttaatggtgacctaggtgaaaaattggaagaagaagacaaggaaaccttattagatgctgctaacgatgttttagaatggttagatgataactttgaaaccgccattgctgaagactttgatgaaaagttcgaatctttgtccaaggtcgcttatccaattacttctaagttgtacggaggtgctgatggttctggtgccgctgattatgacgacgaagatgaagatgacgatggtgattatttcgaacacgacgaattgtagataaaatagttaaaaatttttgctgctggaagcttcaaggttgttaatttattgacttgcatagaatatctacatttcttctaaaaatacatgcatagctaattcaaacttcgagcttcatacaattttcgaggagattatactgagtatatacgtaaatatatgcattatatgttataaaattagaaagatatagaaatttcattgaagagtatagagactggggttaaggtactcagtaacagtgtcatcaatatgctaattttgcgtattacttagctctattgcgcaaatgcaattttttcttaccctgataatgctttatttcccgttccgaaaatttttcactgaaaaaaaagtgcttaagctcatctcatctcatctcatcccatcactattgaaatattttgctaaaacattataacagagagagttgaaaggctcgagaacctaatactgaaatggccaaaaaaaatagattgaacacaactcaaagaaagactttacgtcaaaaggaagatgagtacatcgaaaacttgaaaaccaaaattgatgagtatgaccctaagataaccaaggccaagtttttcaaagatctccccattagcgatcccacattaaaaggtttaagagaatcatcctttataaaacttactgagatccaagccgattctattcccgtgtccctgcaaggtcatgatgtattggcggccgcaaagacaggttccggtaagacattagcatttttagttccagtaattgaaaagctataccgcgaaaaatggaccgaattcgatgggttaggtgcccttatcatatctccaacaagagagttggctatgcaaatatatgaggttttgacgaaaataggtagtcacacttcattttcagctgggttagttatcggtggtaaagatgttaaattcgaactagaaaggatatcaaggattaacattcttatcggtacacctggtcgtattttacaacatttagatcaagccgtaggtctaaatacttccaatttgcagatgcttgttcttgacgaagctgatagatgtttagacatggggtttaaaaaaactctggatgccatcgtaagcacattgtcaccatctagacaaacacttttattttcagcgactcaatcacaatctgttgcagacttggctaggctttccttgacagattataaaaccgttggtacacatgatgtgatggatgggtcggttaacaaagaagcatctactccagaaactttgcaacaattctacattgaagttcctttggcagataaattggatatccttttcagttttataaaatcacatttaaaatgcaaaatgatcgttttcttatcaagttccaaacaagtgcattttgtctatgagacatttaggaagatgcagcctggtatttctttaatgcatttacacggtagacagaaacaacgtgctaggacagaaactttggacaaattcaatcgtgctcaacaggtgtgtctttttgctaccgatgtcgttgctagaggtattgactttcctgcagtcgattgggttgttcaagtggattgtccagaggacgttgatacatatatccacagagtcggtagatgtgctcgttacggtaaaaagggtaaatctttaatcatgttgactccacaagagcaggaagcgttcctaaaaagacttaacgctagaaagatcgaaccaggcaaacttaatataaaacagtcaaaaaagaaatccattaaaccacaattgcagtcattattattcaaggatccagaactaaaatatctaggacaaaaggcttttatatcgtacgtgagatctatatatgtgcaaaaggacaaacaagttttcaaattcgatgagttaccaacagaagaattcgcttattctcttggtttaccaggggccccaaaaatcaaaatgaagggtatgaagaccattgagcaggccaaagaaagaaagaatgctccaagacagctagctttcttatcaaaagcaaatgaagatggtgaagtaattgaagataagtcgaaacaaccaagaacaaaatatgataaaatgtttgaacgtaaaaatcaaaccatcttaagtgaacactatttgaatataacgaaggctcaagcacaagaagacgaggatgacgatttcatttctgtcaagcgtaaagatcatgaaataaatgaagctgagttaccagctctaactcttccaacttcaaggcgagcacagaagaaagcgctttcaaagaaggcatctctggcctccaagggtaacgctagcaaattaatatttgatgatgaaggcgaagcccatccagtttatgaacttgaagatgaagaagaatttcataagagaggtgatgcggaggtacaaaagacagaatttttaactaaagaatctgcagtaatggcagacattgacaatattgataagcaggtggctaaagaaaaaaaacaagagaagaagagaaaaagactagaagccatgagaagggaaatggaggctgctatggaagaagaaatttctggagatgaagaagaagggaagacagtagcatatttaggaacaggaaacttgagcgatgatatgagcgacggtgatatgcctgactcggaaggccacttgaaaaagaaagctagaactgttgactattcccacggccacaatccatccaattcagttgatgatgacattattgaagtggaagaaccacaaactttggaggatttggaatctttgacagctaaattaatccagggttaaaccctcctgcatagtctaacctatagtatttagaacttgtatacatctattctctacactaatatacttatttctttgttcaaatcatcggtaatattacaataaaagaaaaatatgcatatactttcgtgcattgaaggtgtcaaatgaaatcccgcttatagtgaacaggcttccatcatatatacatatatatatatgtttatatatgtatatcatcacttatgctgctccaggagatgtaggtatctattctttcttaacggatccgcatctattaattggaccaaatattgttccgagcttctttccgttagagcttccttttcttccagaatatcttcgagaactaataaaattttcaagcaccaaatattttgcttcccggaaaattcaatttcgtcattatttattaacagaatgttttctctcaagtctttcaacattttaaggtactcttgttcgtccagagttttacaaacaatgtcgtttttaatgaaccacttgatataaaaccatacggattggtcttcggcgtcggtaaacatagcgttgatgatataagatatttcagtccgaatatactccttttgattcccaacctctcctttctgaaacattctgcttatgatctgtactctttggtgccatgcagaataatttgaaatgttattgttaatctttattgttgtgtattcaaactcctccttgtcaagacttttattagtgatactctctatgttaccaacaactattctgcggtaatgccatccgtggtaatttcttgcatcttgttccaataacttattcacgacagcaagttcagtttgccacactttaggggaactcgtaggataatgtttcaagacccaaagtctgtgattccatatccaatagactttggggtaatccttcaatagcatcattacaaaaactaactctttatcccagaaaggtatttccaactcagaagccaaactcgctataatatcccttctgtaattccaaatagcattaaattccggatttttctcaagaagttctgatgttttcttcagagcttcaattgagtaaattttttcatctctcatattcaaaacattttcagtcaagcttctataatcatatattttcttttcgtcttgaactctcttttgtctcagtaattccttggtccactgtttccttttaatgccatgctgtttaatgtggcaaatataaaaaattgcttggtagtcagtaaaaaaaagaattcataatgtaacgaacatttgaagtgcacataccattgctgacctactgctttatagtataaattcagtatactaggtatatgtggctcaaaaatgtggtttttttcttttttgcctttaatttttttcaaatgtttacgtatggtttatgatttaacatttcaagaatagaaatcgccccgaagaatgattgatgttaaatactcgtacaagagtattgaaaaccacttcaaaggggcccaatagcacatttaatgtcacaatcaatatcactaaagggttcaacaaggacagttacagaatttttcgagtacagcattaattccattttgtaccaaagaggcgtatacccagcagaagatttcgtaacggtgaaaaagtacgatcttacgttactaaagacacatgatgatgaactgaaagattacattcggaaaattcttctacaagttcacaggtggcttcttggtggaaaatgcaatcaattagtattatgtattgtagacaaggatgagggagaggtggtggaaagatggtccttcaatgtgcaacacatttctggcaatagcaacgggcaggatgatgttgtagatttaaatacaacacaatcacaaatcagagctttaatcaggcaaatcacctcaagcgttacctttctgcccgaactaacaaaagaaggtgggtacacattcacagtacttgcatatacagacgcggatgctaaagttccgttagaatgggccgactccaatagtaaagagatacctgatggtgaagtagttcaattcaaaacattctctaccaacgatcataaagttggtgcgcaggtcagctataaatattaatagaattcaagtcaaaaaaaaaaaaaaagacggaagtccaaaaaaatctcgttttcgatgtttagaaagaatatagatttatgaactatattatactatactacgtacttcctctgtaaaccacttcatgcgttttttcaagtgcctctgttaaagaaccttgagtgagaaacgaagtctttgacactcaaactttgctttttttgttcttctttttgttgttgtatttgaggggtggatactatcctcttcataacaggtggtgatattttcagatcttgcctcacaaattttgaccaattcggatcttgcatccttgccaagttgttttcaaattgacccaaaagtaccttgtcccacttgaatatgaaaagatcgcgattactgtctggcctgctgccctcgtcagtgtcgtctgtttctaagttgtaggcactccatagctttttccataatgccaggtcccatggaatgccctttaaagcgaggacaaaagaccataccgctgaatcagggttattattggtcaatttggagtaggtctcgtaatagtcatcagcggaatccagaggagccattagaagtttaataaacttcagcagctggtctatattattgtctgcatgtcttttcaccctcttataagaggtattttctcgcaagtcagaatcgttacttacactttctggtaaagtgtgaaaaatctccttcagcaattctaaatcaaggagaagctgctcgccaatgttgacaacagttctggtttcaaatttccttttgctgcccgccagggaaaagggtggaacgggctgcagaaggcggatggtattgcttacaaaatttgtagtgatgatatcaatcaccttatccaagaaattccacttataaacatctctattgaattgcgacaaaataaatgccaaagtcgaaggttgctcttgctgttgtttaatagaggcatctgttaatgcgggcattttaagtacggatttgagggttaccatgtacctgctataatcttctatcgcagcatttgaccaatcattgttgataaactctctccatacaaaatttagatctaagggtatgacacggtttaatagaaaagaagttccttttgctagtaaatcgtcgtatatatttttcgttttcgtaaaactgtttgccagcttttcacgattaccgctgaattcagataatttatcctccaattgatctatagtcgtggcacaataatctgcagtattgatcaataaaacggtatacttggcagcttctagcttatcctggacttcaatattgtcgggcagcagtaaaggaagaagaattttttgtgagtaagtttgaagccatctactgaaaaaatttgccaatgaagtcaatatgctatcattggcattattatcaatgagctctaaggtctgagtcagtacggaacgatatgtcctgaaaaggtctgcactcgagggtaacacgagagattctgtttcattagatgggtacttcggctcactcatataagaaagaaatttcttttccatcatttggttttggtgagacacccataaagtcaaataaggttcgaagcaggaacttagttttggttccttaattttttttgaaaatcgtacgtcgatgtatttttcgaaatctagcgtcgattgtaatgctgtcatgaatagatcaatggaagggttcttgtctttgaattcccttttcagaagtgtctgaaggtccttgtgtgtaatgtgataaaaagtggtggtcaatctgactgccatttcccagtcttttaagaaatagtctgcgaactttgaattgaagttattaagaatttttttgaagtaaatgtatcttctcgataaattttctagggatccggcttcatcgtcgaccctaaatatctctttcatttcgaagagaagtttgtccaaacaccaatctatcatctgggctctcgtacttgtatcgcagtcgagtagctcgcaggcaccttcgcgcaattccatagtgagtgctgtatcatgctctgagatattgccgccggaaaagagcgcattgtagttttgtttaattttggacaaagtgtctcctttcagtcttgaaatggagctcaacaaatagtttatctcgtccaatgatttgtaagagatgaatgtgttttcagcaagcgaacacattatcttataaggggacaccatttttttgaatgagccctgtgagagtaattcattgcattgtatgtaactgtctgtcaatatctttaaattttggaaaagagtcaaagagtgggtgaggtttttcttggcaatgtccaggtacgagataccttctgtcagattcgatatcgtcaactcggtggaggctgagacatcttgagtttctttgaaatcttggaaaactttcctcagagaagcctctatttcagcggaatttttagggtgttccttcaattcattctcttctttgagaatatcctcttgcaattgctttttgtagcttctggtaatactgatcagttcatctatgttgttcagggattcttttgaaaaaagtatattggtaatatcttccagcgggtcataatctaccgtaccttccagcattgtccttctgagaaaacaaaaatggaagatgttgtgaaaatgcagtaagtgacaataagctagcgacttttcaatgatcgcagattaagtatatatacactttaggtctccttctcttctttactagctacgaaaaaacaaagaaaaaaaaaacaaaatagagggaaaaaagatatacgtataaaaatatgctccaggggaggttcgaactctcgaccttcagattatgagactgacgctcttcctactgagctactgaagcactatttcttgttccaaccgaggaataatactagacctgtagaaaagtaccgcttatctaatatccaactttttcttctgttccctttagtgaattcaagatgaaggaacataacagaacggaaaacaaaaaaaaagggaagaaaaaagatatcaccaccaattggcacgctcgcaacggtttcgggccagattcatggccctgtggggtagaagtgcctacagacaaaaaaccgttacgtcccgcctcaccaagcatcgacacacaagccctctcaacctccttaatttctttatctttttttcccttcacctctgtgctctttttttagccacagctgtgcattacgcttgctttgcttgttttgttctctttcgccatgccatattactacttttctacttactggcacgaggccgcgcaagccagatccaagcacgccagaaagtgcggtgtactggtgcaaccttttatcgatttctcatcatatcgctatcgcaacgggcatgggcgacgaaaaagccaatctaaagcgttgtcttcctcgttcctcgcgcacgcgattttgcgttctgcataggaagccgaagtcgaacaagaagcaggcaaagtttagagcactgcccctccgcactcaaaaaagaaaaaactaggaggaaaataaaattctcaaccacacaaacacataaacacatacaaatacaaatacaagcttatttacttgacatcgcgcgatcttccactattcagcgccgtccgccctctctcgtgttttttgtttacgcgacaactatgcgaaatccggagcaacgggcaaccgtttggggaaagaccacacccacgcgcgatcgccatggcaacgaggtcgcacacgccccacacccagacctccctgcgagcgggcatgggtacaatgtccccgttgccacagagaccacttcgtagcacagcgcagagcgtagcgtgttgttgctgctgacaaaagaaaatttttcttagcaaagcaaaggaggggaagcacgggcagatagcaccgtaccatacccttggaaactcgaaatgaacgaagcaggaaatgagagaatgagagttttgtaggtatatatagcggtagtgtttgcgcgttaccatcatcttctggatctatctattgttcttttcctcatcactttcccctttttcgctcttcttcttgtcttttatttctttcttttttttaattgttccctcgattggctatctaccaaagaatccaaacttaatacacgtatttatttgtccaattaccatgcctaaagagaccccttccaaagctgctgccgatgcattgtccgacttggaaatcaaagattccaagtccaaccttaacaaggaattggagacattgagagaggaaaacagagtaaagtcagacatgcttaaggagaaattgagcaaggacgctgaaaatcacaaggcttacttgaaatctcatcaagttcaccgtcacaaacttaaggaaatggaaaaggaggaacctttgttgaatgaagacaaggagagaactgttcttttccctatcaagtaccatgaaatctggcaagcctacaagcgtgccgaagcttctttctggaccgctgaagaaattgatttgtctaaggatatccatgactggaacaacagaatgaacgaaaacgagagatttttcatttccagagttcttgcctttttcgccgcttctgacggtattgttaatgaaaacttggttgaaaacttctccaccgaagtccaaattccagaggcaaagagtttctacggtttccaaatcatgattgaaaatattcactctgaaacttactccttgttgatcgatacttacatcaaggaccctaaagaaagtgaattcttgttcaatgccattcacaccatcccagaaatcggtgagaaggccgaatgggctttaagatggattcaagacgctgacgccttgtttggtgaaagactagttgcctttgcctccattgaaggtgtctttttctccggttcctttgcctccattttctggttgaaaaagagaggtatgatgcccggtttaaccttttccaacgaattgatctgtagagacgaaggtttgcacaccgactttgcatgcttgttgttcgcccatttgaagaacaaaccagacccagccattgttgaaaaaattgtcaccgaggctgtggaaattgaacaaagatacttcttggacgccttaccagttgctttgctaggtatgaacgctgacttaatgaaccaatacgttgagttcgtcgccgacagactgttggttgctttcggtaacaagaaatactacaaggtcgaaaaccccttcgatttcatggaaaacatctccttggccggtaagaccaacttcttcgaaaagagagtttctgactaccaaaaggctggtgttatgtccaagtcgactaagcaagaagccggtgctttcaccttcaacgaagacttttaagagtatctctctatatatttctttttacgcagtctcttcaatctctttatgtgggctttcgcacctcttatttatatatatatatatacactgaatcatataaacttttttttatattgaatctaatatattatcaaacggaaacttcggctgaatttcatacgtatattgattaaagtggaaagggcatcggaaaagtaagaaaagcttaaaaaaattgaaaaaaaaaaaaaaaaaaataaaaaataaaaaataaaaaaacctatacaatacatacatatgtatatgaatataaacctggaacgatgtgtctttaaaaatagttgaacgaactactcggacatacccctacatcacttaaggatgtctactttcataagaggtcccatctgcggtacagacaactgcccctcacggctttggcgtatcattgatgggagaagaacctgccaatatggtcacgttatggaaggtgacgtggaatttaacgacgatgaagatgatctcaacggcctcggtgcaggtgttatcacaagacgtctgaatcttaccaccaatgccactggtagttttcaatctagtcaacttaccaactcgcaactgctgcaacaacagcaaaggcaatctcataaaaaatttaaaaaacttatcggtcatgaggccaaattactatttctcaaatccttccagttcatcttgaaaaggcaaatccgctggctcataactgaaatgcggtttccgaaagagttcgaacatgtcgccaagataatttggctcaagatattaaagacgattaacgaccaaccgcaagaagaactaaaacttcaattacatatgacttcgacaatttcgatcctctaccttgcatccactcatttgtccctaccagtttatacctgtgactacatcaaatggatatgcaccgccaaaatgccgtatttccaggcaagtgaaatactaccgaaatcgtggaggatccagctgccaaattattatgtttccatactagagggctcaatttcaccttttaatgggcaactgtacaacaaaatcgcattgacgtgtggtatgatccacttcaaagaattcttcaactctgaaatttcgtgtcagggcttattactgaaactagtgatgcaatgcgctcttcctccagaattttatttttataccaaacaagttatcgaatttgaagaaacagacattcggaacctgacactgtgggaaagaacggacgaacgtcacacagggcgagtaagtaatcatgccgaactcagggtcctctcttattttatgctcacaataaattggatgctttcttttgatagagaccgacaatacccactaaaatggatcctttccctcacggaatcattgactcagcgcacaaccacaagtgaatctatcggcagaaatatcgttaaagtggtttacccagacaaaccgacttctagtgattatttccagtggtctgaggaggagaccctagagtttttgaagtggatggaaaagcaatttttgcccacacaaacaaaatctttgcataatgagaatggttcgatggagatgacaattgatcaaaaaattgctagaaggaaactgtacaagattttccccttggatcgagaggccaatcatgatggcgaatttaatgactcaacgcatcagttaacttttattgaagatctgcaagaaagatacgctaaacaaacccccttttttgaaagcaacaaaatacgtgattctctcaattatcaagaggctaatccaccggccagaaaggaggctatcggtagacttctaacccatatagcatcacagcttttagtggattttgccatttctaaagagcaactgaaagactgcatttcaaggatcaaaaatgcctgtctgcataggatgaattgactccttttaaattattctcgctggattgctatttctatgcatactccttgaattacatataccaatctgcatatattataggtacatattaatatagaaatgtatcctattttacattgtttctataacttttacattatcagaacttatttttttcctgtcaaaaagaaagaaaactcattctctagacacagcgagatcttacttttcctaacggtgtgaccatattgtacgtacaatattatctatgttttatgaccagatctagttttaaacagaattttaaagggagggtgcctaattttgtattatatattaaaaaagctgggaaatgcccggctcagctaattttcttcaagccggttttacgtgcagatcttgacgaacgaaaataaccatcatccgattaatttgtttgtttattgccccgttgcccattgtgcaaatccgccttgagcaaacgcttgtagtgcgcttccaaatccagtggacgttagtcttccaattttactatctgtggactcggcagctttgttgagttcgtcaacagaagcaactattctgttcacatttgtttcaatgaccatgcccccctgcacgatttcttctaatacactttccaaagtttgccagttaaaaatcaaatcaagttcattgacttcagtaaaacaacggtccaatgattccacaaaagtttggatcagatctaatatggccagttctgattcttgatcatccacgatgaaagtgaaatatagtgtagcgtagtttttatagatgatttgaatatcttcattgtttacctcatcattattattttcattgcttaacagaagcgatggtggcgtgactaaaaaagaactttgaaaatcgctattcctttgagaaatcaattcatatacttgctctaatagcagtttttgctttggaaggtcgaccggcgtgtagaatttcactaatcttggttggcatttcttattgactataccaaaaatgatgaattatgttagtaatgtataattttggcagaagaaaagacccttgagaaatcttacatacatattagaactgcatgaatcattgtgtaacgttatatgtgttctggcctctgtaacccagatctggtatagttacaacagaaatgatattgttccagtggactatttaaaaaaaatatactcctacaacgtaagagaagaaatataaaaaagaaatgcgcaagcccggaatcgaaccgggggcccaacgatggcaacgttggattttaccactaaaccacttgcgcttacttttgatatgaatctttcattcatactcaatattaataagcaagatattttttgaaatgaagaaccttaatcgagccatcgtattcaaaaagaaagaaaaaagactgaatgagaactatttttttattgccttatagagaattacttgagactttttttttttgcctaaaatatatgactttattttcgcttggcctttcttacctcgttttgtgattactcattacttacatcagcgtaagctttccatatctataacatttatgaaagtggaactcctcatactcaaaagttattgctatccatttatattgtgatcttaccattaagatatatagcagatcataatggcttgattctaatactcctcgagtatgaccatgcaacggttcaaaatcccgggttgtaaatatttcttttatcacgaaacatgagtgacaaccacttagactcgaaagtgacgttcttgtatttgcacattcgatgataaatatttaaaacgtatatgtagatacatagtggacagcaagagagatgcatggttggcccatttctcagccttctgtttgttctcttcttaattcaaatggaaacttgttgatctcgagtatcttgttaattgtttgaacgtttatactgtcattgaacgattctacccaatttttgcctttcgtgcctttttttggggtcaagaacccatcccaatccaaattggcaaccttttgaacgcttctattgacctcgtcattaaattctcctaacatatctttatcaggaaatatgctaacaatgtataaataatagccgtcctttgcggttcccacagtacttctaccaaggttatctaaaaaacttttctttggcttgcccttcatgctagcaggattaatatttggagatctgttaagattaacgtactctcgaatggccttatcaccatttagtttacaccactccttgataaacgttgttttcacctttaattttaaatctcgtctcaagtacgcaaattcagagggaatactgtttctatgtctatttgtaagccgtgtcatcgctgtttgaattttgcttagttcgacttcattagcttttgatatcctagtttcattgaaatattctttgtccttgttgaaaaccttcccatttaaataaaacttcttattggattttaccgttattgctggtttactttttctaaaacaagacataaaatggtcttcagggaagtaatgaagttgaaagaatctactagtgtataccaatgagttaggggaaaatttttttccaatcgtcacataggcttggatgggtgaaattacacctcgaagtttaccagcaacaaatttcactggatcccagtttctttcttcttctttttgtaaatcagttagcgtacttaatatagtattttcagcatttaagcacacagctgaatttcctgaatcgctttttcgaaggtcaccaagagaaagaggctcggtattcttcgtcactataaattttgaaaagggatcactactatgtatagtggttgatggtcgaattaccagtttgcctttaggtttttgcgataagagtgtggagaatatcttcatgatttggtttttctattaaccttcttaatcttttctttcttcatctgccatcgcctttctatgttttccgtatttcttccccgcaagttctttaaactcagatagtattagaatcgataattaaggccaggtcaaagttcgtattaatttcaacctttgggcacctatattggattaatttccgtaagataatatatgagagcactatcatggagtgatgaagaaaaattcaaactctaggggcaaaccgtttgttacgattgctcaaaaattactgcgtctgaagccagaattgtaggtatatacgaaaaggtacaacttgggatactattgacggcggtaagataagtgaatcctacctttcgttttgagccgctcaaataagacctgatacaaaaacggttgtttaatctttgtatagtttcttctgtagaagagttatgaaaatatacacttaaactataacgataagaaaatgcgaaaggaaaatgatgaaatcgaaagcattcacaatttccccttggaagcattgggtaaattaccaacctacgtatcctctcgcaacaattctgaaaacctttaacttcccacttttcatatggcttagcttgtagctgttttgaataatctttccctcgtgattttcgataactctaaacttattctttgtaaaatcataatcagtaacaacactcgaatacggagcggcggagtccattccaacgttgataatttcgttttttccgatctttttatgagcttcaaatttggcctttctaattacaagaatgtcacctggtttaatcttctgtaagctcttcatcaactgttcgattccttcttcaggtttataactcaatatagttgcgccaaacgttcttgctcctatgggttgtataacttcgtctttgaattcggatacaatttgtgacacgaaattcttagccccaatatgtgaatttatcaatgaatgagatttctctacaactttcgcattaaacctttgagcgtattcatcaagaatacgtgctgattgtgtttcgactggcgatggaaagcgttcttgaagagtcgttaccgttttctctgggcttgtactattaaaggtcaaggagaatcttagttgcgaatagttttcaaacaagaagtaaaaatcccttaccacccatttttgatgtaatcttttggaaatgaaatgatcatcgatctccatcaaaaagttcaacttcagattgcttatagcaggaggtgcgcttttattaatccaccatctttcttgtgcattaaactctatcttgacgttgttggaaatctcgcctacatcatgcgtcgttgaccttcttatagaggccaccttcggtgtagtatctgactcatggaatgaatccacaggacgattcgtcaatgaaggcacatggggcggtagggttcgtgattctttttctgccccagatagtactgaggttggcacacgttgttgcgtactcatcattgaaggtgtagaggccgtgacattttgatgtggtggaggagaaggagctgtatgtgaatgagtggctgttggttcagagtcaaattcaaaagtagccggtggtactggtggtgcacgtggaagtggcggagcagtatttggcataggatgatattcctcggatacaggtggaaggggagcagatgacttgacatgttcttctacttcattgtgtttaggcagcgcaagaggcgctggaggtgctggaggtgctggaggtgttggaggtactggaggtattgaaggtgctgagagtgctggaggtgctgaagatactggaggtactgggtactgggtactgaaggtgcagagagtgctggaggtgctggaggtactggaggtgcagagggtactgaaggtgcagagggtactggaggtgcagagggtgcagaaggcactgggtgaggtggcaccttgtcctcaggatgtgacaccttacttagaactggagctgctggagctgccatcgaaatatcttgagcggtttctgttaatgcagatgaattagtggaaactgtatcatgatactcgtttatggatttccgccgattttcccctgaaatggatttagtcaaagaatttatcgacccgttgcgagcaactcttgtttgtggggaagagacaggcaaaacatttccagttgtgttttgtgatgaattttcaatatcatgtgatacttctgcagtacggtgggagattggtggttcttgagggtaaattttttctccggaattaacattctctgactcattattacctatctgaaaagcttgctccaccatcgaatgctttctcaacccatcgtttgcatcctcaaactcgtggtcgtcagtatcttcatcagaatcatggtcagagtattcgggatgtgcattatcaacagcagctaaattgtgataggcgtgtgtaccatgttcttgcttctgttcatgctctgtggttgcatgaggatctagcgtctttgtttcagtgggttgattcttctcacttagatttgatttcctaaaaaatgggttagaacttgggtcaacaaatggcataacaggtatggcacgaggtagttcttggagctgttcaggttcctcctcctccttctccttatgctgtttctttttcggctcttctgatggtttatttccaactccagaagccataccgaaggggttaaaaccaacaggagcaccgaatctactagcgccagatagtttagccattctttctctcaatgcggccctacgattctcttcactatcttcctcttctttttcctcatcattatctccctctctgtcttcatggccgtaacctatttcgctttcctcagcaacattttctcctcttgcctcgtctgcttgtgactcctcaactttctgattttcctttgtgtactcatctaaaaattgttctttctctatgtcattcgtgccttcatctgcttcgcgtgaggttttagtaatctctttatgtgccaataattccatttgcggttcctcgttgtgctcagtttcaggcgtaaattcaggtttcggttcagttttttcattttcttctgcttcttcagtttccgtatagggctcattcttgttaaccgcactacgttcatgttcttgttcgagcttagccttttttctcaagagttcttcttctcttgcagcctgtaatctttgttgctcctgtaaaagagcaattctttctttaaggctcatctggggcaaatccttctttaattggtcattctcagtttctattcttccactttccacctgtgcacgattaattggttcgggaacaatctttttttcgttttcctttagggactttttcctttcaagattggacgtatcatttgttggaattccaggggggacatagtatttaggagcatctgccacaattgtttttttcacaggtatgttttctaaatccaagtgagttgattttggtaaaggaacttgctccgttatatcttgattaaacatagataagcgagccttcaattttggagaatccatgggaacttttctttcgccattaccactactactatcatgctggacctgtgctgatactgctgtagcggctggaactggcactgtagcggctggaactggcactgtagcggctggaactggcactggcccggacagagtttctttcttcgtttcaggggaaatgggctctggtaggtccttttgttctacttccggctggattgtacgttgctcagtggaaccggtattcggagatgattcggcttcctttccaacttcagatccctgaacagcaacaaaacttttcgggaagataccctcaataacgtcgccatttgaatcctggtattcaccaaagtaccattcggcgtcttcaacagacgtaacaataatctcttgatctttttcaaaatttaaatcgtcctcgtaatcggacttgtatgggaactgagccaccaccttgaagggcacttcgggttcactcatccttagtttgggtaagactgtgtttacttctagtagctcttgcagttgggacgcgattgatgtttactaccgacttgacgctactgtttcacagtgtgctagtaaataccacttctagttgaagtcttaaggagattataattctggaggtaaaataggggcattgtagacctctaactattttcagggtatattcctatattatataggtttattcttaaaatatgaggtttataaatgatacacatcacttattgatagggttatactctttgatacgggtaacatatgagacgcgaaaatggaatataatgacaatgtaaatatcgtcatcttgagataattatcaacaaggttgtcatgaggagttacagataaaagtcaacagagtggagttagtggtgttttaactgtagtgctccatagtttcacggcggtttctcttgttttcagttggtagtaacttttatcctggaagtgctggaaatgaataactcaaatgagcataggcgggaagaggcaggagcggctaatgaacaaatgccttacaataaggctgtaaagtccgcgtatgcagatgtcctcaaggacaaaatgaatagggaacaggagattagcctacgagccatcaaaaaagggatatacaccgatggcggtgaaactgacaactatgatatggataaagagaatgattccgcgtacgaaatgttcaaaaaaaatcttgattttccgttagaccaacataatgatgacgacgatgatgatccgtacattgaggataatggacaagagaccgacggatatagcgacgaggactatacagatgaggcagacaagagttttatagaagacagcgattccgacagctacgatttggaaagtaattctgactttgaagagaacttggaaagttcaggtgaagctaagaagttgaagtggcggacgtacattttctatggaggccttttcttcgttttttatttttttggatcttttttgatgacaaccgtgaaaaataatgatttagaaagccattcatccggcgctacatcctctccaggcaaatcattcagcaacctacaaaaacaggtgaatcatttatatagtgagttgagtaagcgggacgaaaagcacagttcagaattggataaaacagtaaaaatcattgtctctcaatttgaaaagaatattaaaagacttttaccctcaaatttggttaattttgaaaatgacattaactcgctgacaaaacaggttgagacaatttcaacttccatgagtgagttacagaggcgaaatcacaaatttacggtcgagaatgttactcaatggcaagatcaactggtaaaacagttggatacacacctccctcaagaaatacccgttgtaattaataattcttcgtcgcttttaataatccctgaattgcacaattatttgagtgctttgatttcagacgttattgagtctccaggcattggtactgctggaagcgctgaaagtcgttgggagtatgatttgaatcgctatgtaaaggaaattctttcgaatgagttgcaatatatcgataaggattatttcatccaagaaatgaacagaaggttgcaatctaacaaacaggagatttgggaagagatcacaaataggttagagacacagcagcagcagcagcagcagcaggttcaacaggattattctaacgtgccacagcagtattcgagcatattaatgaaaagattaattcaccaaatttacaattccaatcaacaccaatgggaggacgatttagattttgctacttatgttcaaggtactaaactattgaaccatttaacttcaccaacctggagacagggcagtggggtacagccgatagaattactgaccgactccaaacaaagctcctcaacttactggcaatgtgagaacgaacctgggtgttcatgggccataaggtttaaaactcctttgtatctaaccaaaatttcgtacatgcatggccgttttactaataacctacatataatgaactcagcaccaagactgatctcattatatgtaaaactgtcacagactaaagagatcaaagcattgcagacattggcaaatcaatacggtttcgggcagcatcacaagagagaccgaaattacatcaagatcgcaaaatttgagtacaggttgacagattctagaatacgccaacaaatgtatctgcccccatggttcattcagttaaaaccactcgtacgctcaattgtctttcaagtggacgagaactacgggaacaaaaagttcatatctctgaggaaatttatcatcaacggagtgacaccgcagatttgcaaataattgaaaataacgagttccctgttttactgggtgacaccccagaatatggtgtcactcagaacaccgacgaaggcaagaggaaagttctcctatcaaagcctccttacgcgtcttcatctactagtaccaagtttcatcccgcttctaacgtcccatcatttggccaagatgagctagatcaataaacgacaataaaaaattaaacgttctaaccccctggcccccagaaaatcgcgcagattgacggcactccctttaaatcatagagttaatcagctactcaccactctctttcggtactggcgttattctgaattccaaccttgaacacagccacacggcattcagatgttgctcccatgcgtggactcacgctctgcgattaacagctcatggaaatttcctcgtgctatttaagactgcagtcgtttggaaatcggaatatcttttttcgtgcagttttgcgggaaattttccctacttaaaaagctgaatgaaaatcagaaatatctgcaaaaaaaaaaggtaaaaaagggaaattttaagacatagcataaaggacttggttttgtttcaatactcagcccttttcattcatttctatcacaagtttttttttgctctcgtttccattttcttcgtttacttattattgacgtacatcttttttagtttcaaataacatagcaagaaggcttaactaagttcctatattcttggcatatttatcatcatcaggtcttttaaaagtatctcagaacgtaacttcaacgcctttagatttttttcacaacacgactctattgcaagagacaaaaaaaattaaaatgggcattttggactcgctgaaaaaacctgttaatatcaagagttcgctccccaaattctcccgcagtgctaccagcatcaatttaagtagccacccagtaagttcacggtccttcctcgaattaccaccagagcttttcagcatcactaaacctatatttaagcttctgcaagcacacgcaaataagatttacttccaatcttccgacgctgaggctgtatggaatgttaaggattcttctggacatgtttttgaagcagagtcaatttctttgctcggctctcatataattatcacaaattcctctgtacaagtcgcagacgtggccatcatagattccccttccaacataaaccaatgtgaaatttcaagcgttggagagttcctgcaattcaataatggccaactatctatcacatgtaacgattttggtttactggagaagttcaaaaggttgtgtatgatttctatttttgagttcatttctatatataaggccttgacaggcacagtgatttcctcttatgggctgagaatgtctgatatgcatatcattttgaactcgccgttcaattttaaggattggtgtgaagtttatcttgatggtcaaggttgggtgaaagtgtggtgtcatattgataaagtgtctaaaaccaataattctaaaagtagtagtgacaatgatgctaaaggaaagtatcaaatacggttttatagagatgacaaatccacatctagcaagaactgcgttttttttattcctgacaatgagtacgttcaagatattttcttttataacatcaatgcggcagaaccttctaaaaatatgaacgacttttttcaagggttgcaaatgataaagctcgttggtaatgtacgcttttgcagtgatacggactttaatgatgtggtggatagtggatccatctatagtagtgcaaacaacggcagtgtgacagcagctcgacagcattgaataatgaaagtcctaacactacaccaaaaagtagaactttcttttcacctaaagggcacagaagaaatagctcccatgtaagttcgttaacttctagatcaacaaaaaagcctataactaacttcactacacgtacaaatgggcttttgattaggccattgccccatcatggcgtacatcacctggaagcaatgatcaggttcattattcctttgatggattgtgcaagactttatgggcgtccagttcaattcaagacagaaagaaccgatataaattcgttaatgtttggattacctaaattgccctcagtggattattttgctgaagaggagattgcccatttgatgacccaggaatttaatcctttgaaagaaaaagatactgacgatactatggctttaactatgtcaagattttctagctacctgcaagaaagaatgacaaaagtctccaagagaaacacagaactcaacttcaggacctttagtgatgtaatgggcatgtataatactacgagggatcactctaaacttaattgcatgagtgacaaggataattctgtgaaggaattttcattgagtgataaaagcaatgttagttctgaaacgactaatatgatgaatcaattgcaagtaaacgcccatgaatacaaaagttctatgtgcgaacgtcctatcgtcgcaagtacttcgcccattgcatagttcttcgcatatatagccacatctcaaaaacttacatacagtgtatatatttgtggtacagtttctgtatagccaaatataccctgatataatcttatgtgatattatatacttccatcctaatactaaactttttcgtttaacgtgacgcatggtgcgaagaaaaaaaatagcaaatcgccactcaataaagtgagtagagagcattatatcaaaaaagcatcgataatatcgagtgatcatacgttgaaaatcatcaagtacaatagtgatataagccacaatgcaagctccagtggtatttatgaatgcttctcaagagagaactaccggtcgtcaggcccaaatctccaatatcactgctgcaaaggcagttgccgatgtcattcgaacttgcttaggtccaaaagctatgttaaagatgttattggatcctatgggcggtcttgtgttgactaacgatggccacgctattttaagggaaattgatgttgcacatccagcagctaaatcaatgttggagttatcccgtactcaagacgaagaggttggtgacgggactacaacagttattattctagctggtgagattttagctcagtgtgcaccttatttgattgaaaaaaatattcaccctgttattattatccaagccttgaagaaagcactgactgatgcactagaagttatcaaacaagtaagtaaacctgtcgatgtggaaaatgatgccgctatgaaaaaattgattcaagcctctatcggtactaaatatgtcatacattggtcagagaaaatgtgtgaattagctctagacgctgttaagactgtccgtaaagacctgggacaaactgtggaaggtgaacctaattttgaaatcgatatcaaaagatatgtccgtgtggagaagattcctgggggggatgttctagattctcgcgtcttaaagggtgtcttattgaacaaggatgttgttcatccaaagatgtcccgtcacatagagaatccacgtgttgttcttttggattgtccactagaatataagaagggtgaatctcaaaccaacatagaaattgaaaaggaggaagattggaataggattttacaaatcgaggaagaacaagttcagctaatgtgtgaacaaattttagccgttaggccaacactagtcatcactgaaaaaggtgtttcagatctagcacagcattatttactaaagggtggatgtagtgttttaagaagagtgaagaaatcagacaataatagaattgctcgtgtaactggtgcaaccattgtcaatcgtgtagaggacttgaaggaaagtgatgtcggtacaaactgtggattattcaaagtagaaatgattggggacgaatatttctcatttttggataactgcaaggaaccaaaagcttgtaccataatgttacgtggtggttccaaagatatattaaacgaaatagatcgtaacctacaagatgctatggctgttgctcgtaatgtgatgttgagtccttccttgtccccaggtggtggtgccaccgagatggcagtttctgtcaaattagcagaaaaggcaaagcaattagaagggatccagcaatggccataccaagctgtagctgatgctatggagtgtattccacgtactttgatacaaaatgcaggtggtgatcctattagactcctatcccaactaagagccaaacacgcacagggaaattttacaacaggtattgatggtgacaaggggaaaattgtagatatggttagttacggtatttgggaacctgaagtcatcaagcagcaaagtgtcaaaaccgctattgaaagtgcatgtttactattaagggttgatgatattgttagtggtgtaagaaaacaagaataatagcctcgaggttaaacttcattactgccgtttaatatttggtgtttcttcacatttttttgtttttttatactattgtaatgtatttatatagaattaaagtcctcactataattttgtcatccctacagtatgtcataagcgttaatcggacaaacgttcattttaaaattggcctttttatatttatattactcctcataggatttaatatagaagtatcattcgttaaataatcattatatcatctgtgctttaaataaaaaagtcggccgtcgatgtgtttacgattggccagtatacttactcattcatgggattagttttatttcaacgctgtggtgggtacgatatgaaagacgaactcgacttgtcatcatctgaaatgatctcagaatttttgctttgagaaaaagaatttgattctctcatttctaaaattggggttaactgccgcggcttgacagctgagatgatatcagacgtctcagtgcttcgtccctttggcgtcatagggcagtttatgtactcttcgccagaaaacattcttccctggtttgagggggtcaacgacttggagactaaggcttttctacttatttttggtcttttcgattgtgcttcagcttctttttgatttgcgctttcttcttgccctaaatttgcttctcttggatgtttcctatttgtcctaacccttttataaacgtttctagaaattgccaagacttcttctagcgaaaattctagtctaccacctttagattcctcatcttcacaataaatcagtttaaaattacagtcaattttttctggtttctggtcctttgtattaatcatttgataaacagggtcacttctacctatagaatctctaaagatcggtagtttttcatcatatggtctctttttttgcgataacatctcatgttgtttaagctcacccaaattggtatttgcttctagcaatgatattcgaaggttgttttctttgttcctttctgcctttaagtcaaaattttcccagccatctctataaacacctctattcggagtttcgaatagttctacatcagactcttctccatctacaaatacgttgttttttgttaaattgacgtcacttgatgtgccattttgatttgcaagctctagtctattgacaaattcagatctggttttcccaagtactgtagactctaatgagtccatcgatatttcatttcctagctgaatattgttctcccccagttctctcaggagatggtttaaccggtcttctaaaaccttattaggcctagccttatttttgattcctagctgtagaattttcacggcatattgaaatttttctttctgaattaatagattcgtaaattcttcataaaatgacgctaactcggaaccaattccatttcttaacatatacatgaaaatgtctctgctttccatgaatgaatttctggtaaaaagttctatgtaccaaaaccatattttaagaaacctaacatcattgcgatatctctccaaatcctttaagtgagataaacatcgctccaaaagggtgagcattccagattgtttggaattaccgccttgtggataggcgttgttcagccactttatgtattcaagatacaaagtaattgggtcgcttaatgcagggagctcatctatcagtctttgttcgaagcttgatttaacttggtttatttccaccagtggttgatgtatcgctttcgagagtgccgctgctgatctgccttccttcaggggaagaatgttttctttttgagtttcgatttcttcaaagttaataacattttgtgatggtgacgatggcatgtaagagatacgtttctttgcgtacgctttcattctatcaagttaacgtcttttattgtattttcgcatgattttgtttactatttttgaaccagtgtgcgcctggtgaaggtgtgcatttcaggcaagagggtagttctcatatataaaaaaatggcgctaaagaaattattatatctaatatgattattacttaattatacagtaaaaaaaacacgctgtgtattcatttagcaactaggttgcagaaaaaggaaaataaaatagagagaattagaaacacagaaaccatgccgggcccgatcttatcctcataatctactgctctctttagtctaatgtttaccactctcttggcataaaccataacagtacgtatcaacacagccaaggaagtaataaagaacccaatggagccaatcatggctgttggtgaaccatatgttaataaagtagtggagacaccgcccaacaatatcgagatggacaaccaagacaggtaggttctttcagtggcaaagtaaacttttggttccacacgaactggcacacatatcgtctttccggtggggcacgaatttgagtatcaaaagtagtaccttttgggattttagatatttgatcaccgttaaaatagtggtcaaaaaatgccacgatttcatagtatttcttggagataggattttcggcattcctgatctttctttgataataagcagcattagcactctcaacaacatgattagtgttggaggtgggggccgaagtagccccgtaaccaacagattcttctatatcaagagaattaccgggtgcgtttgtcatggcagcaaccaaagcagcgtcatcctcatcatcctcatcgaagtcgttatcttcgttatcggatctaccgggtcttgttatttcaatatttgttggtagtggaggtttcctgatatcaacatccatttgaggtaaccaaaatgggattgaatccactttatcatttagtaaggtagccacaccatgaataaacttggagaattttgggactggctcaactaagtgagacccgactaattcacgtacccactctggaggttcttgacctagttgagtttgcaatttaacttccaggactgcatatgggaaacggcaaatatccttgtcatctagctgcttgaatggccaatcgacaccaatatcagttctcctccaattcttatgagttctatccacaccatcaaagttgtcttctctcaccatagttaactctgtatcaagggagatacgaactcttgcatcaccaggtaattgaaaagcagttctattgtagaatgatctcactacaggtctcaactttttctttaacatgacgtattgaatttcggatgctaacgcctccaagttttcaatttcgttcattggcttcttgccttctttacgcatcttggcaaatacttgatcaacagtatatttaccctttaagaagtcattaacatgacgttcctttagcgcaaatcttgccttgacagatttctcaccagtccaatcctctctatgggtctttctttctacaaagatcgtgtctgtagacatacccccataccatctcaatctgtgggcttctgcaccttcatcttttcttaatctgccataataaaggtctagattttcattatcaaaatagatcgaagtaatagcggaatcttctctttcgaattccttattagtgttgaagactaacactggtaaatgcttcaagatgatcagcttcaattctgtaatgttatcagggtgaacccaatactttgttgtctgtctaacgaaattttgttgcttcccaccagcagatgagtctcccttgattgggcgacctgaagttctggcaatatcatatagttgggaaattttaacgactagttcgtcatagttttccttgaaaaatggtttagagtctaatctaacttggaaaactggtttcaagataaaacctgtcttcttatcgtgtttcttgataatcttttggaaaccagtgtagtttagtctcgaaaactttgctagatcatgaacatcggcaatgatatcacttagttcttcttctagaatctcaaaatctagctgagtaggaggattattggagtctaacaaacgaacagtatgttgcacttgttcttgaacctcttttacacgtctaaaaacttcactatgcttaactttgcaaaatgtgtaaaccttgtctaactcgatctccaaagattctaaaaaatctgtttccaattcttgcgtccactgaccgttattcttagataagttatcttctagctcagtcttcagatcatcataactaatataatagtagctgtactgtctaataagagacttgctcaagtgctcaccaaacttcatagctgttcctgccttgttatgctcttttattggccgatttgattgttagcctgtaacttctttctgattgcctcaatatataaagatagtattgcttctttttcattcacgtgtgcagccacgtgcggatgaataataaaaatgcaacatatatgcatagtgcggtgtgtgaaaaagtgaacctacaagtcagtagctctccgtcaaaacgcagacaaaccaattttttgtcggtgttttcctgtgcaattccagtaagtaacatattaatacaatttcctatgatgggttacgtggaaagcagagaggcaattgcgtgattaattcggaatattagcaacgcttctcttagtatgaaaaagctcttcgaaagactatatttttgaaagctttaatatgtttataagttaaatattgtcgaacttgtttgcgacagctcttgaagtcacggtgcgtctttttttactcgtcaactggtataacaatgcgtatgacaattattatataactattactttattcttgccatgaagggattactgtaacgccctcaactagtatacccttttaagcctcgacaaaaatacagaataaacaaaagttaaatctcaccgaagttgcttgtggtactggctttacagacgtttataacgcagcactaaatttccaaataataaccttcctccaatggaaataaaaaaaatcgagactaacccaaagtgtgcgcaataaactctaaaaaataaagtatattcttgtaaatatttctatatgcttaagttcaataatacatgcatactcattgaacatgttatattgttacacaacaaagtaatttctgtttttcggaagtgccagtccaaatcaattcaaagcactgtacactcatgcgtacgcagagatgatctctagcatttcctcaattgttttttcgtcaaatcttgcatcacactcctccactatggagtaaaggtggaccatattggcaggaagttgattgacaatctgcagtttttcagccttgaataatttaaaagaattcagtttagtcatcaactcagcaaagctttcatcgctcattttgcttatacccgatttttcagcatcttttgcaccactgctttctcgttcctcgccttcatcttcctggttgataaagtttttgtttatactgagatagttaaccacattgcgagtaataccttgcaattcaggatgattgtagggcctattctgcttacctttcgagcgacttttcttcagcgcagccaaacttttttggtcccaaagatgttttttttctagatctgttaggaacttcaagacttcatagtcacttaaaaatgcattcctttcctcaagaactttcataacgtttaaagttttttgtttaagtgtcgattttttcagtggtgggtgttggattcactcaacttctcttctactgtggctgttatttgcttaactttcatagatcgatggcattgaaaaaaataatttttcaggcaattttcctttttttacttggtataattttcaggaattgaaggatttttcaacgaattagccttgttggcgcaatcggtagcgcgtatgactcttaatcataaggttaggggttcgagccccctacagggctaatatttttttcttgcccacttattcaaggaataagtgctaattatctttcaaccttgcagcgaagctttcttttgtatttcatctcatagaaggtgaaatatcacactattttgtaaatagaaatagtatatgtagttcgtggagaaccagactgcagactatcaataaaaggttacattctgttcaactcatgtgaccagaagtttgattaagcaaaattgttcttctccttaacatatgatattatctgaaggaatctagaaaagcttgatcattccgcagaataacctatcaaaatgattgggaggaccattttataattcatgctacatatataacattatacagtaaacccttttaatgtaatggattgctcatagttgtgtacacgaactgtttgctaataagcttgttttagcttctattgctaaagaaattactgacgaagagtttatgacaaggaaagatgaacgaaagtacaatttaccggttagtgtcagcgccaaaggatccacgcactagcaaaataatgaaaattgtgccggatattcaagactaagagatgtacaagttgaaatataagtaaccctcggcataaactactctgtcgtaagatcattaacatgtcgatttgcctgtgacatttaacgattcacaaatagcggaattaaatgatactttatctatcctaaaacgcacgaagcatactttagaatgcatgctcttagtaagtatgcattgccgacttctctgtaagacttttatctcgtttcagacctaatctgcaacaagagaaagggaagaggacggtattgttacgacgttattggcggctaggaaagagagaatcaccatgaacgatatggtgcaaaaaaaataaaaaaataaattgaaacggacaggaattgaacctgcaacccttcgattgcaatcttattccgtggaatttccaagatttaattggagtcgaaagctctaccattgagccaccgcttcaacttttgttgaaaatttaggctaacattttctaataggtgacattacaaaatccagtcttacagttatgcttaatattgaccagtagtcatattactggcatattatctgttagaatagtgacatactattctttattactgatgaatttgtaattgtgaagcaattagacgcaaacgtcattgatgtgtcaggatggagaacgatatagactatgtgataatgtaaagttaaatatctgttacttgaacaattaacttgacgtttgtatatgtaaggatatgggtcattacatagaaactatagtaaatagtctcagtattgttatatttgtcatgtttgatatgactaatcggcgcatgttttacacctcttttgtatagtataagaagatctgcttttattcttgaaccctaccactatctcgccaagtttttaaaagatccactgcgatcattgaagattctatttcaaataaaaatcaactattacctatcatctagcattcatattacttgtatattatcatatctgtaagaagatgacatgaatgatgagaaatagtcatcagacttaataaaagccgaaattcaaggtcgataatgtaataggatagggtgttgaatgacaatgtataaaaggaacgaagacagagtaatactattatgtaagaaataccgattcccttgtgagtatataaacataaccatttcattaaaataatttattcaatggtatgtatgatattataataacatacttatacttgtctcactctgttcataaacgcaacaatacaattacttttgaatattatctttaataaatacacttagtagttaccaataaataataaaatcctttactaatactaatataaggatttctatgttctcgaggagaactcgtagtatgttctgtatccctaatattgtagcccttaacaacaatggaatacgaacaattttcttaatattcggctatttctgaaatatacatattcacgggatactaggaggtcagcatgttacaaatttcatgatagtgcatcaagagaccctaaaattaatatcctttatgtgcgtattgctttcatggtagtaaattatcactgttttcatctagacgtgggacggtaacattttcgataaatatcaaaagatggcagtcattgtatagaataccacaatttgtgagcatctctgaggttttttacaagcttccgtaactcatacagacttctatcgtcctactctagtattatttacctattcataaccacttttttatccttctatttaaatttatagatgcaaagggcggaaagaattgactggaaagtaaactaaatataaaaaatatcgccaacttattcatacaatatcgtagcaactgacaacttttaaaaatctgcaaaattctttgtagtgttccttaataatgtttaagctaaggttttttattaagaggaaaatattgcataattctataatttacatcagtacagtagtaacatattatccaattatctatagtgcttttgctttttgaaggcgcttccttccttcgaattatttctttctcttgagtgcttttctggctttggctgtagcggtttagaatttggaaatatttcaaattcttgctccttaattagttttttccaatcccacatttttctaacatataattccagtttccaattcttccacacttgcctgccataaatactattcttcaccttctcagtttctaaaactaatgctctagcaatacgctccttatataatgttaattttgccgtaaattcccacaatttgtccattatatgagagccatatacattgcatgccaaatttacagactctttagacagtatgttcaatagcatttttctcttaattatgtccaccctagtagtttgtagtacgtgctcaacaacatgcgaaaatactccatggtaacacatttgtatcaacctttcctcaggcagagccaacatgctgtcaatggtaatattcaaaaacttgtcgtcgtagtcaattaattgttccaagaaaactgatcgtcttctttcttctgctgttggccagtcatctctggtattgcccaaagtcgatgcactcaacaacaggcaactttccaaaatattctttgcatcagacttttctggataatatttttgtattaattgagcaatgacatcatcccttaagtaaccaccttgtttattgcttgcgttgataatagcagtaccaaaatccatatttgagtttaaaagcatgcttaattcaggaactactgcatccaatatctgttttacgtccttctccttcaaatgttccagcaatgcacgcactacaaaggcacctgtagtatccctttttgctagtttcacaatacggtctttcatatataaacgataaagtctttcaacatattttagcctggcagagccaatcacattttctaagaaatgagaaccgacaggatctgacagtaaatattccaggaatgattcctccttaggatccttctcatctgctgtattgaagaccaatctccaaaatgaacggtccctgtcaaaaataccttcgacttgaataatgagctgaattacaggggaagccactttatccacactgtactctctaaatttggtgatagtagattgcgaaatatcagaacgcgactcggcaccattagtaaatcctttgtataaagtagttattatgtcacgaagttcagatttgaaagattccggtgtttggtaaactttattgaaatcgtcattatctttaatgtcaatcatttttcttgcaatttttgactttttggaacgtaaagtagagttcgctttagttgaattaggcaatgtcttggaagacaaaattaatattagcaatctcaaaacatgtgatgcatactgatggttcatcatagttttcaagtgcggtttcagttcattcaacataaagagaaacatattttccatagtcacataaggcccttctttttcattgttatcaaaacttggtgttaaaagttctctttctaccaaggcggcacttctaacaaataaagtctctaaaacatgggaagcatatttatgacatgacaacccgaagaaaacgccattgaaagattggaaaatgtcttttaactgagtctcatcacattcaagaataactcgttccatcaatttcgaagttatttgggaagtaaccaatttcagttctttaccttttgcttcctcaataatgctcgtgacgaattgaaacttttcctcaggtgcttcgaaggcgtctaattgcaaagtcgattcggcttgcttgaaatactccagttcttctctatctagcacaccaaaaaacatttgtggctgagtctctttaatttcggcttcgtcattgtaagtagactcttcttgctggatgtgctccttcgcagaatttgaactgggttcaaattcgtcctttctctgtttgtcttggtgtcttctgcctcttgttttagtctttcccataataacaataatgtggtttttccgtgaaggtttcagcgtcgttcacagtatactagttgtaacagatcgcagctcatctaatataattttcttcattatattgtagatgagcatgaaaattctcgctaaccgaaaaaaaattgaaaaaaaaaaaagtattacaatcatcgaacaaatatacaggccaagagttcgtcggttttgcaggttgcttcttggttaatgtatacagtacatctgcattatcaaaaattcaaacattatatatatctttactactatacaggtacacatgatacagcctagcaagtttgaaaacttgattgcaatttatgacattatattctgctgtttgcaggtatatctactttgtaagtataaagatgcaaacaaatcagtcttcttggtcccagttacctggccttgggccttgaggtgctcttggaccacccgccttctttgccatgataatttggtcaatggaaagcacagtagttgcagcttctgtagcgacgttaatagcaaactttttcgttgcaagcatgtcataaatattttcctctctgatgtcctttacaccttcatcagattcgccatcaatatccacacctttatataaatgatctgtcttaactgcaccaggttcagttacgttatgtgcagcgtataagtttggtagtacctcattaacatcaagaccagcggtctccgctagggtacgaggaaccacttcaaaagccacggcaaactgttttatagctaactgtagcaatccaggtgttcgttcaccatacttagttatcctagaaatcaattcaatttcggtagcaccagcaccaggcaacaacttaccgcctgatggcttcattagtcccttgacggctgcaacaccatcatcaatggctctttcaatatcatccaaattattctgtgtggcacctcttaaaatgatagtagatgttcttgaaatttcaccttgctcttgtttgaacacagttactctatcaccacctatctccattgtcttaacagtttccactaaacctaattcttctggagttggcgcacctaatctaggcaatggagtggccccacaaacgcgacataatcttcttaattcgaatttgcttggtaccttcaagactagtataccgtatctattcaaataatgtaacgccaattcaccaacaccagcacctgcaacaatgcattctacgcccatgtcggcaatctctttcatcatggcatctatttgcttttcctcgcccttagaaaaatcgagcatttcttgtgcattatgtaataaaacagtgcctttcgtttcagtattggctatgtcaagcggacaagtgaaaactgcaactttatgctttttatcttcggataatgattttacatggccttcaggctcacgattgaaaaccatacctttgatgacggtagaattggaaagcgatccacccataatctttactactctgatagaatcaacattaaaataaggaatttctccagcttgctgagcaactggtaaaacgtgagatacagcttcagaaacaagttcactcaatatgtcttcagatccgtactttttggaggagatgactggtttaatcattttcaaaagttcgtttttatcattcttgtcagtaatttcaccaacaaccatttcgtctagttctttcaaagtaaacttccttgccatattataaccttgaataatctcaacggcagacaagcccattgaaatcagtttttcggacacatttaatagttcgccagccaaaatcatgactaaatttgtaccgtctcccatgtcgatcttctgttgttcagtcgccattacgaggactttcactgcaggatggacaatatctagttctcttagcatggtggccgcgtcgttggtaataatgattttaccgagatggttaacaatgatcttgtttctaccgcagggtcccatagaagtcaaacacatttgatgtaattcgcgaatggccgcaattgatttaataatttggccatcggcgttagagtaactattgtagccttgtttaaacaatcccgcgttgggattttgtggcaatctaagtgacatggttaattgatgattttattgcccttgaggttcaagttgtcttgtcggtatctgtaaagtgagaacatcatcatgctatactattttcttcacttttttttgccactagcggaggtgatgaacattttcgaataccgttaataatgacaaaaacaccattaacttggcttatataaaataagctattgaaatagtaaatgtgctcgcaactctttaattatctaaatccggcagcttctttattgattaataatacaaaatgttcggacaagtgatcattagatatcaacatgaattcaattggtaacaatttcgatgcttacattttatgctagtatacaccacgcatatgtctgtcaatgtacctattacagaaggaaatgttcaagaagcagttcagacagtaccgaagcagaattaaaaatccattatttgaatatgatctgatagtcatatatatgagcaatacaggtcttcacattaaatgtatgagaactgccggaaccactattacattggtcacaattaggaatgaaccaatcggcgtgtgttttatatcccccttatataagtctaagaagatcgatattcaatcttcattaataaagcctttttgacctctacctatgagcaataaaccatatccatcaatagtggtcaagccgtaagaatgtttttaccgagaatagaagtaaacttttcttattgtatataagaaaagcatataaacacgcgcccagagaacatattcagtatgccctagcttggaaacacatcagtaaaatactacgggctagtataatgacttctatatccaaaatttttaagttaacctttcaagtaaaagatctttgccttatactactgtctgaacaactcgtataaattaatgtatgatatgaacattcccattgttacgatagatgtcctaatgaggatcaactataatctatcgaatagtattcatattactaatatattatcatgtacgatgtaccaagatggcatgaagattgagaaaacagtcatcagatttaatagatgctgaaatgccaggactgatagtgtaacagaataatgaatgatatcatataaattggggaaacaataatgacaatattatgtgaaaatatcaattctcttttgtggattacaagatcccctggagaacttctagtatgtcctgtatacccggtgctatatcctttaataaccatggaatccgcaaatatttgatgtaaagtttgtttttcttccccaacatcctttgtatgcttcagtagctcagtaggaagagcgtcagtctcataatctgaaggtcgagagttcgaacctcccctggagcacattttctttttttgtgaattaaacctcgaagctcaacattcatgttttgagataaaaaaaggtacttattacttgtgtaaaagaaagtttataatgatgatcttatttaagtttatagtaggactttctatgcatgtcttgtagaactatttatgctggactcgccattaattagctccagtgaaagtacatatcttctttcttggacattattatctctagtaatagtgatataaggatcggcattcaacaggtgatctggtatttgcggcaatccagattctggtcctgcgttttttttcagttccataaacctttcaacgccaatcggcagcaaatcagccggtaaatgacgttgtagatcgcacatatcgaatgaattgatgtaaaaattgactatatcaaaataagcttcatttacggatttctcgtctgtttcaaataaagaataccttttacttgaccaattcttattatctagtaattcatatgctattttcaaaatggccaatgcaatggaatgttggggtatgactaaaatagtttctagcttcaaagcatcataagcaattacccaagccagattgcacaacttataatcaaaggatagctccctaccaatttttataacatattcatcaatatgaacgtaattgttgactctataatcgaatgagcatgactctaatatccgaagttctatttgaaataccctttttttaaaattttccaaaatgtccgtattgattttaaccacattcctcaatcgtaatgacaaagtacatatatcatttgtttttttaattgtctcaacttctttacagcccaaagtcaggcagcttgtcgctacagtgtagcaaacctcggtctcgaagcgattaaagaggtggtatctttggtaaaagtatactgctgtttctaaagtcttccgtggaaatttcagctgaacacacaagtcacttagaaatttgaacacggcaagttttttctggttgtaatttcgatagtccgatattgtattcttttgggctctttgaatttgccttttagacagaaacggtctcgaaaaaaaaagctgggattcaaacgtgctaggcatatcaaagtacgtaattttcttagttttgctggctctatatctcctctcgctctatagatacagatatatatatatatatatatatatctatgtgtataaagacggctttcaggacagtacttgtttggatttttgatcatcgcggattttcgcaatgcaagtataaagagagcattacccgccacacagtgattcttcagcaagttgtaccgaaaaggaccatttaggtacgtgggatcgcaaaggttcccaaacggtgtgcatcaagccgtagacttcatgagtgctttcggtgcagcaaaaagataaggacaaaaaatactgaaggatgcgaggttcgaactcgcgcggacaaccgtccaacagatcttaagtctgccgccttagaccactcggccaaccctccatcttatttaaaaatcctaggaaatagatgttatataagtcatacatcattgaaaacatcaaataccgttccctgcgttgttctacagaaaagcgcattagagtaggtcataccctttaaaaaatgattttgtaaatgccagaaagtaaacaaatatgcatttcgcctagctcccaatgtaaatagccataaaaaaggataaaatgccagatttagagtcagttctcgttcttcttcttctctgtgttcaattgttcaattgcattgttaatcactgaaattctatgtttcaaattggaatggcagactgaactgagaccttccttactttctcctctatcaaacctaaatattcaatcataaccttattttttcacttcctttttcttactttttttttttttttttttttgtattttggaaggaaagcaggggggacttaccataagaaaagcgactctaaaaaagtgtattttcttccaaagttcagtaaagacagctgggaagtatagtaacagaggagagaaagcataaggagacctcttgctgcagttcacaaccaaaaatagcatatctttactattgtcgctaaccattgcgaaacgagctaaagcaacagcaaacgaaatccctaggtcgaaatgtcatcaaaacctgatactggttcggaaatttctggccctcagcgacaggaagaacaagaacaacagatagagcagagctcacctacggaagcaaacgatagaagcattcatgatgaggtaccaaaagtcaagaagcgtcacgaacaaaatagtggtcacaaatcaagaaggaatagcgcatatagttattacagcccacggtcgctttctatgaccaaaagcagggagagtatcactccaaatggtatggatgatgtaagtatttcgaacgtggaacatccaaggccgacagaaccgaaaatcaaaaggggtccatatttactgaagaaaacattgagcagtctttcaatgacgagcgcgaatagtactcatgatgataataaagaccacggttacgctttgaattcatccaagacgcacaactacacatctactcataaccatcatgacggtcatcatgatcatcatcatgttcagttttttcccaataggaagccatcattagcggaaaccctattcaaaaggttttcagggtcaaacagtcacgatggcaataagtcaggaaaggaaagtaaagttgctaacctttccctttcaacggtaaatcctgcacctgctaataggaaaccttctaaagactccactttatctaatcacttggctgataacgtgccaagcactttacgaaggaaagtgtcctcattggtacgtggttcttccgtccatgatataaataatggtattgcagataaacagattagaccaaaggctgttgcgcaatcagaaaatacattacattcatccgatgttcccaatagcaaacgctcgcacagaaaaagctttctgctaggctccacatcttcttcaagcagtagaagaggttcaaatgtcagttcaatgactaacagtgacagtgcaagtatggcgacgtcgggtagtcatgttctccaacataacgtatctaatgtttctccaactactaaaagtaaggacagcgttaacagcgaatccgccgatcacactaataataaatccgagaaagtgactccagaatataatgagaacattccggaaaattctaactctgacaacaaacgcgaagccacaacgcctactatagaaacacccatttcatgtaaaccatcccttttcaggctagatacaaaccttgaggatgttactgatattacaaagacggtgccacccaccgctgtcaattctacactaaattctacacacgggactgagactgcctcacccaaaacggtgatcatgcctgaaggtcctaggaagtcggtgtcaatggctgatctctccgtcgctgccgcagcacctaatggtgaattcacatcaacttccaatgatagatcacaatgggtagcacctcaaagctgggatgtggaaaccaaaaggaaaaaaacaaaacctaaagggagatcgaaatcaagaaggtcaagtatagatgctgatgaacttgatcccatgtcaccggggccaccttcaaaaaaagactctcgtcatcatcacgatcgaaaggataacgaatcaatggtcactgcgggtgacagtaactcaagttttgttgatatatgtaaagaaaacgttccgaatgatagcaagaccgcactcgatactaaatctgtgaaccgcttaaaaagtaatttggctatgagtcccccaagtatacgatatgctccatcaaatttagatggggactacgacacgtcttccacttcctcatctttaccgtcctcatctattagttcagaagatacatcttcctgcagcgattcctcttcgtacactaacgcgtatatggaggccaaccgagagcaggataataaaacaccgatcctgaataaaacgaaatcgtataccaagaaatttacatcctcttcggtaaatatgaattcaccagatggtgcccagagttctggattattactacaagatgagaaggacgatgaggtcgagtgccaactggaacattactataaagatttcagtgatttagatccaaagaggcactatgctattcgtatattcaatactgatgacacttttacgactctctcatgtactccagcgactaccgtcgaagagataatacctgcacttaaaagaaaatttaacattacagcgcaagggaattttcaaatttccctgaaggtgggaaagttgtcaaaaattttgagaccaacttcgaaacctattttaattgaaagaaaacttttacttttgaatggttatcgaaagtcagacccacttcatattatgggtatagaggatttaagttttgtttttaagtttcttttccatcctgtcacaccttctcactttactcctgaacaagaacaaagaataatgagaagcgaatttgttcacgtagatttaaggaatatggatctgactacacctcccatcattttttaccagcatacgtcagaaatagaaagtttagacgtttctaataacgcaaatatattcctacctctggagttcattgaaagctcgattaaattattaagtttgagaatggttaatattagagcatctaaatttccttccaatatcactaaggcgtataaactagtatctttggaattacagagaaacttcataagaaaagtaccgaactcaatcatgaaactgagtaatttaacgatattaaaccttcaatgtaatgagcttgaaagcctaccggctggatttgttgaactgaaaaatctgcaattgctagacttgtcttcaaacaagttcatgcactacccagaagttattaactactgcaccaatcttttacaaatagacctatcatataataaaatccaaagcttaccacagtccactaagtacctagtaaagcttgcgaagatgaacctttctcataacaaactaaattttataggcgacttatcggaaatgacagatttgaggacgctgaacctaagatataacagaatatcatcaattaagacaaatgcgtctaacttgcagaacctttttttaacagataatagaatttcgaactttgaagacactttgccgaaactaagagcccttgaaattcaagagaatccaatcacttctatatccttcaaagatttttatccaaaaaacatgacaagtttgacgttgaacaaggcacagttatcgagtattcctggagaattactcaccaaactatctttcctcgagaaacttgaacttaatcagaataatttgactagactgccacaggagatatccaagttgactaaattagttttcctttcagtggcgagaaacaaactagagtatattccacccgagctatctcaactgaaaagtttgaggacattagatctacattctaacaacataagggactttgttgacggtatggaaaaccttgaactaacatcgctaaatatttcatcgaatgcattcggtaactctagcttagaaaattctttttaccataacatgtcatatgggtcaaagttatctaaaagcctgatgttttttattgctgcagacaatcaatttgatgatgctatgtggcctcttttcaattgctttgtcaatctgaaagtgctaaatctttcttacaacaatttttcagatgtatcgcacatgaaacttgagagcattaccgaattgtacctctccggtaataagctcacgacattgtcgggtgatacagttttgaaatggagctctttaaagactttaatgttgaatagtaaccaaatgttatctctgcctgcagaattatcaaatctctcacagctaagtgtatttgatgttggagcaaatcaattaaagtataatatatcaaactatcattacgattggaactggaggaataataaagaactaaaatatttgaatttttcaggaaatcgaaggtttgaaataaagtcatttataagtcacgatattgatgctgatttgtcagatctgacagtattacctcagttaaaggtactaggtttaatggacgtaactttaaatactaccaaagtaccggatgaaaatgtcaatttccgtttaaggacaactgcatcaataataaatgggatgcgctacggtgttgctgatacattaggtcaaagagactatgtgtcatctcgtgatgttacctttgaaagattccgcggaaatgacgacgaatgcttactatgtcttcatgatagtaaaaaccaaaatgcagattatggccacaatatatcaagaattgttagagatatttacgataaaatactgatcagacaactggaaaggtatggagacgaaacagatgataatataaaaactgcacttcgtttcagttttttgcaactgaataaggagattaacggaatgctaaattctgttgataatggtgccgatgttgccaatctttcatatgcagacttgctaagtggcgcttgctctactgtgatatatatcagagggaagaaactcttcgctgcaaatttaggtgactgtatggctattttatccaaaaacaatggtgactaccaaacgctaaccaaacaacatctcccaacaaagcgggaagaatacgagaggatcagaatatctggcgggtatgtcaacaatggaaaattagatggtgttgtagatgtgtctagagcagtgggtttttttgatttgcttccccacattcatgcttctcccgacatatctgtcgtgacattaacaaaagcagacgagatgcttattgtagcaacgcataagttatgggaatacatggacgtggatacagtttgtgatatcgcgcgtgagaatagtactgatccactccgtgccgcagctgagttgaaggatcatgccatggcttacggctgtacagagaatattacaattttgtgccttgctctttacgagaacattcagcaacaaaatcggttcactttaaataaaaactctttaatgactagaagaagtactttcgaggatactacattaagaagacttcaacctgagatttctccgccaacaggtaacctagcaatggtcttcactgatatcaaaagctcaaccttcttatgggagctattccctaacgcaatgaggaccgcaataaaaactcacaatgacattatgcgtcgtcaactacgaatttacggtggttacgaagtaaagacagaaggagacgcctttatggtggcatttcctacgccaactagtggtctgacatggtgcttaagtgttcaattaaaactcttggatgcacaatggccggaggaaattacctcagttcaagacggctgccaagttacggatagaaatggtaacattatctatcaaggcctatcagttagaatgggtattcattggggctgcccagttccagagcttgatttagtgactcaaagaatggactatttggggccgatggtcaataaggcagcaagggtccagggcgtcgctgacggtggtcagattgcaatgagtagtgatttttactctgaattcaacaagataatgaagtatcatgagcgagtagtgaagggcaaggaatctctcaaggaagtttatggtgaagaaattatcggagaggttcttgaaagagaaattgccatgctggaaagtattggttgggcattttttgactttggcgagcataagctaaagggactcgaaaccaaagaactcgttactattgcgtatcctaagattcttgcttccagacacgaatttgcatctgaagatgagcagtcaaaattaatcaatgaaacgatgttgtttcgtttaagagtcatttcaaacagactggaatctataatgtcagctttaagcggcggatttattgaactagactctcggacggagggaagttatattaaatttaaccctaaagttgaaaatggtattatgcaatcgatttctgagaaggatgcgttgttattttttgatcatgtaattactagaatcgaatccagtgtggcattattacatttacgacaacagaggtgttcaggactggaaatttgcagaaacgataaaacatctgctcgaagcaatattttcaatgttgttgacgaacttttacaaatggttaagaacgcaaaggatttatcaacttgagttctgttcgtaaattatgtaccaccctgttactcgtttcatattcacgctagagaagtacctcagcttactagatccattcacacattgcaagtatactaaaactatataaaatttaagtacgtaaactctttacttattattatcttcaatgtcatcacgtacttaattatgttaaatatagattgtgtataaataagaaataggatctgttttgaaaaattggccaaaaaggcagatttattaagcctatagagataaggttcttgccatttttcatacatttactgttttctcttgaatgactataatattgccaaaattgcctcgaatatgttgtttcatctcctctcatatttggctttctaagtcttttagttgtattggtgattgctccaattctgaatgattactatgctgctgactaggcgtaaccaatccaacttctccttcattaggatcaaccaagccctcaaaaaaggtgtctctaagctctctccatcttgttgtccatgtccccaaaaatattagtattaaagatgataaaatttgaagaaaaaaccaagaaaaagaaggaaatttccgagtatagaggaacaccacaataaaattgatggcatgtatagtgatagcaaaatcccatgcgagtttactccgtccaacgataacagttaagaaaaaaacacatattaatgaatccagaagccataacagtgagattgataaaccgtatgcgttcgtaaagtcgatattctcccaagaaaacagccattccttgatattgagatcatatcccgctagcttcgcccaacaataaaaaagaacgatcgctgtggtgtaataaaaaatctgtaaaagaacaatttgaagtccaatcttacttggagagagagaatcttgtttgaagatctgggaaggtttcaactcattcggcactcgcaaataccttcttatcgaaaccatgttacagtaattcaaatgcctattttttatctcacttctatgtgtacccttccttagccttcctaaagatcatctcttaacatgaagttacagaatattaccgtgaatatcgcgagctacgaatattttgggtggggagatatttattcatgattagccttgtcctatagtgttacaatggagcaaattgttcaccgttagtattttgaatacgacaatattaaatgaataatagcgcctatctcttgttacgtttggcgatttgtataccttgttaaataaactgattaaaagccgggttatggccgtacacaagttattagaaagcaaatacacttccttatatctggtcacctagttaataaaaggaagtctttaattttggcaaaaaccactatatatattagtcaacaactgaaatattaccagaatttgtctcctaaatgtcgttcagcggaaaaaaatttaggtctagaagacagcagctagtatatgaagcatctttagcggggcgatacaaaaaagcattgagtaagcacccctttcttttttttggtttaccattttgtgcaacaatagtattgggttcgttttggttgtcaagctttacagcgatcaagtacgagcaaggcgatcgtaaagttcaggaaattaatgaagaggatatcttgaaaataaggaagaatcaaagggaatttgatattaaagaagaatattatcgtttacaaggtctttctgaagaggattgggagcctgtgcgcgtcgctaggttaaaggatgaatctgagaatgtctggtaacattcaaaacgtgaacatctttgttattcttctgtccttaaactactaaacaaaaaaaactatgaccattgattgtgcaaagaaaagaccacgagaatgtctaggaaatgattgtaaatacctttattcattggaaaattcttatctataaaacttataaaaaattaaatactgaatttattgctctgcatcataaggtatatatcattcaaacgtgaactcagttagttacgttcatgttcaaagtttttaagacaaaaactcccattagtgcggtgaaaatatagcaagcaatagacagaggcttcttgaaaaaagagcttttcgggtagtcgtactttatcaagacttggccattggcaacttgactaatcaaatttctgtaactgaaagttaatttaacgtgacctttatttaggtcaaagtatgatttctgggtttctatagaaacatttgtaaaagggactggagaatcaatatcgaatatttcggccccttccggaagaaataccgataattcaacattatcatatacagtgtccggtgggccgtttagaattgggatagaagcaacgaatttctcgtctgagccagaggatacatgcaagaaatcggacaatttattagtccaaccgacagtaaaattgtagttccaacctccaaagattgggaatcttggtcttataaagaaatggtcacgttctgcatgcgacgtggaaacaaggccaaccaaatcagtgaaataatgatcagtagctccctcaggcaggagcatgtctaagacagtaacaaagtgagtttgtctcatattctgagtttgaatctgtttcattaattctaatcttgaaaatcctttagacagttttgcggctttgtttgttaattcataatattcctcaaattgtattgtggaagcccaatgagaaagccaaatatctcttctcaaattcactacctgattcaatggggcattgtgggaataaacaattgctaaggtttcgtttgaagaaaatctcggaatatcttcccaaggcccaaactcaaaagagtttccattagcttttcccagtaaactctcgtcatttggggggtggtactcctcaaatgatgagctaccaatcagcgtaaaagaggccttcttggtatcgtaagcagaaagcggcaatctgttcgtttcccacaataggtgttgttcttctgacattccaacgtgctcaggataaggaatacctacggtattatagaagctcttaatcactaaagaaacttcttcctgaggggaaattgcatttggaaattgaatgatcccgtatctaatttcactttcaccatcgtcaccaggtgctgtagtcgaattggcaagtaattggctatttaaaaaagttgcctcgttggtaaaataggctgaaaaaaaggaaactttactgaagatgccactctcaaaggctgtgaagtattcagtcgcaggttcgcttgctatgtttttgatagttatttcgattgtttctgaaatataagcgtttgacacgtctattgtcctcttataatcaacattctcccaagtcgcaggtggctcgtattgggcagcagaagacacgttgaaaaaacataggaacaatcccacaatccaagagaaccaaacctgcctcattttttcagcaccaatattttgtagtttgcgtcttgttccgagctaaagaagcaatcgggtacttgtcaaagaagtagcttgcttaataaaaagcaaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctcttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgagacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaatagtatggccgtgacatttaaggatggtgtgatactaggtgctgattcacgtaccaccactggtgcgtacatagctaaccgtgtgacagataaattaacgagagtacatgacaaaatttggtgttgtaggtccggttctgcagcagacacgcaggcgattgccgacattgttcagtaccatttggaattatatacttctcaatatggtaccccctccacagagactgctgcctcggtgttcaaagaattatgttacgaaaataaagataaccttactgctggtataattgtggctggttatgatgacaaaaacaaaggggaagtatatactattccattgggtggctccgtccataagctgccttatgcgatagcaggatctggctctactttcatatatgggtattgtgataaaaactttagagaaaatatgtcaaaggaagaaaccgtagatttcataaagcattcgctatcgcaagccattaaatgggacggatcttccggtggtgttataagaatggttgttttgacagctgctggtgtggaacgtttgatattctaccctgatgaatatgaacaactataatagaccccaaaagaacaaattctgagtgattacttctctttatatttgttaacaaatgcctctggatctacactgatataacatataatagtctataacctctttctctttttctcttcgctttacgcttttttctctaactgttagaacgacaaagtatctcagaagggaatttcgtaagcaagatattttacgactaatcatttttttgttgtataaaaacgtatgtgagattgattcactaattcttcggagtcctggaaggcttaccttatctatgcattcgtacagttgtgtgcaatgttaaaaatggtgactgtatctacgtatctataaaaaaaggttaactaccggaaaatcatttcttctcgtaaagtgtatatttaggttcggaaatcataaacattgtttttttgtgttttttatttttaaataaaaagaataaatattttatattaaaaaataaattttaaagtaaattaattatttaacacgtgattaagttactctaatataatcctatttaataattagtagagttgttgagaacgagtataatattattttttttttatttttttgtaggttctttggccatcctaaatagaataagcatccacaacaactaaactggtattttgttatacacaacgcgtcttggttaggcatctgttttgttttagctattgttcatcgcgtttttttttttcttatctcttttaccgaggggcgaaaatagcgatagatcgagaatataaataaataaaatattgttgtgttgtgtagttctaaagaaaaattttacagtgaaaaggtaacaccggggagtcattacgtagacttacgtattctgtataactgattccgagacgcaaatgcctgagcaagaaccattgagtcccaatggccgtaagcgctctgaggttcactatatctcaatcccattgaacagaggttccgcattctcaccagatgattctgtatcacagtttcagtctgacgggttcatgacacgtaggcaatccatattggaccatcctgtgggctcatttaagggagttaattctttaagtcgatttgcgacttcgttgaggagagccaattcgtttcgtaatatcgagctaaatgcggataatgaaagatcctttttcaaagagagtaacgatgaaacctacgatccggatactttagcaccagctttggacggtagaagattatcagtaactttaaataatgctggtcgcccgcgcattactaatttggctaacaacgatagagttagtacagccagcatggctattcacgatgatgattatgggtccatccaaaattcaacaattggggattctgggtcaatattacgccctactgcctccttaacagaaatgatgagtggtggagcggggagaaggtttacaaataatgacatggattcaattgtagtgaagagagtggagggtgtagatggtaaggtagtaactcttcttgctggtcagtcgaccgctccacagaccatattcaactcaatcaatgtactgattggtattgggctcctggcgttacctcttggtttgaaatacgccggctgggttataggacttactatgcttgcaatcttcgccttagcgacattttgtactgctgaacttttgtctaggtgcctagatacagatccaactttgatatcttacgcggacttgggatatgcagcatttggtacaaaagggcgcgcactaatttctgctcttttcacacttgacctactgggtagtggggtgtccttggtgattctcttcggagattctttaaatgctctatttcctcaatactccaccacttttttcaaaatagtttcattttttatcgttacacccccggtttttataccattgagtgttctatctaatatctcgcttctgggaatcctttcaacaaccggaactgtgctagtcatttgctgctgcggactatacaagtcgtcttctccaggttcattagttaatccgatggaaacgagcatgtggccgatagatctaaagcatctctgtttatctataggtttattgagtgcctgctggggaggacatgcggtttttcccaacttaaagacagatatgaggcatccagataaatttaaagactgtttgaaaactacctataagataacatcggttacggacataggtactgcagttattggctttttgatgtttggaaatcttgttaaagatgaaattactaagaacgttttgctgacggagggatatccaaaattcgtttatggtctgatttcagcgcttatgactatcattcctatcgcaaagaccccattgaacgcaagacctatcgtttctgtattggacgttctgatgaatgtgcaacacatagatgaagcggccagcgccataaaaagaagagctgcgaaaggccttcaagtattcaataggatctttattaatgttgtcttcgttttgatagctattaatttccctgaatttgataagattatcgcatttctgggggccggtttgtgttttacaatttgcctaattttgccgtgttggttctatttaagattgtgcaagacaacaatcaaaccatgggagagagtggcttgtcacgtaaccatatgtattagtgtcgtgttgtccacattaggtgttggtgctgcaattatttcataatcgacgaggggcatacttactctacttaaattcatttacattagctctgtacttctgataatgaaaaaccattgcgtaatatacatattttcgtgtagaattatttccataaaatattcaccgccttttctgtactggccgccggcatgcgagggaagcagaaaattttcaattttgcgatgagctcttgaagaaacagtgttttgttatgaataaatgatgtgtgcacgaaagacccaaggaaagtcgtataatgtcagaactctttggagtattgaaatctaatgctggcagaattattttgaaggacccctccgccacttctaaagatgttaaagcatatatagattcagttatcaatacctgtaagaatgggagtattacaaagaaagcagaactggacgaaatcactgttgatggtttagacgccaatcaagtttggtggcaggtcaaactagttcttgatagtattgatggtgatctaattcaaggaattcaagaactcaaagatgttgtcacgccttctcacaatctctctgatggtagcaccctgaactcatcatccggggaagaaagtgaactagaggaggcagaaagtgtttttaaagaaaagcagatgctctctgctgatgtttctgagattgaggagcagagtaatgatagtctttccgagaacgatgaagaacctagtatggatgacgaaaaaaccagtgcagaggcagctagagaagaatttgcggaggaaaaaagaatttcttctgggcaagatgaaaggcattcttcacccgatccttatggtatcaatgataagtttttcgatctcgaaaagttcaatagggatactttagctgcagaagattctaacgaagcttctgaggggagtgaggatgaagatatagattattttcaagatatgccttcagatgacgaggaggaggaggctatttattatgaagacttttttgacaaacccacaaaagaacctgtgaagaagcactctgacgtaaaagatccaaaagaagatgaagaattggatgaagaagagcatgattctgccatggataaagtgaaattagacttatttgcggatgaggaagatgaaccgaatgctgagggagtgggagaagccagtgacaagaacttatctagtttcgaaaagcaacaaatagagattagaaaacagatagaacaattggaaaacgaagcggttgccgagaagaaatggtctttgaagggtgaagtaaaggcaaaggatcgtcccgaagatgcattgctcactgaggaacttgaattcgacagaactgcaaagcctgttcctgttataacaagtgaggtcacagaatcattagaagatatgattagacgaaggatacaggacagtaactttgacgaccttcaaagaagaaccctgttagacatcacacgtaagtctcaacggcctcaatttgaattgagtgatgttaaatcctcgaagtcgttagcagaaatatatgaggatgactacacacgcgctgaagatgaatctgcattaagtgaagagcttcaaaaggcacattccgaaatatcagaactttatgctaacttggtatataaattggatgtgctttcatcagtgcacttcgttcctaagccagcaagtacttctttggaaattagagttgaaacacccactatatcgatggaggatgctcaacctctctatatgtcgaatgcctcttctttggctcctcaagagatatacaatgtcggtaaagcagaaaaggacggagaaattcgcttgaagaatggtgttgcaatgtctaaggaagaattaaccagagaagataaaaacagattgcgcagggctttgaaaagaaaaagatcgaaagctaatttgccaaatgtaaacaaaagatctaaaaggaatgatgttgttgacactttgtcaaaagccaagaatattactgttatcaatcaaaagggtgaaaagaaagatgtttccggtaaaacgaagaagagcagatcagggccagatagcacaaatataaaactttgaacacgccgaagaagacttagtttgtatttaggtaaaaaattatttcttcataactctgttcacccagcattttttatggaatatcgaccttgtaatgtcattaaccccttaaaggaccacttaaagaaaatgaagtgcatcatgaaatattcatgacgagatgcggaacatatacactcataaataccagaagaatgtgctgaataattttttgttggtaattggctgtcatttaaagtatcgttgaaacaagaggtattggaagatagctaattttagtattatttatgacgttctttcctggataaatgtagatgtatatacgtaataaaatgttaattagtaagttatatgctttccatataatgttctatcttagtctgcataacttgtttgcttgtttttgtttctaacgcttctccatactgggctaagagattttttattttttttgcagcagtcggccctgatatcagcttttctcctagtgcgccatcaaagatgaccctggcaaaatcagcatcatctctggataagaatgctaaaatgagcgattcagttaatacgtcactttcagcaagatctgtgtacttatctttctctcgtttagcagtagatatattagaattgtaaattttgagagatagatcaatatttgctttcgcgttagcaacaattaacacactttgaattttactctctagtttggaatcaaagtcttctttaataaaagcttcagcgtattgtagcattttttcattactgcttttataaccctggcagcagagcgttaaaaacgcttcaaacattaagtcgtcctcattatttttgaattttaagagatattcgtcgtataatttaaaaaatagagaaactttacctttgaaagcgccaattaatcttaacagcttgtgagctaattcgaaatccttcttgtctatgtttcttttttggatctctaaaaataattcttcgaatgaagttgcagttttgcgtacactccaattcggaaattcgaggctccaattatcatgacattgtgatttaacaatatctatttcttcctccaacttgctaataatttctttttcttcttcagtttgctgaattttctcgttttcgcccagaacagttagacacttgtgtagtactaatggatcagctactatattatcaagcgaataaaaatcataaagttcacaaatttggtattgtgtcatttcactgacatacttatcaaaaaagctcagcggtattttatatttgagtacagaacctaaaacattgggaattccgttgtccactatgtaaataaggataggttccacgagctctgaaggcaaattataatttgaagaaaaatggttgattaaataaagacatctaacgaggtcttgataagtcagactcttttttccatcaaccttttctgccttgtcaaacttgataattttttctaagaccacttccatcagttcatcaggaacattttccattgaggccttgtattgtgtaaaaagttcccaagagctttgtactcttcctggattattcctaataatttgtttgatggcgggaagtgaaggttttaaatcaagatcacgcaaattatttgagtgaattgttgcaacgccgtagtcaagatcacttaagttttctatcatcatattgtgtaccatggccgcatcctttttaggaacctctaatttgtttaaactttcgataacattctgcgatagagagtatgggtcaatggtggttatatcttcaggcaaatgatgacgaattggatcgaaagaagggtgacgtagaagctttttgattatgttctttctatttgaatgagatatgagagagtaaaacctcttgttagataacgtagccgcagaatgaagagagcgtaacattattgaatggcggttagctgttaagcatttgaaaaagtagctctcatcgaactctttcatggtgatgaaattttttcatctacttacttaatcagtggtctactgaaacagccttcgggtaatgaaacgagcggtaacgctcacaaatttttctttttacgaacaaaatataaatttaatactatgataaaatctgcggtgagacggaaaaggataagaactagaaaagtattattagagttaagatatgaactgtccatttaactatggttgaagaaaaaaagagccaggatgaaaattatgaacaataatttcgtatatttcgactcaatgtactaactgtacagtacccgttttagaatagcaggtacgacaaaagcagaaaaatgatcgaaccgagctcagctgagaaaaatatagacgctttaccttcataggttgaaatcatgagagaagttgatgtgaaattctgttggataccggacaattggcttcctgatgcagaagaaggatatgcgatcaaggatgacactaaaaaggtgtcaattttcgttccctgagatgagactgctgtttcactaaaagaattaaggccaactgaagatgttgtcaaagccgtgtgctcaaagtaacccgtatttttcgttttgatatatgtattagatgttggcacagaaggcgtaaaactggtgcttagtaatgttttgcttacggagagggacgatacgagtggggaagacgtataagatgagggactggatggctgtttgctgctgcagaaggaatttaaggagtttctcgtggcatttacaaaagtgggctcttcagatggaacagcagcagtattcgtgatattttcagtgtgcacattgacaattgaagcatctgaggtttcaaatactgctgatgaagagattattggtgtgctgttgattgttgcgaaagaagaggatgtaaattgcgagatgtaagtattcatagcgcctgtccatccagttgttgaggttggagcggctacaacggtcgaagctgtttctctgctaatggtttccacatcactaatcacttctgatgtggtgtgaatatctgttcctactgtgatatttgagtcagtagaatagatactggtttgtgcaattgtcaggctggtagtagcagttggagacagttttgtgctggtagtcaccacatggctgatcacttctgatgtagttcgattgcctgtttctactgtggaaatggatccagtggaatacgcactagtgtttatacttgttaaatcagtagtagtggttgagataaaagagcttttggcgctagctgtaccgaggttccgaccctgataaacaataaattccctagtagtcgagaattgcgtagcgtacgtagtatttgctatggtatcaaggcatgtgtattgaaattctaacgcatgatctattgtgtttacattagcgggtagagattgtaatgcattaacccataacatttccccatcatatagtttttcgtcaagtgtaatccacagattactaccaaaacaagtgacgtcagcattggtatcattgtaactttgcgggaaccaccaatcattaaaatcattggatgaataaacctgaactgaagaacaatccaaatcgacattgttattggaactgtcgtaatcaatcttctcagtaccacccaggaaatatccgtttggacaatacatacccaaatgataactttcaaaagaaccgtaaccagttgaacgcccagagtgaaaaacattctctgtaaaagcagcaggatcgaaattcaccacatctgacatttgattaccaagtttaacaagcattggcccagatttgaaaaacttagcgttttctaactcatattcatagctggaaccaccatcactaaaatttagcgaaaatgttatggatccatcaatcgtattataggaggacaggtcattttgagcagtacatgtgaaagtagtattttcatacaagtatgcagcctgttgcgaaacatagcatttgaaagcctcagtaccatccgctaaggaaatagtagctgtttgcgatgagtttaatagcttaatcctataaacatgtggcattgataatgtgaattcatcgccctccctaatggaagacgcatctgcaatactaaaatcaaaagtggcagtccaaccttgatcaggttgtttatttgcagtcagtggagtaatttctaaattggaaaatgtgatatcgttgatatttatagcagaggccaatgccaaggaaaaaagccacagaataattttgagaaaagtgaacattttgaaaactggcgaattgttgttccttttgtgctgactatattaagcgaggcgactgatataaggaagatatgagaatggacgattactagaataaatagagggcatttcgcatatttatagtatgctaaaaggaatctttttttgattcacatggctttttttttagaagattgcatttcgttacatgatcaaacaattccattgtaacgtttttgggaatatttaagcgccgttactgaagaatgaagtgacataaagctgccattgtatggtaaaacaccaaaggcgagtacccttagcatttccttatcgagctggagcggcttctaccttcctaattaggtcatcaatgacctgcaaaacaaagcgaaatggacaaaggacctacacttgcctcgtggcgggaaactgcatgtagttgttcaatgtttcaccactcagtgttgaaactgtttactccattgaattgaggtgacgatggataaactttctttattttttatatttttttataatttaattaacctaaattgagcctaacagaggaatttgaaacaacacaatagaaaacatgagtttcaaaagctaaatatggtattactattcatagtggtcttggtaatgaataatgcatatgtatactcttcttaacgccttatcttatgtaaccatacacttttttagtaaggtttcaattaagctactattctcaattaaatactgctctgagctagataaggcctattgaagttggaggattagatggatagaaataaggaactaaatcgtcaagttcgaaagcctattcccattcatgcatatcacttacctttccttaatcatgatctctttagtgccatcagaactattttcttaacatcgcgattctgtcttccgggtatcgctccaaaaatgtgcgaggaaataggagatcgttcaaatcatcaacttttagtattgggtatcaaagtatcgcagcctggaaacagaattaatctactgcacaagaagggaatacagcaagaacattcacttcattaataggacgtatttcgcttatgtccgatcaaaaagtttttgccagatataaagcaaatgaaatcgtcacagatctgcaacattttggagtaaaaaagtttaaatcgaatataacaagaaggaaaaatgctctgagaaaaattatcgccaatttggttctaggaaactatggcgaaatgtccgttctgttttctgagctcttgaaattttggcaaattgaagatgatctagaagtgaaaagaatttgccatgagtatattagggtgatcggcgcattaaaacctcagcaggccagagaggctttgccatttataatggacgatttcaaaagcagagatgaaaagttacaaataatggcactaagaactctggtattagtcccggtgaaagagctatctgatcaggccttcgactgtatcatttcattggtaaatcacaagtctccacctgaacaagtgacgaggacagcaatttacgcactgttggatttagatgaaattgatcatgaaagggtattggggttatcaagcattctacatgacattgtaaaagcacagtcgagctctccagaagtcattgtagctgcattacatactttatattccattcacgaaaaaaacgctaacatggaacccttcaggattcccttggaactcgcttttgacatgctagagcttttacccgaattaaatgagtggaataaggctactgttttggaagttttgacgacttcggttgtgccgcagcattatttggatacccatgaaatgatcgaactagctttaccgtacctgcaacaagtaaacacatacgtagtgttgaactctttaaaattcatcatgtacttgttgaattatgttgacgtcatcaaagaaactctagccgaaaagctatctaactctgtaatagctttgttagataagccgcctgaattacaatttttagtattaagaaacgttattcttcttttattgagtagggagtcatctctactcaggctagacatttcgtattttttcatcgagtacaatgaccccatatacatcaaagacacgaaattagagtgtttatatcttttagctaacaaggaaacattaccaagaattctagaagagttggaacaatatgctacagatattgatattcaaatgtcaaggaaatcagtcagagccattggtaatctggctgttaagctagatgaagactctgtacacgattgtgtcgctgttctactagatttgttagaattcggtgttgattatgtcgtccaggagattatttcggttttcagaaatattttgaggaaatatcccaataattttaaagcaaacgtaacagaactagtcaaacacactgaagttgtacaggaacctgaatcaaaaaacgctatgatctggataataacgcaatattcggatgtaattccaaactacctggagttatttagagttttttcctcaaacatgtttagtgagacgctagaagtgcaattttccattctgaactcagcaataaaattcttcatcagaagtcctacaaaggaaactgaagaactttgtatggatttattaaaaggatgcatcgatcacgaaaataatcctgacttaagagataaaacactgatgtattggagattgctgtcattaacgaaaacgtctcgtatatcaaacgcgataacttttgaatctttaaaatcagtactggacggagagttgccactaatagaaatgaacacgaaattagatcccaccgttttggaggaattggagctaaacattggtacaatagtatcgatttacttaaaacctgtttctcatatctttagattgaataaaaccaaactgctaccacaaagtcctattttgaatccaaacaaagacctcttgccagttgtaggtaactcatttcctccaactggagctaatagggaccgtcaaaattcagaaagccagtcctcgacgaagtccagaaagactgctatgatggatgattatgataagcccgctgaaaaaattaatcagttgaaaggtaagcgtaaatctagttcaaacaacccctcaaaactatcacggaaaccctcaactttattaagaaaactctctatgaaacggcccttttcgtgactgcaaatgatactaattcctgtatttaaatatactcatatttaacgaacaattatgatgaatgaaaaaacctgatataatagacttaactaagcgatcataaaaaaattcaaaaagttattttataaaacaattcagatgttaaactaaagagttaatgtaatatatatacaatgaactgcgtcataaattcccatagttcagctcatgggacattatctacttataaagacgtggcttggcagcatttcatatataaggctactgaatgtaaatttttcttccattgtctttcccgtgtcccgagaactcaattcaagcactgttcttgggcgtaataaaccttccggtactactaaaatcagacaaaggcaggaagcctcgatttgaccttttaacgggtaaagctctaaaagttgctctctgctccatattctcgttttccgtcatttcagtatctttttcccctgcctcccttacctaaagcttcctcttcggcggctagtaattggtctctttcctttttggctcttagcttctctgtctttttttgttccataatcagcttcttctggttaggggttctcgcaccttcttcccacctctgagcttcttgagcttctagttgttgtttctctagttggtccttttcgtaagcttgcctacgttttcttgctcttcctgctgccacttttttggcagtttctgagtatctcttgccagtattatgcatgttcgcttcttcactatgtttggtggtttctaatgacaactatgcggttagcaaacttccaaaaggcggttaataatacgactacacattatcctatatatatatatatatgtacgcaagtgcttagattggaaaaaagggtgcaacattctcgattgttctatttcagcctgttgatatcaatctgtcgttcaatgctttgtgggtgtgctttacccactcttatacagtagttaagtggcaaaaagggtgtcaaagggaaaggaaaaccagaggaaaagcaaaatagccgccaatactaactctagatttatatcatgttatacgattaatcagacgcgtctgattaatttcaaaagttaaaatataaactatttttgaaatcccattgcaataagcgaactatagctgaatctttcctgcaaaaatggaagtgaagggcaatggacgcattgttaacaaagttcaacgaggatagaagtctccaagatgaaaacttgtcccaaccacgaacgagagtaagaattgttgacgacaatctttacaacaaatcgaatccattccaactatgctataaaaaacgtgactacggttctcagtactaccacatttatcaataccgtctaaagactttcagagaacgcgtcttaaaagaatgtgacaagagatgggatgcgggctttaccttgaatggccaattagttctaaaaaaggacaaagtgttagatattcagggaaaccaaccatgttggtgcgtaggatccatatattgcgagatgaaatataaaccaaacgtactggacgaagtgatcaatgatacatatggtgcaccagatttaactaaaagttatactgataaagagggtggttctgatgaaattatgctcgaagatgaaagtgggagagtgcttctagtgggagattttattcggtctacacccttcatcacgggtgttgttgtaggtatactgggtatggaagctgaagccgggacatttcaagttttagacatatgctaccccactcctttaccacaaaatcctttccctgcaccaattgctacctgccccaccaggggaaaaattgctcttgtttctgggttaaacctcaataatacatcacctgataggctattgagattggagattttgagagaatttttgatggggagaatcaataacaaaattgacgacatttctctaattggtagattactgatatgcggcaactctgttgacttcgacattaaaagcgtgaacaaagacgaattgatgatttctctaactgagttcagtaaatttctacacaacattttgccatctatatctgttgatattatgcccggaaccaatgatccaagtgacaaatctctaccgcaacagcctttccacaaatcattgtttgataagtccctagaatcatacttcaacggttctaacaaagaaattttgaatttagtgaccaacccatatgagtttagctataatggcgtagacgttctagccgtttcaggcaaaaatatcaatgatatttgtaaatacgtaataccatcaaatgataacggagaaagtgaaaacaaggtcgaggagggcgagagtaatgatttcaaagacgatatagagcatcgcctggaccttatggaatgtacaatgaaatggcaaaacatcgcgcccaccgcacctgataccttatggtgttatccgtacactgataaggatccatttgtattggataagtggccccacgtttacattgtggcaaaccagccatattttggaacaagagtagtggaaataggtggtaagaacataaagataatatctgtccctgaattcagttctactgggatgataatattactggatttggaaacgttagaagcagagacggtcaagattgacatttaaataaaacaaggaataatttccacatagatatgcaattaagttttatatgtaaaagtgagcattcatcgttcagctcaaaatacgtttcttgtcacagctggtagaaaaactatgagcgttttttcttacccgcagtcggagaaaaattttttcttcgaagaggcgaaaaagagaagaagagaaagcacaaatctgatgaaatagtagtataaaatcgcatttacaaattttcaaccattgtttatttcctaggtcattaaagagtaaagtgcaatctgtttactaatcagtttttgtcttcatatttttgtgtcttttctgctgcctcacgcaccttctataatacaccaaataatgtccacttctcattgcagattttatgaaaacaaatacccagaaattgacgatatcgtcatggttaacgtccagcagattgctgaaatgggtgcttatgttaaattgttagaatatgacaacattgaaggtatgattctactaagtgaattgtcccgtagacgtattaggtcaatccaaaaattaattcgtgttggtaaaaatgatgtcgccgttgttcttcgtgtcgacaaagaaaaaggttatattgatttgtccaaacgtcgtgtttcttctgaagatatcattaaatgtgaagaaaaataccaaaaatctaagactgttcattccattttaagatactgtgccgaaaaattccaaatccctttggaagaactatataagaccattgcttggccattaagtcgaaaatttggtcacgcttacgaagctttcaaactatccatcattgacgaaactgtttgggaaggtattgaaccgccatcaaaagatgttttagatgaattaaagaactatatctccaagagattaacaccacaagctgtaaagattagagccgatgttgaagtgtcttgttttagttacgaaggtatcgatgccattaaagacgcattaaaatcagctgaagacatgtccacagaacaaatgcaagttaaagttaaattagtcgccgccccattatatgttttgaccacccaagccttggataagcaaaaaggtattgaacaactggaaagcgctattgaaaaaattacagaggttattacaaaatacggcggtgtttgcaacattaccatgccaccaaaggctgtcactgctactgaagacgctgagttacaagctctattagaaagcaaagaattagataatagatctgactctgaagacgatgaggatgagtcagacgacgagtaatcattgccgcgcctaatttttctaggtgttttcaagtgtcatactgttttagaaaattttgtatagaacaaatacgtatatcctgccatatcatattctttgcaatatacaccttgtacatttggctattataaatattacaatccatttaatcataatcaaaatttaatttctgttaccacggggttgtcagtggagcatgccctgccggttctctataatttatctttttcacatgagatatttttacctcaaaaggtagtgatgctgtaataatatgaggctcccccctttccttcggaattgcatttaaatcattggggaacactaagacaagacaaaggggccgtccactcatgtgattttcaacaaaacagataacatgcggatacacactgatatattttcaaaggaaagtctgactgatacttaagtgaagtggtcctagtcggtggcttaggtggactacagtgcaaagaatagaatttttcaaacatgtcaatacgtccagcaacacatgcaggctcatggtattccaatagagcccaagaattatctcaacaactgcatacatacttgatcaaaagtacccttaaaggcccaattcacaacgccagaattatcatatgtcctcatgccggttacaggtattgtggacccactatggcctactcgtacgcatcgttggatttgaaccgtaatgttaagagaatatttatcttggggccgtcgcatcacatctatttcaaaaaccaaatattagttagtgcattcagtgagctagagacgcccttgggtaatctgaaagtggatacagacttgtgtaaaacattaatacagaaggagtatcctgagaacggaaagaagctgtttaagccaatggatcatgacactgatatggctgaacattccttagagatgcagctccccatgttggtggaaactttgaaatggagagaaatttctttagatacggtgaaggtatttcctatgatggtttctcataacagcgttgatgttgatcgttgcattggtaatatcttgtcggagtacattaaggatccgaacaatttattcattgtaagcagtgatttctgtcattggggccgcagattccaatatactgggtacgtcggaagcaaggaagagttgaatgatgccattcaagaggaaacagaagtggaaatgttaactgctaggagtaaactttcacatcatcaagttcccatttggcaatccattgaaataatggacagatatgcgatgaaaacgctaagtgatactccaaatggtgaaaggtacgatgcttggaaacaatacttggaaatcaccggaaacaccatatgcggcgaaaagccaattagtgtgatactaagtgctttatcgaaaatccgtgatgccggtccttcaggcatcaaatttcagtggcctaattattcacagagttctcatgtgacaagtattgatgatagtagtgtcagttatgcttcaggttatgttactataggataatgatcacggctaaaacggtcgaatgtaagcatatatctttcgattgtataattgttcccaaatactacagcatctcaaggaaaaaaaaacaaaaacttccaaaaaaatcgaatccctgaggaatctttaatacattttcaatctatttaagttttataaacgtgtatatgagatgtcatgagcatgaattattaataataaaaactaaatcattaaagtaacttaaggagttaaatttaagccttggcaacgtgttcaaccaagtcgacaactctggtagagtaaccgtattcgttgtcgtaccaggaaaccaacttgacgaactttggagacaattggataccagcggcagcatcgaagatggaagagttagagtcacccaagaagtcagaggagacaacagcgtcttcagtgtaacccaagacacccttcaacttaccttcagcggcagccttgacaaccttcttgatttcatcgtaggtggtttccttgttcaacttgacagtcaagtcaacaacggaaacatcgacggttgggactctgaaagccataccggtcaacttaccttgcaattctggcaagaccttaccgacagccttagcagcaccggtagaggatgggatgatgttaccggaagcggttctaccacctctccagtccttgtgggatggaccgtcaacagtcttttgggtggcggtcatggagtgaacagtggtcatcaaaccttcttcaataccgaaagcatcgttgataaccttggccaatggagccaaacagttggtggtacaagaagcgttggaaacaatcttcaagtcagaagtgtatttttcttcgttaacacccatgacgaacattggggcggtggaagatggagcagtgatgacaaccttcttggcaccagcgtcaatgtgcttttgagcagtgtccaattccttgaaaacaccagtggagtcaatggcgatgtcaatgtttagagaagcccatggcaagttagctgggtctctttcttggaaagtggcgatcttgtgaccatcaacgatgatgtgcttgtcatcgtgggaaacttcaccagcgtatctaccgtgagtagagtcgtacttgaacatgtaagcggagtagtcgttagagatgaaaggatcgttcaaagcaacaacttcgacgttctttctttgcaaagcaattctcataaccaatctaccgattctaccgaaaccgttaatagcaactctaaccattttgttttgtttgtttgtgtgatgaatttaatttgaaactaagttcttggtttttttaacatttaaacaaacaataataaaatgaatagacacacaagaaaaaaactatcttgaatgagtgcaacctttatatattcttccaaacctacaaaaaaattgcaggtctgcgatcactgggtactatcaaaacacatattagcatacgtatgtgttcgtacgtgcggtccgcaaggtctttgtgacagccatgacatgattggattgaatagttcacttcagctgtcaccaccagttttaggccctaacacatcagtcgagttccactaggctttgttagccgtagctgcgttgcaacaactgcgcaaaacgcgcgacttcctgtaaatgccgcagatcacgtggtaaagaaaagaaacaacaggccgacccagtttcgttgtttcttttcattatttctggatgctcttcacaacgtatttcatgacatacttattgaattagtggaagcccaaaacatcattaccctggaaaacttaattgacgtaaattaacttcagttgtcttatgttttttgcatccttaactttagccgcgcagggataatcatatatgtcgaaagagcaactaaacaatacttaaaaacgtgtttgaacttttacgaaagggtaacgacaaataatcattcactggaaaaaccaataaaccataagtaaatgaaaaactgtttcaaccgatgttggtactttccatgtcttaaaagagtacaatttataaattaatgaaaacacagaagtatttagatcggctcaaatgtttttggacattaaaagatcttgaaactgagtaagatgctcagaatacccgtcaagataagagtataatgtagagtaatataccaagtattcagcatattctcctcttcttttgtataaatcacggaagggatgatttataagaaaaatgaatactattacacttcatttaccaccctctgatctagattttccaacgatatgtacgtagtggtataaggtgagggggtccacagatataacatcgtttaatttagtactaacagagacttttgtcacaactacatataagtgtacaaatatagtacagatatgacacacttgtagcgccaacgcgcatcctacggattgctgacagaaaaaaaggtcacgtgaccagaaaagtcacgtgtaattttgtaactcaccgcattctagcggtccctgtcgtgcacactgcactcaacaccataaaccttagcaacctccaaaggaaatcaccgtataacaaagccacagttttacaacttagtctcttatgaagttacttaccaatgagaaatagaggctctttctcgagaaatatgaatatggatatatatatatatatatatatatatatatatatatatgtaaacttggttcttttttagcttgtgatctctagcttgggtctctctctgtcgtaacagttgtgatatcgtttcttaacaattgaaaaggaactaagaaagtataataataacaagaataaagtataattaacatgcctgctcctcacggtggtattctacaagacttgattgctagagatgcgttaaagaagaatgaattgttatctgaagcgcaatcttcggacattttagtatggaacttgactcctagacaactatgtgatattgaattgattctaaatggtgggttttctcctctgactgggtttttgaacgaaaacgattactcctctgttgttacagattcgagattagcagacggcacattgtggaccatccctattacattagatgttgatgaagcatttgctaaccaaattaaaccagacacaagaattgcccttttccaagatgatgaaattcctattgctatacttactgtccaggatgtttacaagccaaacaaaactatcgaagccgaaaaagtcttcagaggtgacccagaacatccagccattagctatttatttaacgttgccggtgattattacgtcggcggttctttagaagcgattcaattacctcaacattatgactatccaggtttgcgtaagacacctgcccaactaagacttgaattccaatcaagacaatgggaccgtgtcgtagctttccaaactcgtaatccaatgcatagagcccacagggagttgactgtgagagccgccagagaagctaatgctaaggtgctgatccatccagttgttggactaaccaaaccaggtgatatagaccatcacactcgtgttcgtgtctaccaggaaattattaagcgttatcctaatggtattgctttcttatccctgttgccattagcaatgagaatgagtggtgatagagaagccgtatggcatgctattattagaaagaattatggtgcctcccacttcattgttggtagagaccatgcgggcccaggtaagaactccaagggtgttgatttctacggtccatacgatgctcaagaattggtcgaatcctacaagcatgaactggacattgaagttgttccattcagaatggtcacttatttgccagacgaagaccgttatgctccaattgatcaaattgacaccacaaagacgagaaccttgaacatttcaggtacagagttgagacgccgtttaagagttggtggtgagattcctgaatggttctcatatcctgaagtggttaaaatcctaagagaatccaacccaccaagaccaaaacaaggtttttcaattgttttaggtaattcattaaccgtttctcgtgagcaattatccattgctttgttgtcaacattcttgcaattcggtggtggcaggtattacaagatctttgaacacaataataagacagagttactatctttgattcaagatttcattggttctggtagtggactaattattccaaatcaatgggaagatgacaaggactctgttgttggcaagcaaaacgtttacttattagatacctcaagctcagccgatattcagctagagtcagcggatgaacctatttcacatattgtacaaaaagttgtcctattcttggaagacaatggcttttttgtattttaatcgtcataaaatgctcccatctcaaaagtagggcaaaattcatgatcgaccgcgcaaaataaatagatttgcaaataagttttgtatgtacatttattaatatatataatatatcaaaagaaaaaaatcaaaaaaaaaaaaaaaaaaaaattgcactcttattcagtcatcaattacaaaacctagagatagcgatggtgcatattcaataaaaaactccttatactgtcgagaaagcttattattggtacttctcgaagatactaaaaaaggttaatttttggagacggaggcaatagcgactagtcatactggtcgacattaatttcaatttttggctgtgcccacctcaatttttgtttattataccatgggtaagctggcaaaacacatattaaagtaatcacacaactaatgccatacgcagtcagtaaaactttcagggactgttgtgcaaatcccaatatacacgctaccaaagctccgatcatgagcgatagctgttgaaatttttctgttttccgttggctgggaaaatctattggaaaaaccagtttcctttgtacatcttgtaatatctcagacattgaagttgactatgacgtgacgttgatcttgtttgagtattgcttgaccaatcctggagtaacttcgtttaatctgcctcgtttttttctctaaatagtttctattatccctcctccacgcgagatgtatttaaaatgtgaaaagtgtacacatggcgttcatcttacgtagatgagagaaacgctaagaagccaaccaaactagtataatctatacatttatagatgtttgtgtagaaccttatttttatactcttgtattatattacattacttgcattaaaccgtcatttcaccaataatttggtcctttagccaattaacatatctgatgaatggttcacccttgctaacatcaataacactatcgttcgtagcttttctatatatattaatcaggcccttatccttagagagctcgttaaatagtttacaattcaaaagatctaactgaaacttccaaatgggtaacaattcattctgtaacacattaactaagatcttcatctgtaaatcgttcatctgtgactgttgtttactcatagggatcttgttcaaaaatttgtagagattaacgaatcctgataaacaattttgcatttgtaatataaattcatctttaaaatcgacatttaatctgtttaattcctggaaaatatacctgttcactccataaatggaggtgactagaaccttctcgatcaaatgccggcattttccaggagtttcaaagtgatctaactcacaactatccaataataagcggaatcctgtccttaaatcgtaaattagttcacaaatatcactctttagtgcaaggagttcttttttgtgtgaaataaatgtgccagaatggtttaatacttcgtcttcctgcttttgagccagataatacaagacatacattagatccgtcatataatgtgaagtattcagaataaacggcactatttgattcagcagtataacatttttcttgttgttttcggatattccgtcattgagcaaaagtttggtttgtaaagacgaaactgtactttcattagattctcgtgtttcactcatacgcctttatatgctatcacagttaccttatttgtcctttttcttgtagagctattctctattctgctttgacttaactagcgtgaaattaaaaccaacgccgcttatctaatcacaataaaagatcagactgtgaaattaataaaaaggaaaggataaaacgacagatatcgcactaactttgttagaaacattatgcagacaaaagaaggagatgcatgtgcctttgtattcttttaaacgcaaaaagggcaggtctatgattaagtatgaatgagcgatataaaatttaagtagaaaagggaagataatagtactatatataaatatataaatgcatttttttacatacctgttgggtgaataatttacctagctgttggatttgctgttactgtattattgtcgtcatcattgccatcgcctttattgttatcattgttattgtcatcattatcgttgtcactgtcattaatctgtaacttagactgtatatcgtaacattcagacagccttgttaatgaggtcatgccttctaggctttcttgatcaatgtccagagatatattgggtttgtctaatgatccttgatgagattgatgctgcagctgaccttcccaaggcctaggtcttggcctcaatgaaggagtactagctaaaccctcatccagcgtaacattgggcacctccacaatattaggtataggcttgttattcagaatgtgatccagcaactcttcataactaagttcaccacctgctgccatgcttgactcgttatgttcgcaatcaattttcaagaggtaaaccgaaacatgtggagctcttttacaggctccgataataataaaagaaactttaatagttggtaagaacttgacaaaaaaaaacacaatatatatacataaaaaagtcaacaactgacaagcaaggtaaaaggtgataaagttgaaagatgactggcgaagaatggggcttgactgtactgtcattcttggtaagagtcggattttttctttttggcatttaccaggacgctaatttcaaagtgaggtacactgatatcgactatttttgtgtttcatgatgctgctaaatatgtatacgaaggcaaatcaccttatgcaagggatacatatcgttacacaccgctactaagttggctgctagtgcctaatcattattttggatggtttcatttggggaaggtcatatttgttattttcgatttggttactgggctcattataatgaagcttttgaaccaggccatctccagaaaaagagctttaatattggaaagcatttggctattgaatccgatggttatcaccatcagtacaaggggaaacgctgaaagcgtgctttgctgtttgatcatgttcacgcttttttttctacaaaagagtagatacaccctagctggaatcttatatggtctttctatccatttcaaaatatatccaatcatatattgtatcccaatagcaatttttatatactacaataaaagaaaccagggtccacgaacacaacttacatcgctactcaatatcggtttgagtactctaacaactttgcttggatgtggttgggcaatgtacaagatatacggatacgagtttctggatcaggcatacttgtaccacttatacagaacggatcacagacacaatttttcagtgtggaacatgctattgtatttagattctgcaaataaggaaaatggtgagtccaatctctcaaggtacgcatttgtgcctcaattgctgcttgttttagtaactggatgtcttgaatggtggaatcccacattcgataacctattgagggttttatttgtgcagacgttcgcatttgtgacatataataaagtgtgcacatcgcaatattttgtttggtacctgatctttctaccattttacctctcaagaacgcacattggttggaagaaggggcttttaatggccacgctttgggtaggaacgcagggaatttggttaagccaaggttactatttggaattcgaaggcaagaatgtattctatcctggactatttattgcaagcgtgttatttttcgtcaccaatgtgtggctactgggtcaatttattactgatattaagataccgacgcaacccacagtttccaacaaaaagaacaactgactgacgtgaacttgcaccatgtacatcaattctataaatctactcatataatgaatgtgtaaatatgaaaaaaaaaatgcaaaagcgcaccaccaaaagagaaaaaagctgaaaaaaaaaaggaaaaagatacttgatgtgatgtgtgagtgaaaaaattattaattcctactggataaaatcaccccaaggaaacagttcaagagctaaactaaagaaaagcatattgcataaaatgttaagagaagtcatctattgtggaatttgctcctacccaccagagtactgcgagttttcaggaaaattaaagcgttgtaaagtttggttatctgaaaaccacgcagacctttatgcaaagctatacggtactgacgataatacgcaagaggtggaagccgtgaccaacaaactggctgaatccagtattggcgaagctagagaggaaaagttggaaaaggacttgctgaaaattcaaaaaaaacaggaaaacagggaacaaagagaattagctaagaagctgtcatcgaaagtgatcattaaaagagaagctaggaccaagagaaagtttatcgtcgctatctctgggctggaagttttcgacatcgacatgaaaaagctagccaagacatttgcgtctaggttcgccacagggtgctcagtctcgaaaaatgcagagaaaaaagaagaagttgtcattcaaggtgacgtgatggatgaagtggaaacttacatacattccttgctggaagaaaaaggcctaaaggacgtcaaagtggaaaccatcgatgctaagaagaagaaaaagcctgctgcagaaggagctgccaagtaagcaatccataaatatgtaatagcaccgttctgggagaaaaggactttttacttggtaaccaggcgtgtaggttagatagtcaaaccctatatcgttcttgagatcgtcgctcatatatactgtgcagccggccctcgtgcgcctgcgccgttccttctctgaaaccttcgtagtaggacaataaatatagtccccattgcctattcaaattatttgcaaccgaaaaactgcaaaatttgttgttgaccataggcgtacaaaacacaactcaatccagccgtaagtaagtatagttatgacttcatctctagatgatatagaaccaacagcatataataatatggaagcggacgaggaatattgcagacgcaacgatatacatgacctttccagcgtggtcggtgatgctgtctcacaaggtgtgccagacatggatggtcaaacaacggattcttcgaaggaccctgagccaaattccgaggataagaaagcgtttcctccttcgagtggctcatttttttctcctaatctacagggtcaaaggaagaaagttcttttaaagtttgttttcacaaattgcttactggccataatttgctttacaatgtttgtgttgttctggggggctctttacgacaccagcaagtatctacacaaagttaagcttctggttgttatccaggaaccccctgtggtaattttggataataacagttccatggtagtgccctccatatcgtatgctttgcctacttttatcaataaaataccatgtgattgggatatttataacagtcctaccttccaggccaagttcgacgtaaatacgccacagcaagtcaatgacaaggttgtcgatttggtttacgacgaaaaatactggtttgccattaatatcaagccaaacgccacggagactctatttgaatcactaatcaacgataccgcaccactattcaattctacgctgtttaatcaggtggtatatgaaactggtagagacccgacaaacctaaaatcaacgattttaccggttgctcagaccattgaagagtactaccatacattctacacactaaattatctgccgccgttattgacaaacataacccaggtatatcgttatgcactaactaacaatgcaaggtatatcgctgcagcaggtaaatataactacgaatactatgaccacagaccattcacagaccgtattctactggcacccacacaaatcggtgttgtttactgtttactgctaacttttttccaatttctattgtacggcccattacacgtagaaatggcaaaagtgctaagaccagccaacggtttaatttaccgtatcgctatgtcatggttcacctttttctttgcgtctttgttcttctgcacaacaaccgccatctttcaagtcgattttaccaagtcctttggtagaggtggcttcgtcgtatattggatgtctacgtggctcttcatgcttgctgcgggaggagctaacgaaaatgcggttatgcttgttattacgttaggaccccagtatctcgggttctggatcctatcatttgtcattctcaatattgcaccttctttcttcccattagcgctaaacaataatgtttatagatatgggtacatgatgcccgttcacaacgtcatcgatatctacagggttattttttttgacgtgacaagacgcaagatgggtcggaattatggtattttagtcgcactcattgccttgaatacggcactgttaccatttgttggcaagtatgctagtagaaaactaaaacagaaggctttagtggcagcaaagcagagttaatttcgtagattataattaaggcgacttttcaaataaaaaaatactgatcgttgtttttttttaaataaatgtttatccattcaatggactataataaatatttatatatatatatatatgaaaagattgcgaacaaaaaagatgatggaaaaggagaatctctatatatatattcatcgattggggcctataatgcatcaagcatctaaaacacaaccgttggaagcgttggaaaccaacttagcatacttggatagagtacctcttgtgtaacgaggtggaggtgcaacccaactttgtttacgttgagccatttccttatcagagactaataggtcaatcttgttattatcagcatcaatgataatctcatcgccgtctctgaccaacccgataggaccaccttcagcggcttcgggaacaatgtggccgattaagaacccgtgagaaccaccagagaatctaccatcagtcaacaatgcaacatctttacccaaaccgtaacccatcagagcagaggaaggctttagcatttcaggcatacctggtgcacctcttggaccttcatatctgataacaacaacggttttttcacccttcttgatttcacctctttccaaggcttcaataaaggcaccttcctcttcgaacacacgtgctctacccttgaagtaagtaccttccttaccggtaattttacccacagctccacctggtgccaatgaaccgtacagaatttgcaagtgaccgttggccttgattgggtgggagagtggcttaataatctcttgtccttcaggtaggcttggtgctttctttgcacgttctgccaaagtgtcaccggtaacagtcattgtgttaccgtgcaacatgttgttttcatatagatacttaatcacagattgggtaccaccaacgttaatcaaatcggccatgacgtatttaccagaaggtttgaagtcaccgatcaatggtgtagtatcactgattctttggaaatcatctggtgacaacttgacacccgcagagtgagcaacagccaccaaatgcaaaacagcattagtggacccaccggttgcaacgacataagtaatggcgttttcaaaagcctcttttgtgaggatatcacgaggtaaaatacccaattccattgtcttcttgatgtattcaccaatgttgtcacactcagctaacttctccttggaaacggctgggaaggaagaggagtttggaatggtcaaacctagcacttcagcggcagaagccattgtgttggcagtatacataccaccacaagaaccaggacctgggcatgcatgttccacaacatcttctctttcttcttcagtgaattgcttggaaatatattcaccgtaggattggaacgcagagacgatatcgatgtttttagagatcttcgaagaaccacatgttggatgaccgggcaagatagtaccaccatataccatgatggaaggtctgttatgtctacccatggccatcatgacaccgggcatgtttttgtcacatgatgggatggcgatgttagcatcgtagtgttgtgccatcatgatggtttcaaaggagtctgcaatgatttctctactttgtaacgagtatctcatacctttagtacccatagagataccgtctgaaacaccgatggtgttgaactgcatagctttcaaacccgctttttcaatggattgagaacatctgttattcaagtccaatagatgcatgttacatgggttaccggaccaccaacaggaaccaaccccgacttgaggcttcttgaaatcttccttcttgaaaccggtggcataaagcatggcctgggacgcaccttggcccttaggttcagtgatgatatacgagtacttgttgagcttctttgcaacgcatctcgttgtagagaattgtctagatgtagcaactttcgttaacaagcccatctctacttttttcttggctgtttacaaaaaaatacaagaatccgttactaaagattacaggcgctacaatgcataataaaacttcagtctcttcttttgttacattatataatatactactatattactgagtcatctggagaggaaaagagaaaattttttttcaggcccggttccgctcgcagcgaagaacagcgccatttaactatgtgactagttaattttttttcttttcatgggttcagcgaggacggaatggatacaagagggaataagaacataaaaaggtgaggtggagaagcaaatgccaacctaacctacccgcttgatcacatgaacaccgcttcctgattcaacgatatcgcttacctcgccgaccttgagctggaaggcagcgtcttcaaagctaggctgcatctcgcctctcccgaaccagccgaggtcgccgcctcgcttgtatgaagagcaatctgatctctctttagccagggcctcgaaggagttcgtcttagagtcgtcatccaacctcgtgattaaggttttcagttcgtccgtagcgtcttgcttggatatcgtaatgttctcggatctatgcgatgcgggtcttcttgaatccttgtgcttgatgagaatgtgcaggcatcttacacgcactggatggtctcttaagtgcttgtgtagctggtccttgttggtgccctcaggctcctcccattgcgagtgcttcgtctctggattgaaaaaatactctcttttcttggacttactatacctgacggtccacggggttggcagcccggtcctcgatgctacgtcagatggcattggtgcgtcgttgtggtgccgtagtcggttatgcgtgggaataagtaccacaatgatcattcaggtcctttttctacttagatcgaagggaaaaaggtatgatacccgctcgtgaaaggtgatgtaataataaataggatattattatataatataagaatatatatgtatgtgtttatacgtgggagggaattgtcctcagaacttggctcgaatgtctcgttctgacccgtagacaacgtagccctcctgagagacgcttgccatgatgcgtcccgactgtgtgtcgaaatacttgccctgtacgaggtgcttgtcccagtgggacctgggattcgaaatcttaagatagatccaattgttcacatgaggcaactggtgaaagtaaatcgtgtggtcgagcgagacactgaaactgtggcagtacaaaggcaggttgtggaagtacgggatcgtgagtaggaggtaggaatcggacagatacgcaaaggccacgtagttgtagcgagcgtcgttctcaggagtaatgctcttcgggatcctgtacggatgatgcttgtgtaaagaagactcgtcgcccgcgtgctccacggtagtgatgggaggtctcactttgacgaaataatccagctcgtcggtgtgtcttgccgagtagaacatgtccttggggaattggtactccatgactccgtattgaaacgcatccacatacttgctcatcgaggttgcgtcttggaacctgtcggacaatgaggcatacctgctcaatttctgtgggtccagaacttctttctggaaaagcgaagtggcctcttcataacgatgagggtctggctgcttaccttgcaggcctggaatcgtctcccagtgctgcaaggagtcgtgctccttggaccgttgcacggcaaataagatcatcgacgtaaatatcaacttgtcgtgctgataagcactaacctgcttatggatgaaatttctaccgtttctcagattctgcacatggtacgtgatcttggtccgcggatcaccacccttgatgaaatacgaatgtagcgatgtggggaagaagttcaatggcacagtatgcaatgacgccagcagcgattgtgataccagcgttccaccaaaagtgcccttagaccctacgggcgcggcaggcagatactttgtgacaaaactggtaggcgaaagaggaaccagttccaatattttctctaggttggacatggccattttggaagcactcatttttatgcaatcttgtcttatcttgtcttgctcatggtggatactgaattgaaacccttttctggtttatatccaactggcgtggtttttcattgtaggatgaggctcggtgtttatgccgtctcttccgaggatgcaatcaaaggctctctcctttgttggggtagtagcaagtccaataagcaacgcttgtttgttgattgggccgatttacatagcctatacactgctgttacatatgcctgtgtagaatgaaaaagcaggacgcccgtttcacagctcagattccagagtgtcgggtcttagttcctcccagggaataatggtcctggccgcacgcttcagccgatggctagcgtcatcattgtcttcgctattgtggttttggctggtggatagggttggggagctggatcttctgcgtttcatggaccttgtgaccatcattcttggtggcggcacggacttcttacgctgcttatcgtgggcttcgtccatatcgtgcaggagtgtggtgccattcagagacacatccgggcgatcgtaggcgtgatctgccttttctcgaaacgccatctctagagcagtctggcgggtttgtagactgtgcatgtctttggatagagacaggagcactttatgcacgtcctccagttggctgccgacgttgaagagcatctcctgggtgcacctcatcgacttttccgtctcatgctgcttgttagttacgtgtcgcgttatcttggaattatacctgcttatttcttcgactaatacctgcctgtagctggaatccgactttgtcttcttctcgtcgcctttcgataacattgctgttgacactttgtccagttggttttcaatctgggaagccaaatcctttattaaggttttcacgtttcctatactacagttgttagtaaatgtgttttggaagaaaatgaataaaaaacttgagggtatgcactgtgttggtacgaaccgttcgtagcagcatcttgttccagtagctggttaaacttgtttagcgatttacataatgtcttagaattttcatttaaaactttaattagcttgtcagagttttccctcagctccatactctccaattccagtttacctgcccattccagtatctgcttgtccgattcctctaaagcgcctgcattcgctactttcccactgtgggagaatatagatctgaacggtgatgatgtttctgtaatcatcaacgagtgttcagaattagcctctgaaacatctgtagatatctcgtctgttctacctctagcgaccattttactaaatgtttctacacgtctgcagtatccttgttttgcttgttttccttctttctgttcttgttgattttccctttaagtcctgaaaatactatcatggcgtaaagggaaaaaaaaaaactaatcttacgtggttcttataagatggaccagcaagctgcatacagtacaccatacaagaagaacacactatcgtgcaccatgtcagccaccttgaaagactacttaaataaaagagttgttataatcaaagttgacggcgaatgcctcatagcaagcctaaacggcttcgacaaaaatactaatctattcataaccaatgttttcaaccgcataagcaaggaattcatctgcaaggcacagttacttcgaggcagcgagattgctcttgttggcctcatagatgcagaaaatgatgacagtctagctcctatagacgaaaagaaggtcccaatgctaaaggacaccaagaataaaatcgaaaatgagcatgtaatatgggaaaaagtgtacgaatcaaagacaaaataatatagttgcaataatagtaataataataataataataataataataataataataataataataataccatgtatagaagtatataaatcatacaataaatttaagcattaacccgtcacggactggccatcttcagatgcttcttctcttcgccaatgccacagtcgggaggaatccccatttggtacatctttatggccagctccatcaaataatcgatggcttcgttgaaaattttggccttatcgattgtcggaccccaaacaaaaatgccatgtctcctcacaattacggcgcatgtgtctggataatctttaaaagtcttgtgcaagtcatcgatcaactcgtcctcatgcgccatgttttcaatgatgggaatcttcagcgtatcaaaaaacgatagcgccatgggtttcttggtcacagggtccacctttccgcttggaattgctttgatttgttcgatgttagcaatcctgaactcatcgccaaatagcaaggagcatatcacagcattttgggagtgtgtatgtattatagcacctgcatttttcttttggtagcacgctaagaacaatggagtacatgcgcttggcttgtaaagcttgggagagcgcaaatactctaatgtctgagcgtccatgacaaacaaatcctcaggtatcatcttctccttctgcaccccagatggggcgagataataataattcgtgttaggatcttttattgaaatcccacctccagttccggtgcaccaattattatgaaaaaactgcttgcatagcgtgcaaatgagatttgctggatggcacggatcatctgaatgtatcagaacatcttgtgaagacatagtcgttcactggctccccttgttagttcagtgcttaaaaacgttacatatcttgatgaacagctagctgctttgatcaagagaaaaaaaaaaaaaattggcaccgcatcttagtgccgcaatcttacgtaacaagagagctataaaagtacaactaacaactcttctaatacttaattagattgagggcgtgcgtagtttaacgtcttgcaatggaaacatgtcctcttttcgacatcattttcaaaatctaaaatggcttctttcacttgggtacctaagtctaacatttgcagttcactctcgtggaccacttggcgacaatgagaacagtaccaccttatcttatcgttttctcccccaggcctatcttgttccacaacaatacccacagtatcagcaaaccgaacaggactgtgaggaacatttcctggcaataaatatgaatcgccttcattgatgatgatatcaatgaactttggttcagcgtctgtctcatccacaacctttaaaagcatagatccttttttttgatagaaccattcgggagttggattgatgtgataaccggttctttcattaggcccaccgacaatcatcacagtgaatccccctttatgtaagcaataattattcaccggtggtttcaaaaggccttcgttctccttcaaccatttgtcgatattaattggtgtagtattaaacatttttttcgatttttttggtaaatgtatgctatttcagttacttgtagactgtcgtgaaaagaataaagaaagaatcttttacgtccgtttttttactttgccgaatatgtttcagtgactcacaatttatcctgacgccgtcacaaaggcagccattccattgcaataacgacactctgaatattcacgaacgttcaccagacatttggaggcagcgttctaaatgccgatacccgttcaggagtacaggtgtcagtgacagaaaaataatggcaccgttgacgtcgaaaatacatccgcgcaaattttgacaggctattttggcagcgcaatcaaagaataaacttggtatagtaaggaagccagttactgtacgcatgaattacggtagctttttttattttatttattttttttttttttggacaaatagaaaaatttttattattatgtaagattattgaagtaaaaatacaattggacgaatctagttagattgccaagatgtgttaaaaggcaagattaacttatgaacatgatctacaacgtcctggtttttaaattcgagtaaatacgcctcctttttatctgtgaatgacagtcctgttctcccaagtctttttacatcatggagacgggagttatactctctcgggtacaaggttccttcagcatcagaacagatcacaaactttatcgcaacaacaattcctttatattcctgggaaaatatgtcggtatagcctactcgagacggcttccaaacatcagctttcgttttaacatgttgctgttggaataaaaatccactatcgtctatcaactaatagttatattatcaatatattatcatatacggtgttaagatgatgacataagttatgagaagctgtcatcgaagttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacatatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtacaatatggagacttttactgggtatctaaaaggtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggttacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaagaatccaatgatcttaacatagaatctgaccatgacttccaatctgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgacattcagcatcctgatacgtacgatacaggtatgcaatccaacactgtacatcattatgcgttgatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcacattatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccgagccagataataaactagtcgcaataagcgatgcttcatatggtaaccaaccatattacaagtcacaaattggtaacattttcctactcaacggaaaagtgattggaggaaagtcgacaaaggcttcattaacatgtacttcaactacggaagcagaaatacacgcgataagtgaatctgtcccattattaaataatctaagttacctgatacaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaatgatgataataatatttatagaattgtgtagaattgcagattcccttttatggattcctaaatccttgaggagaacttctagtatattctgtatacctaatattatagcctttatcaacaatggaatcccaacaattatctcaacattcacatatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaaactgctcagtcacattcaccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagtaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccgatgatcttaacatagaatctgaccatgacttccaatctgacatcgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgatacaacaatgtggtatggaagaagttcgtggatggtcatgcgtatttaaaaacagtcaagtgacaatttgtttattcgtagatgatatggtattgtttagcaaaaatctaaattcaaacaaaagaattatagagaagcttaagatgcaatacgacaccaagattataaatctaggcgaaagtgatgaggaaattcaatatgacattcttggcttggaaatcaaataccaaagaggtaaatacatgaaattgggtatggaaaactcattaactgaaaaaatacccaaactaaacgtacctttaaacccaaaaggaaggaaacttagtgctccaggtcaaccaggtctatatatagaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggcaaccaaccgtattataaatcacaaattggcaacatatatttacttaatggaaaggtaattggaggaaagtccaccaaggcttcattaacatgtacttcaactacggaagcagaaatacacgcgataagtgaatctgtcccattattaaataatctaagttacctgatacaagaacttgacaagaaaccaattaccaaaggattactaaccgacagtaaatctacaatcagtataattatatccaataatgaagagaaatttaggaacagattttttggtactaaagcaatgagattgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacatatttctcagttgccttactttaacagaagataacagaagtgaagaacttatatattctgatgagtctttcatattagccaattctgaattttcagtagatgatctagtaacattacgactgaagcatgaagacgaagataccgttgataaagttcctgtggtggttgagggtgaaagggatgatgtctggctactttgtaactgatattgtaacacattcaccaacttagcagcttgcgcacagcgtatagacagcgtgagatcgtggagtgttccaaatacactagctttgaaatcagaggaaggaatccgaagttgaacatcttgtgccgttgatctattgtacttccaggtgggttccaatttcacaaccaatttacacttctccttttcgaagtctttatatacaattagtaaggtctcgttgtctccggataaaattaaagacaaacacagcatgtccttactcaaaggcacccatgacttgccgttccaaagggaaacttttaccgaatcgttttcgaaatatactgctcctccagatgtgtttatgcttaacggaaacgatacatacgtttcatcaacgttatcgtcatggggggttgctgataccggggtaactgattgttgattgcctggcaaactaaacaatgatcttgaatgatttttgggaatatcgatagttagattctttttgttttttgagaagatgcttagtaaagatgaagatttacgccgataaagcgttggcttatagaaatcgatatctggatcgaataaatctttatctcgtttatcctttccatcttcagaaattatactctcagaatcgtcaatttcagacgcaacactctctattagttcgggagagacactctccaggctgaaagtttgagaagctgttctaatgttttttaaggtaggtgtgtccatatatttaggcgagagaggtacttgaatgctcttatccaattcaattagcttttcacaacttagggattcaatatctttcagagaggtgtcaagatctgaatcttcgctaactgttgccctctcactcatgattgacagtgactcctcgtcagggtattcattagaggtctctattaaggaagacagacttcccggcaaaggaattgatctatgcagtgtgcgaccattgtgtattgtatctgatatctttacagagctaataggcatatcgtcatttcttttaggagaagtataatcagggttgttactcctaacataaacctgttgagaaattttacttccagatcgcttgtattcttttgtagctgttgagtcgaaaagctttctaataacatgtttccaatactcttgccattgaataggatctttgcaagttaacctcaatacaatgctattatttatcggtacctttagttttgctccactatcatcaagtctgatgagatcaagatcgccggacctaaatggtcgaaatagcagcgacctcccgacattcattaagtcatggtttcctaacgcaagggattggaacaagttatcaatggtttgtaatgtgtatggcattttttcagaaagaacctcaaatatagctatctccccattatctaattcaaggatttcaactagtttattattgatcgccaacttctttacatctagtctgtaatatgctctatttataaccttattggaatcgattggcggaagattaatcagggaaacttcgcctgatataacgtcacgaacgcttccgtatttcagtgagttacagcttataaagtcatagcaacttttaaatttgtatacaaacgcactgattagggagcctagtcgtacttcatttgtgacatagaaaatgtccctcaacttataataaaccttgaatagtaataccgcaaaaagcttttgtgaatccatcctaaagtatgacatgttcgcatcgagaagcaaatgcatacatccaaataaaagattatgatacaaatcgagtatttgcgcatctttgaataaactcttgtaagaattcactatggattgtgttagagacatgtcatcatgatttgcagcatgctttctcaaaatgcatctcaagtaaccgctaatttttctcatttcatgaccaactttaaccattgggtccaagctcgaaccatggtacctgctatgggactcacagacaacgagtaatcgttttaacagagtctcgaagctcgcttcttccttgttaaataattccatcccgtctcccacacaatactaatttgcttgctcgttcgtaattagaggaacttttacttggttcatgatgaattttaattgaactgagggtaaaagagtaatctcgataagggtacatttttatttttcccattaagtgaaatttccttcaaattattctcgaagctttcatgccattggtgacacgaaaaaaaaatcttgttgtattttatctaacgcgtcgcgacgcgttagataaatataacagtaaatgatggtataaatgccaccgtcgatatttaaatgagattgcttatatatcgcattattacctgcgaaaatctaatttacgactccttgaaaaaattccatcatactaagtttcttggtatagttacattatcgttggtctactccttctcgatttccctcttagaaataatcaactcttgcaactgcctttccaccgtaggatcatctacatacttgttaaatacgttaagcactctcaaaaaagtttcgttacttgttacgccttccacaagttgacccaagaagattttagaaagaacggataaaatgctagtaattcgtttcatcttgacatcttggatttcatccaactcaaaaatcggtaataatcctgtctctagtaggttatccaccgcaactttttccgtacgtagttgacttgctcgagataacagaatgttctctaatgcttgcaatgcttgcatacctagttcgtcacagggattgaggcattgatgggcgagaccttgaatagcagctataatctcattcttgttgagtgctgaattactcctcccaacagtcgaaagtaggtctgcagttatattaatggaacgactagaaagatcaataatagaacggtatggattggattcaggtgcttcacacccatcctcgactgaattttcataattttgttcccattttgtgccaacggcacctgcacatgacatttcatcaagcagacttaatatgttcataaagttcccatcatctacaaagatatcaccattttgaatgtatttttccaaaaatgtgtagacggcaaattggcggtctttggctgatattaatatccttaaaaaattccaaaattttacatttttgagagcccgctcattgtattttacgtcattgagatgtgtaaacagatcatttattacttgcttcccccattcactttcataatatttagtattgaagatttcattttttaccaaaaagtcgtgttctattaaatcacttaaaatgtcccgtggattatcaaatctcgaaaccaaaaacattttatacgaggcaagtcttgcaatagcctccttggaaaggccatctaaattcgaaatattaatcatatgatcagcaattagtgctccaaattcttgtccataagaagcctctgatattaatataatggatatttccaacaaaaagagaagttcttgttcgaaatagggcgaattttcactcgttttttcaatcacaagtgaagagagaagagtttcaatcatcttaggactgacgagttgattgttctcaaagactgaactgagaggatggctagccttaacgcactcaaatgctttaatggaaaaatcgatgtcttcttccgaaggttcttcatcgcctttcaagtaagaggcgaaagtagacagaaggcttctgctcatctttgccttgcggatcgatatatctggatctggcaatggtagttcaggaagtttcaagagtgaatgaaagtttgtaaaaaatggtaaattaggttccatcaataaattctcgaataatttcaaaatgagttgcacaatctggttccatagtctggtagaaacaatgctaggatcacttatttctttaatgatttgaaagtacaatacggtacataactgagccttaaagttttgtccaagtcttatactctggttactaacggatatcttcgacccagtgtcttcgacgaatatctcgaccaaaggaatactgtcaacatctagctccaccgcttttgcgctactttgtgccaatgttgtcatttctcccagatgaagtacagtatcattatatgactggtcaaaagaaaagtaatagttgataaatgtacacttactaatggcgtccaagatacgtaatgatatttgatcactggaagcaactgtgaatattttgaataaagtcttcaggataatatctctaacatttgagaaaattgctttctcatactgaagtatgtctatttgcgctaacttagaaatagggtttgtgaaatctctttgcatctctgtcatcacagatgttgaggatattaagttattccaggcatcttcaaaccacctttcatttccatgatgttcttcaggcattactatttccttaactttgatggacgtgtaaattttatgcaaataccaacgaggaaaatcttttccattgtagcatcctcgtaaattgttagagtagtcatcaaaagtcatatggtctttaacctgcgggttatgtgaatcggtatttaacatgattatcgaataacttaacacaaacacagagtctgcatcaggctgtacatgaatgatgtcatcttctgtcattgactctgagccattttttcctgcttttttatcctctaactccactttatcattgctttgatcagcagaatattttgatgaaaatgcttcaacgattctttcaatctgttgagattcccctggtaatctgaatttcgtcagcaaaattctgatcgcttcatcaacccttaaccctttaaaatcgaatagatctataaattcttttaacaatgaagtttttttcggatcacaaagtaatagaccgatggttttcttatttaaacgtccgttattgagaaacaaaaatgaagcaatgtctctattagaatccgaatcaatgaatcctttttcaattaacatttgaatgcctttctttgccttttcattaaatgtttcaacgcataatatgaattcagtctttctgtctctctgtttcaaaatatcaatttctttctgattttttacgaattctgccctatcaaatctctgcagatcattgtatatattttcaataagcgaaagtacaccttctaggcaaattggaggaatgttgttagaggtattaacggccgccgctggtaaagaaaatttagttagctcttttataaagtcaatcgaaagatccgacctatccaaattacaatcgaaatttacaaaaagttgcaaaaagaaagcgggagagtgaatccacagtattgaaagttgttcaataattaattccctgattgcaggtggtttttgcttactaacgtcaccactgattgtggtatcctctagaatttcgaatattctccttaaagtcagttcaatctgcataggcaaataatcacccaatatcacaaccaaactcgtgaataattgtaaagttgcttgcaaaagagaatactgggtagaactttgtataatgaataaaacacttttaaatattggatcagaaattaagctgaataaccggggatatagaggaaatttgtcaccggatatttcaatggctgcattgattaactgtagagataatttcatggccgaagttgtgtgcttcattctattctctggcataaccagtgataacaataatccaagataatcctttataactgttattccgtaatttggctcgacattttcggctttctcagccgtttcctcatcattttcctgttcccttatgacctgttggactggcttctcatttttattatcgtctgcaacagcactgtcatcatcagtgctactcaaatcgttatcagaggtagtcgtacctataatgtcatccttcaaattattgtcggtgtaactttcatcattgatatatttttctgtttttgtaggtggatctagtaacttcaactttgtaaatagtttaacggttatccctgcaattgtaacttcagccgttttcctcaaaacctcgcttctctgcgtattacatgccaaggaaagtgtcgtttgtaaaacatcgtagattatagtatcggagagatagtctccaaaggaagaggttataatatcgcgtagtaatgttacaacttttaataaaacagagtcgtccgaaatttgctttgaagcttcaaatctacaatgtgtaagcgcaacaacggtttccctaacggcaatttgaatatcattaaatgttttgtttatgatttttagtgtaaaaactttctgcaacgagtccagagccagagaagtagtataacccgatactgaactagcgctgactatttctaaaaatggtttcaaaagttccaaggcgtttaatgaatctaaacccttcaagtcgttaatttttagccgcagctgtactaaaccagatatcagaggatcatgatagctagaagtaggcaaattgtggaagctgtcaacaaacgaatcactttgactcaagaatatatcactacctccgcccagcaacgcggccacacttgtttgtgatttatctctggactgcttgttcatggcagaacaaagattgatgcactctttgacaatcatcgtagctgggttcacggccaaaacagtttccattggcacgtcgtgcattttgtatatgaagccgtattagttaaacctgggcgcttcttaccaaagttgcgaattaacttaactaagatggttcaattctctgtgtaaagtatccatattaaaaggtcttagttccaacatgtaaacaaagagatctatatattgttttttttccaatgcgctgagtgatgaagtgattagaaaatcataaaaatgagaaactgcaaagaaaaaaaaagtcgttattctgaaaggtgttcggcagcaacaacctacatccaacgcgatgattcaagatccccttgtatatttagacatctccattgataaaaaaccaattggtcgtattgtctgcaaactttttcgtgagaaggctcctaaaacaacagagaatttttataagttatgcgctggtgatgttaagagtcctttgaaggatcaacagtacctgagctataagggaaatggttttcatagagtcgttaagaattttatgatccaggcaggtgacattgtctttgggacacaaaaggattcctcttcatcgtctgttggaaaaggtggatgttcaatttacgctgataaagaggaagtgaaaaccgatgatgaatctttctgttacgggaattttgaagacgaaaacttgggagagtttgtagaaccctttaccttaggtatggccaatttaggttctccaaatacgaacaattcccagtttttcataactacatacgccgcacctcatttgaacggcaagcattctatttttgggcaggtggttcatggaaaatcagtggttcgcactatagaaaactgcagggtagattctgatggagtccctgaatcagacgttagaatcagcgactgtggagtgtgggaaaaaactatgggtgtcccgctttacaacgcttctaatgaccaaattggcggtgacgtatacgaagaatatccagacgatgatacacatttcggtgacgatgattttggtaaggctcttgaggctgctaatataatcaaagaatctgggacgctcttatttaagaaaaaggattactctaatgcctttttcaaatacagaaaatctttaaattatatcaatgaatacatgcctgaacccgacgtagacaaagaaagaaacatccaatttattaacctaaagatgaaaatttacctaaatttatctttggtgctctttaatctggaaagatacgatgatgctatcatgtatgctacgtatttattggagatggataacgttcctaacagagatcaagcaaaggcttattatagaagaggtaacagttacttaaaaaaaaagagactagacgaagctttacaagattatattttttgtaaagagaaaaatcccgatgacgaagttatagaacaaagaatagaatatgtcaataggctcatagaagagaataaggaaaagacaagaaagaatatatcaaagtttttctcctaattagttacttgtaaggctgaaatttgagattaaataacccaatatgaaaacactacattaataagatgtaattatttttatttataaatccatttatttgataaaaaatatgatatcatacaaagtcatctagtaagttcttggtaatagcagatttttttggcttctgtggcttttgtgatgaaagatcatctaatatgtccttagagagtttatctttcctattttctgagttgtctgtttcacccacagagtcgtttggcgcttttggagttaaattctctttatgctgagaatatgaaggagagacgaactcatccagtatacttctaggtgcagaagaagaactttgagcgagggaatttgaagaagtgctatttggtggtggttgcaagaagtcgtctaataagctatttggtaactttggattaggtgactctatatctgaagcacttggcgagccaaacttatcaaaaagactgggcctcatcctagcagtagaaattggttcagacgccatggcgccaatagcagaatatgctctatccttggtggggctctttaatagcttctgaactggtatggaatttctttcgatgaacttccaattcttcacaagtgaaaccgccaggtaattgcaacccattcggcaaagaatatcagtaactcttaagatcagagtacactcgatttttgcttcaacatttagagatccaatgaaatacttcaagtttctgtttctcaggtgattgtatagatagagcaaagcagggtcttcaacaaggaatgatctgttaacacagacttccttatcaacaatgcttgagttgttttctaaatcaatcggagcagtcagcaaagctttaatagccacttcctgctttctcaatttccagtaaatgaaacttgctttccatctatcattctcctttattgtttcaggtagcatttgcgctgtcaatagctctcccaacacgggtccattatcaccttcataaacacgacatacaccgattgccaaatccatatcatgcacttgcttgcaaagaacgttgacacaatcttttagagagtcagttaagagaaagaaaactgctgcatccatatatctatgcttacttagcagaacaaaagcatttttgagtgctgccgttctccacctcggtacagtgaaatcattactgataaatctaaccatcttttgctgctcaggatgaccaatagccatcttccacaagctcaatagtatctgttttttcttcaacgcaagataaaaaatagcacaacggcttggatccctcttatcatctttggaaaattcatattttgcaatatcctcgaatttcttcaccaagtcctgctccttaatccaataggctattctatattctcgagcgcgattccatgaggttatgtggcggtcaatagaagataataatatttctttattgtctgagtgcaatgcccaagacacatccctcatcaatatgcttttttgaatatttttatgtgataaaaataacttcacgcccaacaagaacctaacaccgttgtaatctactatattctcatttttggtgacttcatccactgcttcaatgactgtgataagcgtgatctgctggtggcgggttagataaggcaaagttgttttcgttagttgctcagtaagtgctagagacactgtcttattgaaacaggggtatggatcagggaaagattcgaccggatagtctctatctttagcaataaagtactttaatggatccattcctagattggaatccaaattagatacatcttgcgattcaaagtctaattttcttaacgctaaaaacaatcttaataacagctccttgacaagttgtaacttattcgcataaatggcttgaatcaaaaattgtggatgataaactggaagtggaccatttaaaacactacttaaatggagaatatcatttgataaaatttttcttgaaccaattgattggtacgtaaatggatcagtcaaatccagagatttatccttgatgtaaaattgatttccggaagcaacaacaaacgtgccatttttcatccatacggagtcacctatattatgagctgtatgtgctgtgatatcaattttttcaataggtaggtaactaggtgtgttgttcgtgtaatcataccttaattgagtataaagtaaagcgtatcctgtaaatccgatagagacaatgctttggccatattccgtgcttgtccaatctatatcctcgataggattatgaaatgtttcttcgtattcaagaactcccctgttcaggtcccatagtgacattactttaccagtagaattaacaatacataacttacctgtagatgatcctctaatacatgtacaattcattattccggtgttaatttcacatgccttgatccattggacatgcctatcattataattaacgatggctttatacgttctggtaagaccttttttagtaatcaaagaaatcaaaggcctgttactcacaaaagtttgatgtacagggtcaataatggagatcttgtatatgtcgtcaccatcgatatctaatgaatcagactttacttcaaaaataccacgtgttaaagagacttcaaaagctttgattgaaccatcagagaatattaacgcggtgaaatgacgctcatgactatgctttggctcaggtgtatttaacataactattggatggatttttttctcctctttcagtctcgtttccacacgtaaatatgattgcttctgttcactgtcctccttacgattcgttggacattcccaggcttgtaaagccccattttcgagaagacagatgacctgtttacccaactcatgtacaactgcaaattttatgggagattctgtttgtattgtattttgtaaccgcagtgaaaccccatggtttaacttttgtgggtaccaaacgccattttctgagaatctcgaagtggttaataaagcttcgccgtcgctgcttcttaccaacttctgcacagatttgttatgtcccgtaaatttgtgctctaaagcggcactcagatcttcggttttattgtttataagctgcagaatgtcgattagtaaatgtctgattacaccttgtaaatcgtggacgagaaaagaaagtttgcccttcacattgtcatagggttgtatttcggggaggtacaaatatcttgtatcgtttagcatagttgctttcttgacttttttatgggaaatggtctttttagtcattggttttggaggatcttgggaaagattattcaaagccaaaacttccatttccccagtcattgaacccagaataacaatgtctgagtcagatatatcaaagatttccgagtctttcacactgagagtttgcctaatgatccaattgtctattatcacgcagaacttctgcgtgggggaaagaggcacttcaccccatatttgcacagtatggtttttctccatttcaaaacaagaccatattctcagaactttatcttcacacagcgtataaagagcatgagaggcagtgttgtttttactcacctggtctggctcttttttccaccgcattgcagttataggtttcggatgaggcaacatagtaaggttaaagatggcttgttctccgactattgaaacacgcttccatagtttagcattacagtcgtacttcccaatactgactatcagctgcgaatcttgtgatataatcacattataaacaggtttaggctgtttttggttccactgcaaaataggttgatacacaccaaaattatccttaattttccaaaaagaaagaaaatcagatccaatggctaactcattatcagaagaccatcttaggcagtttactggcgtgtcatcatggaacaactggcaacattgggtccacttgggattctgcataatttgatgaatgggcttgtagatgagcaccctattgtggaaggaaagggcaatgaatccattctggctgttaatatcgaccgcagtacagtctgattgtgtatatatggtctgtaacctagtgaatttgttggtaagtatgattaaattattccctgaacaatatgcaaagatggtatgattttgccatgttgcttgacaagctgtctgaggggtagcattggggcgtcctggaagaaagttcaatgacatgagaactacctttgcgtgtgcacgtttgtttactttctcaattgtttgcggtgttcttagatccctttaattattaaaaaaactgaagtgcttgaaacaataacataacgaggtttcgctatgcgggcagctttaaagaaagagggatagtatattaaaaggctgccataacaattaatcggaacagaatagacacaaataaatttgcagtgcgtttgtagatatcaaagaatggtagctagttgtaaagatcagaagaaggctgtcgctatatgtttgcagagatcgccctgtgtcatgatagagagacataaccctcaagaatgtcttgacaatccagagctgaataaggatctgcccgaactttgtattgctcagatgaaagcatttttggattgtaagcgaggaatcgtcgacatgactaagcggttcacaggtaacgcacctctgtcgactggcaagtacgatcaacagtacgaaaacttgtgcaaaggaaagtttgatccgagggaggagatggaaaagctaaaacttctgaacagccagcagaaggactgattatttatgaaaattggcctgtaaatatatacataaataaatatatgcgtcaagctcttttattcggtttgtccagtaatcctcttacaatatatatatatatatatacgcatgtagcgtattcaagaacattacatttaaaaaatagagggtagaacaataaaaatgcacttaacaagttccgtaagtagaaattataatcagtctaagtacaaatttataccttagcttcatttcagttaagggcgatgcaataaaagtggaagaaaaaaaaagaagggaagaggtttgataatatatatatatatatatatataacattgctcagagaaacatacatcagtgatggaagataaagagcagcaagacaatgcgaaacttgaaaacaatgagtcactaaaagatctgggagttaacgtgctttcccaaagcagtttggaggaaaaaatagctaatgatgtaactaactttagcaacctacaatcgctgcagcaagaagagactcgtctagaacggagtaagaccgctctgcaacgttatgtcaataagaagaatcatctcacaaggaagttgaacaataccactaggatatctgttaagcagaatctccgagaccagatcaagaacttacaatcagacgatattgaacgagttctgaaggacatagacgatatccaatcaaggattaaagagttgaaagagcaggtagatcaaggtgctgaaaataaaggttccaaagaggggctgcagagacccggtgaaactgagaaggagtttttaatcaggactggtaagatcactgcatttggacacaaggctggtttcagcttggacactgcaaacagagagtatgccaagaatgacgaacaaaaagatgaggattttgaaatggcaacagaacaaatggtagaaaatttaacggatgaggatgacaatctcagcgatcaagactatcaaatgagtggtaaagagagtgaagatgacgaagaagaagaaaatgacgataaaattctcaaagaactggaagacctgcggttcagaggccaacctggtgaggcgaaggatgatggggacgagttgtattatcaagaaaggttaaaaaaatgggtgaaacaacgttcttgcggtagtcaaaggtcatcggacttgccagaatggcgaagacctcatccgaatattcccgacgcaaaacttaatagccagttcaaaatacccggtgaaatatactcgctgttatttaattaccaaaagacgtgcgttcagtggctctatgagctttaccagcagaactgtggcggtattattggtgacgaaatgggtctgggaaaaacgattcaagttatcgcatttatcgcagcgttgcatcattcaggtctattaacaggccctgtattaattgtctgtcctgcaactgtgatgaagcaatggtgtaatgagttccagcattggtggcctccattgaggacggtcatattgcactcaatgggttcaggaatggcttctgaccaaaaatttaagatggatgaaaacgatctagagaacttgataatgaattcaaagccaagtgatttttcttacgaggattggaagaactcaacaaggacaaagaaggcattggaatcaagctatcatttagataagttgatagataaagtcgttactgatgggcacattttaattaccacgtacgttgggttaagaatacattcagataagctactaaaagttaaatggcagtatgctgttttagatgagggacataagattagaaacccagattcggagatttcattgacttgcaaaaaactgaagacacataataggatcattctttcaggaacaccgatacagaataatttaaccgagctttggtcgctttttgatttcattttccctggtaaattaggaactctacctgtgtttcaacaacagtttgtcatacctataaatattggtggttatgcaaacgcaacaaacatacaagttcagaccggctacaaatgtgctgttgcattgcgtgacttgatttcaccgtacctgttacgtcgtgtgaaagctgatgttgcaaaagatctgccacaaaagaaagaaatggttctcttttgtaagcttacgaaatatcaaagaagcaaatatttggagtttctgcattcttcagatttaaaccaaatacaaaacggtaagagaaatgttctatttggtatcgacattctaaggaaaatatgtaatcaccccgatttacttgacagagatacaaagagacataatccagattacggtgatcctaaaagatccggaaaaatgcaggttgtcaagcaattattattactgtggcataagcagggctataaagccctactcttcactcaatcgagacaaatgctcgatattctagaggagtttatatcaacgaaagatcccgatttatcacatttgaactacctacgaatggatgggacaactaatatcaaagggagacagtcgttagttgaccggtttaacaatgaatctttcgatgtattcttactaaccacaagagttggggggctaggtgttaatttaaccggtgctaatagaattatcatttttgatccagactggaacccatctactgacatgcaagctcgagaaagggcatggaggattgggcagaaaagagaggtatcaatatataggttgatggtaggaggttcaatagaggagaagatttatcatagacaaatattcaaacaattcttaaccaacaggattttgactgatcctaagcagaaacgatttttcaaaattcacgaactccatgatctgttttcactggggggtgaaaacggttattctacagaagaattgaacgaagaagttcaaaaacataccgaaaatttaaaaaattccaaatcagaggaaagtgacgattttgaacaactggtcaacctatctggcgtatctaaactagaaagcttttataacggtaaggaaaaaaaagagaatagtaaaacagaggatgatagattaatcgaagggttgctaggaggagagagcaatttagaaaccgttatgagtcatgattcggttgtcaattcgcacgcgggcagttcttcttcgaatataattacaaaagaggcttccagagtagcgattgaggcggttaatgcgctaaggaaatcgagaaaaaagatcactaagcaatatgaaattgggacacctacttggacaggtaggtttggtaaagcaggtaaaattagaaagagagatccgttgaaaaataaattaactggatcagctgccattttaggcaatattacaaaatcacaaaaagaggcatccaaggaagctcgccaagaaaattacgacgatggtataaccttcgcaagatccaaggaaatcaattccaataccaaaacgctagaaaatattcgggcatatttacagaaacagaataactttttctcatctagtgttagcatacttaacagcattggcgtcagtctttctgataaagaagacgttattaaggttagagcattattaaaaaccatagcacagtttgataaagagcgtaaagggtgggtgcttgatgaagaatttaggaataacaatgcttcatgaaaacttagaatggacagagtacccttgacgtaactttacccatagaaatatctataaaaaatatgtatgtgttatgtgtatatgtatattctgaagactcttagcggaacccgtaaccttcagattcattaattgcccaaagtaatttcagttctagtttttttttcgaggaataattccataaacatatttcattaaaacatgtatgagccaatggcaaatcatcactatcatgcgaccctagcaagctaattttgaatgggatagtagagatacccgttgcaggtatacgatcagatgccgttacgaattgtaataatttcttctgcaatggatagtcccaactttcaataatttcccaaaaccagcaaaccgctctggaatcatcggagaagccacctacatactttgtcacggatcttaacgatttgaaatcaaatttagtttgttcctcatcaccacacactaatctctccagctcttcagaattaaataattttatagaattgcattctgcgaagacccttttaaaacctgaaacaaatttattgtattgtggctcaatggacttttccagataaaattctacccatttcatgacaaactcatgcttgttactttgggttattggcacatttctgccattttcacataattctaccgttacatactctttgctcgatttactgtcatttaaaatccagttgttatttcgatacgtagtctcaaatgttaaagaaaagacgtcttcgaaattatcctctgtgtaattgagcatttttattaagttcctacttgtctccggaaacaattccgagtaatcttcaaaactcagaggctctgagcatagttttttataaagcgcctttggaaattgtaaatctaatatggtactgttgaaaatcgccaaccccatgacaactccaaacaagtaatataattccagttgtgagttttttccttttgatttgtcaaaatttggagggtcaatggcaaaccatgaacgtgagctttcttttatgtaaataaataagccattcatcggattaaacagcgattttgttaataagaaaaaccattcttttctcaaccctcccgcatcaattccaggttcattaacaaactctattctcagcgattttaataaatcgccttgatgttccttgatacatctcaatgaatcatgagaaataacgtcacgccgtactttgattttgaaataaacgtctacggatttgcctttatccagtgaaattaaaaaagcctgttcagcttcatgttccatgattctgcgaatttcatactccataatagagattttgatgccgagtgacaatataaatggatacttacagaatgaaaaacatttttttgtcgtcgaatttccccactcttcaatcagttgattcatttttgtcttttgagctactcctctccaatgatcgaaatcttgtttataatctatgaagtctagcgttatattgtaaaagctttgaattgacaacgctccacggccatttcttctagtattggctacataatagatgaacgtcaattttgctgcagagtgaatatgccagtcttcctcatattgaaaaaatttaaatttcatcttattattgacgggatgcgtgaaaccacttccctgtttatcatttgattgtgcacttattggtctagtactcaggaattcatggccagtagtgtgatgccgacgaagacgagatcgcatctcatcttcaggcttcacgttattttttgcggttctatttgataattcgttcgacagtaatctggaaaattggaaattgatgtataaatttaaaatctctacctggtatgaaaaattatccgtaggcgttcgccgtaatgattgaatcaattgttgagatgtttttgttgataggttagacaagtagccaatacatcgtttggccaactcataagacaccgcccttatttgttgggtctcaaacacatttttgctcttccgatctctaataaggcaggttcgtattgtaggtatatttaatataatcagcaaccaacgatactgtaatatttgcaaattttcccctttattgattgttattctcttcagtagatcgttacagcaacacagcatactataatacggtttccttgtaggaagatttgataatatactgtaaaatctttgtaaaacttcataattcagcatctttatattctttccaccatcatgtaccaagaacgacctgtttaaaatgctaacatcatgaaatctgtccagtaaatacgttattaccggttggaaaatcaacccctttctttctttatccagaatcccagtcttcttaagccgctgcaaatcatcatggcaccgccttactaccatctgcaaaccctctaatgtgcacgaaatatgcgtactagattccaaattactgttaatttccggctcctttacaataactgttacttggcatgcgctgcatcgaaatttcgttatggaggctggaaaccgtagtgggacaccacaacataggcaattaagtgaaattagacaggatttatcttcttcccctgacacggatgccgaagagttccgcttattgcttttgctatttgagcaacttccgtcctttacactagcggctaaggaccgttccgacgtgcgccttcctgatttgggtaacctgttcttagtatgggctacagaatgtgatagcaactccttcgacacagatccatctctaccgtctttttttgcattaagcttatcaaataaagaaaccatttcctattttactttacctatcagccgcagtattcgagagatatacctggtaaatttcaccaatgcccttaaaaatatgtacttttctgcttaaagtcgagaaatgcatgcaaaaacttgcccctatctagcaatccttcgaatatatttatctatctacctgttccacatgggcggttatacctgactcttcaaaaaatcctgtaacctccatttttttcctttatttggggcaatcacaaaaaaagggtcccagaaagatatgaccctactccctttttgccttatttaaaagtgctaggagatacaaggttaaagctagacctcggttaacgatgggtcttgacacgtaggcgttgctctcctctccataatcatagtaagttgagacaatcgtatacctccaaaggaagcacttgttggcttgacaagagactcatgatagacaggaacgagagtcagggtaattggatagtggaaagatgaaagcaagagaaacgatgcaaagaggaggctgcccagggcttggcgtatccaatttctcatgccagcagggaggattcgtatagcgatgactgacaacattatagtaagtgaggttgatggtcccccggatgtagttaaatgttttattagggaagaagatggactcgaaggacagagccgagaattggtggtcataggactagaatatatagatgtgtttgaaggggtagaacaagatgaagcgcgcaagaagttaagacttaggactgtcggatatacaatggcagccttttatttcaaagatcatactgcacctaaccgaagattttatattctgttgaaagccacgggacggttggacttcgtcaaccttgattacaaaatagtgaaatctctggaaacaggaattgatcaggtaagatcagagccaaagttcatgttccaagatccactacgaacagctctggtttttaatttgtcatgcactgaaatttacgagatttctactgaggacattttttgtttggaagaaacagacgttaagctgagttatgtgacatcctcaccgatagtatccatagatgcgtgtatcaatttcaatgatttcttagataaggatgtctttacgttgtcgattctcacacgtgcacacaatgaggttgcatataagttggaagcatgcgtgtgtgtattcgagtctaaaccagccaaaggaacgaagtggcaaagaactaccaatttaacatttgtggaggaagcaacggtctcacaagtacttctcaaatcggtcaccaatattggtcattttgtttttacgccatggaaaacttattttattaaacatgcattgtcatcgaaacagaccattgatggtaaaacggtagacaaaatataccaagggcctggtgcctttgggtctgataacatggaaagaatcgaacttttgcagcctattttagcggataccacattaaatcatttaacatttacatttatgacgagtactgcaattctaataacatgcagaatgaatgcaatccttagcagttttgaagacgatacgtatatctgggaaaaggccttgtttgagaggcttcccatcaatggtggttcctcacatgatcactaccttgcagcgtttttcaatgagaagtgttggatactggtatccccaaagggccatcttacagtatattcagtcagaaatgaagggcatagtaattttgttcatcttggttcttttctttgcaaatcaaccttatattccgatttgatagggaactacaccaagtcacatttatcttgtggatcattacactgtgggcagggatacttgtgcttgaaatttcgatcgtgtggggacattttcgcgtccacttgcatgaagctacttttcaaaagtaaagacagtgttcctcgacaagtttactctacaagaaaaggtatctattgggcagatgtgaataataatgtttacagagatagtgagcgaatagactttgaaataaatggcagtttcattgctactaaagatggaactctattgaaagataacactatcgttactttggtcccaattcaaagagataatgagtgtaattacgcatacgtcacaaaacaaggttatctgaggtggagtttttcaaaggtttattaccggattcaaaacacgggagttgatttgactatagataattgctttttatctgctatatctagcaagggctcttttttgactgtacttgttctgaatgatgaaataacggtatttgatcattgcaaccgtttgaaaagccagaaagtagttttccatagactttctgacttagcgtccattttcctatatgaatacgaaagcacggtctacattttcatgtctgacaccgaaggaaacctttgcgttatgaaattggcaacttttgagatcgtagaagaggttaaaatttgcaagaagaagttacagttctgtgaagtccctaactcagattatttttttatatatacagccgatactataatttttttcaagccaagtaaaataaaaggtagatttaaaatccaagaagtatatgcaccatgtcctataagctgtttgatacctggagaaaaagatggctcagttgttatggttacttctcaaggtcaattttacgacgtacttgttcctggtgatgccggaagggctactctttgttctaagtttgaaaaagttttaaaaacatgtctcaaatttataactttggaatcttcatcaagatatgtgattgtagcggccctgccagtagcaaatccattgcaggacaagtattccgaaatttatgtgtatgatattaaacagttcaaaaacatttccgcattcaatttttctaacctcaacaatgatatcgagagtataaaatatgaaaacgctatgatatcagatattattgccgtacccatgctcaaaagaaccgaaacattaggaaaaagaaagacttctgagctgtataaggaagtgattttcaattcatgtatcttggtgtctctaaatttagactcaatagacggtattgatagtaaaaatatgaataacctattattgttttcatttgatgaggaatcgggttttattgaatttgtttttgggattaacacggggttctcaatcagtgggttacataactattacaatggatgtgttttggtttatggggagtttgtgcaagcttatcaactgaactattcagttcatgataacaagttcagtattgaacaggtttcaaataggttgaatatttctggtattacaataacatcatctatattttttgataaaaggaaggcaaagatggctaggaagcagcaaaatataggtacatgggtttatttggaagaaatgattttacttgatgtacggaaaggtgtgatgaggttcaatgtcatccatacaacagacggtaacatagaaaaggttcaattgcaggtacagcctctgaatttatttgagagggacctcatcaatagcattaccgacaccgggaaaatgtttaccggtgcagccgctataactttcaagaatattaggtatctactaatttcgtacggtgatcaaaagctcacgttatttagtttaaaacttgatggtgaggaagaaatagacgaaagagtgtaccatgttgctgagcaagttacaaccatcaactctgtaagaactactgattccagaatgagcacgtttttaggcgaatctacatttatgcccttattcttagtaagtaccttgtctaacggttgttatgtgatcggaatcctgcatgaagagtcagatatctcattacatatcttatcagaaaagaaagctgtcttcgcaaagcggtcggttcaaaagttcctgggcttcctcgatcctcaaatggatgatcacactgtaatatctgaaatttagtgtctacgttatgatatatacacttacaaatttactttccttttttagtatagttttcaagtaaaattcttgaagcggtgttgtttttgtttgttcttcgtttagcaaaagtcattgttaaatacacgctataatatggccatgaccgtaggaccgaatgctgtccgaaaaatgatacttatcacacatttcaaataagatcggttttgtagttcaaagatttcttaagagccttttacgtgtttcttaagaaacacttcacattggctatcattattagtaaatagatttatatgattttcacttattaaggacagaaatgtcgcgatttcgaacccataaaaaaaggaaaagcaccgcctgttctccagtcttcataaaagcacaccgtatagaaagggcggtgaatgttgatcttgcatactataaaattatttgacactaatgccaacaacttatgtgccaataaatcaaccaattggggatggtgaagatgtcattgacaccaatcgattcaccaatattccagaaacgcaaaattttgaccaatttgttacaattgataagattgctgaggaaaatagaccactgtctgtagactcggacagggagttccttaattcaaaatatcgacattaccgagaggttatatgggaccgtgcaaaaacatttatcacattaagctctacggccatagttattggatgtattgctggtttcctacaagtcttcacggaaactctggttaactggaaaacaggtcattgtcagaggaactggctacttaataaatccttctgttgtaacggcgtggttaatgaggttacctctacaagcaatttactactgaaaagacaagagtttgaatgcgaggcacaagggctttggattgcctggaagggacatgtgtccccttttataattttcatgcttttgtcagtcttatttgctctaattagtacactgttagtcaaatatgttgctcctatggctactggttcaggaatctcagagattaaggtatgggtatcaggttttgaatacaataaggaatttttgggtttcttaacattagtcattaaaagtgttgcccttcctttggctatttcttcgggattaagcgtaggtaaagaagggccctcagttcattatgcaacctgttgtgggtacttactcacaaaatggctactaagagatactttgacgtattcatcgcaatatgagtatatcacagcagctagtggagcaggtgttgcggttgcttttggtgctcctattggtggtgtcctttttggtttggaagagattgcttctgcgaataggtttaactcctctaccttatggaaatcctattatgtcgccctagtcgcaataactactttgaagtacattgatccatttaggaatggcagagttattttattcaatgtaacatatgatagagactggaaggtacaagagattccgatctttatagccttaggaatctttggtggtttatatggaaaatatattagtaagtggaacatcaactttattcactttcgcaaaatgtacctgtcctcatggccagttcaagaagtgctttttttggcgacgcttactgctttgatttcttacttcaatgagttcttgaaattagacatgacagaaagtatgggtatattgtttcatgaatgtgtcaagaacgataacacctcaacttttagtcataggttatgtcagttggatgaaaatacgcacgcttttgagttcttaaaaatttttacttccctatgctttgccactgttatcagggccttgttggtggtggtatcatatggcgccagagttcctgccggaatctttgttccttcaatggcggttggggccacatttggacgggcagtaagtctactggtagagagatttataagtggcccttctgttattactcctggtgcctacgccttcctgggagcagccgctaccttgagcgggataactaacttgactttaactgtggtggtaataatgttcgagctaacaggcgccttcatgtatatcataccccttatgattgtagtggcaataacaaggataattttaagcacgtctggtatttctggcggtattgctgatcaaatgatcatggttaatggattcccatatttggaagacgagcaagacgaggaagaggaggaaaccttagaaaaatacactgcagagcagctcatgtcctccaaattaattactattaatgaaaccatttacctttccgagcttgaatctttgttgtacgactcagcgtctgaatattctgtgcatggttttccaataactaaggatgaggataagtttgagaaggaaaaaagatgtattggctatgttttaaaaaggcacttagccagtaaaatcatgatgcaaagcgtaaatagcaccaaagctcaaacgacactggtatacttcaataagtctaacgaagagttgggacatcgtgaaaactgcatcggatttaaggatattatgaatgaatctccaatctcggtgaagaaggcggtgccagtaacattgttattccgtatgtttaaagagctaggttgtaagactatcatcgtagaggaaagtggaattttaaaggggttggtcactgctaaagatattttgaggttcaaaagaattaagtatcgagaagttcacggtgcgaaatttacatataatgaagcacttgatagaagatgttggtcagttatccatttcataatcaaaaggtttaccactaatcgaaatggtaacgttatatgattagacatttatgtaatttttaaggcgctagtatagattattcaaaattatatgatacagacttttatcaatttttacttgtttaagctccgtcaccctgttattaaacgtgagcagagaaatgccttttgaaaacacactaaaacacataagttaatcttcgcgccatttaccaacctttttgtattggaggtaaagtgctttgaaatattgtttcccaggtgtgtcaaggaaagcgttcaattgattcaactcgttctgagataatatatcaaaaatcgcatgaataccgggctgcagactcttttttatgtttaaactgaactgcgtcgtaatagacaactgtatatatttcgttagaaccacaagtacattttttctgatggactgctttatcaaacttatctttgagcttaagttatttttctgcccattttgagcgtttgatacattataaggctcgcagtagttcgttattagtctggctacggcgtctgctgaatttgcacacaatgtaccatcatgaattgctattatttctagtatctggcaaagaacggagttaaacaaatggtgacgattggaaaatttaaacctgtgaactaatagcatatgatctatcacttcgatgatgttaataaagccttcattgatttcatccgttgactcatggtttactataaaagcgagagtttttaaacagaaaggaagcagcatttcaatacagtattggctgaatagccatggtttcgatactaagaactccttgatagcattgaacagtagcaagtatgacttgtagccaaatttttctatatcacaataggtgtaggcttcaagtaaagctatcacaaataggtgatgaccaaggttattgtctcttgcaatcctttttgacattatgataaaaactctcacaaatttttcagcacaaggttggctaatggtggaaaacgatttagcactgttccagagcaggcggttaaacgcatcaggaccttgtttaagactttcttccaagcagaaccccaaggcagaatcgcacttatctgtatgctcaatatttaagtactctgcaaaaatatactccaacttgttttctgtaaggagtgaatgaaccaaaaacatttcctgttcttctggcgcatggtacacttttttagaatgatatcgaagcataattttggaaaatatatccagaattctcgatttatgcttagaaatatcgccttgtccggtcgttataatcttgtacaatgtagacattgatattctgaaaaggggaattgtttcagattcaaaattttcagagtagttttccaaaattttaacagcatagctaattgccataccttgtatatctctatgcttgttatctggtttcaaaaattttgcgatagtaaacccggcgataattagtttgctatcaccattggacaatgacattgactgtttaacgatatcgtaaccagattctaagaacttctcactcacaggctcctttgcctgtgacagatgattagtccaaactttttcgaaaatagatattttgtcttctatttcctttttttcatcacctgtctctgaaatggccatttcggggctcattattgttttctcacataattcgtagaaatttgtttcaatgttgctcttgaaggtcgggcttgacaataaatgaaggaggcattctctagtagcggaatcaaggcaaaatgattcgcatgttagattgttaatgagagccactctaacgtttttgttgatgcattggataggaatttgaatcaaagcttctagagcgaaggtttgatggtatgatgaagcaagcttgtttattaaagcgtacgtgatatttgtctcctcaaaaatgtcatcattttttaataacgaagataaatttgtcgagttcaatagtaatgaatcaattaaagaagaaatttgttctcttgtaaagttgttgtttactaatgttgcaaatttggacacaacagagtatgataagtttgactttctttcttcgtcaaggatttcaaagtgcctcatgaattttttttttgcatcagaaagatcgaacgaaatatattctctcaatttgaagcaataaaagaacagttcttcaacatcagccgatgtagtatcaaaaatattagaagataacacgtaatcgattttttctagttcctctgcagggacaatatcatcgtagacttccattatatgatactttaggtcccattgaagactgttattaaatgattccaaagtaaatacttgagataaaataggctttacctcatcgagagttgcgcgcgatgcgccctctgatagtccctccaagcatatgcgtattaaatataaaggaaccctgttggtggaatcgtgattgacttggtcaagtaaagcttgcaatagatttttccattgtaaagaagataaagtgaacaattgcttcgttatagacttgacatatgcaggatgatttatcaaaaaataggaatcgggtccttttctggaacagtactcatttattttggcaaaaaaatctgataattcccttgcgttagcgtgtgattggattattaaatcccaaatatgagaggaaaagagaggatcgttcaaattttcgagctgaatcaattcaagtaaccgaaaaatatgtttaatagcaacctcgatatccaatttaaggataattggtattaatgataacactccagattcatcagtcgacgctaacatttcaagcaataatgcttcaaggaactcttgagatacggttttcttcgattccgataaaagattcagaaatctgcattctaaactaggtttcttggcacctaaaattgtaaagatgacttctagttgagcaaaattgtcttttgataagaaagtgacgaaagtggcaaaataataataagccatatcgtcggtaatttcggacgcattctcttggacaaactttttatttaatttcatgtaatctatgcgtggttgtaaaaggaactttcccataaaatgagatagacgaatgaaggattggtttgaagatgcagaatttttggtctgtgcgaaatatcttaaacttggtagtagcatatgcttgcagtaacaagtagcaattttgttatccgttgtagtaatattgtcaacatgagttagattgcaggcatcttgcaagtatgaaagcgcaaagtcagtcgtcgggcacgaacttaatccatttatggcatgttctaaaagttgaaaagactcttcaacagaaaaattgacaatcaagtagtcattaatcgcaaaaaatgcttttataaacgaaacgctacgtgtaagtaatttgtctttaggccaaaggaaaaatgttcttatcattacaggcacagtcttcaattttttgagtagtttttttatcgaaattggatcattaatagcatctaataatctcgtgaaaattatccaagtatgttcactggtcttaaaatcatccaaatttccattgttgagcctatcaatgagtaaatctaagacgaaaatttctttttttggaaagtaggtttctaatttatcaaattttgaaactatctcggcaatttgatggggttttgtgctcgtcgaacgtagtaatttcgacaaatcttgggcattgtctgggatagatagttcttctgtaagatcacccatattatcaaaaagtgcagtatactctctgtttttccaaagataattgatggcaagctaaatcttagacagagatgttcctatgctagtaaacaattctgtagttgtgaccaagtgccctcttagcgatcattttgagatgagctaagtgaaatttttcagatcgcgcacgacggagaggttttttagttggatggaagtcaagccttgtacaaattgtagttgtatagaaaacattgaacttacggtcttgagttgagtcaataagcgtgagccagaacgcaattatcagatatgacaatcgatgattcaaatcgattacttatggacgtcgatcaatttgattttttggacgacggaacggcgcaacttagtaataacaagaccgatgaagaagaacaactatataaaagggacccagtcagcggggctatcctggtccctatgactgtaaatgatcaaccgattgaaaaaaatggcgacaagatgcctttaaagttcaagctggggccactttcttaccaaaatatggcattcataactgcaaaagataaatataagctttatcctgttagaattcctagattagataccagcaaagagttttctgcatacgtatcaggtttatttgaaatttaccgtgatttaggtgatgacagagtgtttaatgtaccaacgattggagttgttaattctaatttcgcgaaggagcataatgcaacagtaaatctggccatggaggcgattctgaatgaattggaagtgtttattggtagagtcaaggatcaggatggaagagtgaaccgattttatgagttggaagaatctttaaccgttttaaactgtctgaggacaatgtacttcatattagatggtcaggatgtagaggagaacagatcagagtttattgagtcattgctaaactggattaatagatcagacggtgaaccagatgaagaatatattgaacaagtgttttcagtgaaggattctacagcaggtaaaaaagtgttcgaaacacaatatttctggaagcttttgaatcagcttgttttaagaggcctgctctcccaagctataggttgcattgaaagatcagatcttttaccatatttgagtgatacatgtgccgtttcatttgatgcagtaagtgactccatcgaactcctgaaacaatatccaaaagattcgtccagtacatttagagaatggaaaaatttggtgctaaaattaagtcaagcctttggtagttctgctactgatatttccggtgaattacgggattacattgaagatttcttgttagtaattggtggaaatcaacgaaaaattctgcagtattcaaggacgtggtatgagtccttttgtgggtttttattatactatatcccctcattagaactatcagcagaatatttacaaatgtcactggaagctaacgtcgtagacataacaaatgattgggaacaaccatgcgtcgacatcattagtggtaagatacactcaattttaccggtaatggaatctttagatagttgcacagcagcatttaccgctatgatttgtgaagcaaaaggtttgatagagaatatttttgagggtgaaaaaaatagcgatgattatagtaatgaagacaacgaaatgcttgaagatctattctcttataggaatggtatggcatcttatatgctaaatagcttcgcttttgagttgtgttcactgggtgataaggaactatggcccgttgccattggattgatagccttatctgcaacagggacgagaagtgcaaagaaaatggtgattgcagaattacttccacactacccatttgttacgaatgatgacattgaatggatgctaagtatatgtgtagaatggagactaccagaaatagcgaaggaaatatacaccacgttgggtaatcaaatgttatcggcacacaacataattgaaagtatcgcaaattttagtagggcgggcaaatatgaactggtaaagtcatattcgtggctattatttgaagcttcgtgcatggagggccagaagttggacgaccctgtgttgaatgccattgtgagcaaaaactctcctgcagaggatgacgttataataccacaagacattttagattgtgtagtgacgaattctatgcgtcaaactttagcgccatatgctgttctgtcacaattctatgagctgagggacagagaagattggggccaagcgctgcgcctattgcttttgctgattgaattcccttatttaccaaaacattacttggttttgcttgtggcgaaattcctgtacccaattttccttttagatgataagaagctaatggatgaagattcagtggcgacagtcattgaagttatagaaactaaatgggatgacgctgatgaaaaaagttcaaacttatatgaaaccattattgaagcagataaaagcttacctagtagcatggcaacacttttgaaaaatttaagaaagaaactaaatttcaaattatgtcaagcgttcatgtaaatcagtatagtaatgtccttcggatggtatattaggatatatgacgaaaataagtaaatttaaacaacaatatatatttatattgatctatttttctatcacgtaagttgacatttgtattatacattacatcacaattagtaatggaaagtgtttggaaaaaaaagaagattattttgcctttcttttgaaaaagctttccaatgttccttgcttttttaaccttttattcgatgacggcgtttcttgcttttttgaagacgacaatgccctttttaccacgggtgatggcttgcgtggtggtgttgaagttgcgggtctctttgtcacaatatatccatcctcatcaataaaagaggagggctcttcttcagatttaggttcctttgaatgttctgtttcagaaggctttgtttgctgtattttaggtacatccataagtgaatcttctgctgtcgtttccaacaagtcttctaaatcatcgttgtttttgtccttatcgttgctgtcagtttctttaggtgagttgggcttggaccctccatttacttcctctgtatctaagtcatcttcgacaaaaagattatttaactctttcatttgagcttctctttcagggttctgtttatttattttttgcaagttctcctctttccttttacgtaactcattttgtctagaggtttccttgtcatctctatcctttttcatcttagccagcagtgcagtagacctgagacccatgtctttagatttggatttccttccggttgtttcttctggcgtggtctttgatcttgctgtaggccttaccaaaggtttagatttctcttctaacgtcttagtcctctctataattttcgatgattcagaaactttaagttcgtatgaatttttaatggttaaacaatccttttgatcgataatgtcgtaatatggtatgaagctgtccatgggattgaaggcatagatgaaacaatcaattattgaatcttgctgtggaatgttggaaagatcatgaataattttaatagtttgatctttgtagcagcatatcactacgcagttgtatttggcattggtggtctgtttgtaatagtcaaacattaatttcttggccatggatgggccgatcttcaagtggtgaattagatccgtaaaaaggacgggctttacctcagtgaagagcttctcattgataaaatatgacgccttttgatccattaattaccgattgagttaactaaagcctatttctggttgttagttaatgtgaaatattatttcgagctgatctgattgcgatgtaacgaacttctgcgtacttttcaaaattaagagtttcgcgtgtttaactcatacgcgtttactacttccgtcggaaagttacaccgtagtggaaaatagacctattcgttagtataaccttattaaggtacttccattaatgaagtgttctatattgaggcatactgatcgagaattttcataaggtgaaacgataaaaatataaaaattaagcttagcgccgctcggtttcgatccgaggacatcagggttatgagccctgcgcgcttccactgcgccacggcgcttaacttttatgaatattttagacttaataaagattcatattgtaaaattaaaaacaacttgcacactgagctgtgttagaatgaaatcctactataatccatagtagtattcatgtcactagcacattacaaaatatgccataggaagatgacgtaaagattgagaactagtcatcagatataatagaagctgaaaagcaagaattgataatatcggacgctatcctacaatagcagcgcagttgcataatttgttatgtgtcgtctttattgtgtgtaaagctttatacacctttacctttgtgtagaagacaaagacattgttgttatcactatgtccacattcgctacgaggatattttcaacatatctagttgaaatacaaatctcaagccactataaaaactgcggaatcaaacaaatgtacaatacattatcctactagagactaatttctcaaggtttgcaatcccatctcttttcatgaggtatattgcggcacagaatggttgtacgaccattgctcaacgtttccgctcatagatcgattcaaataagattatagacatgtggcgattcaatgccaatccttatcccgaaattacggatgtattcagccaactttgcctatctacattattctgtcaactagaggctaaagacacgaatttcttggcattttttgtttgaaaacttgaaatggaagaaagacagaaagtaattttatgtaatctattatatttaagtagttctaaaaaaaaggagaaatcgacgccagatttcccaccttgagtagagtatcatactatataatatcaatgtacggttcacgcacccagttggcttagtctgttgaggggatgagtaattgttatatattaaccaaaaagggaatcatcttcgttgaaatcttttttgaaaaaccatttaaaaataacaatactagaatatatgataagaccaccgatcatgcacatgatacaactcaaatggccaatcaattggcaatgatagaaaacaacagggagtgctataccgcttgtcaccagcattcctgtaaggaagtgagccagatcttggccagtgtttgatgaatcggacatgaagtcagatgtgtgatatttatttcctgcattgaaaattgtgtttggtattggggcaagcaaaaagatcaaaatatcgaatagtgggtagtaattatggaataatgcgcagcttagtatgaccaaaaggaatcccaatgcgaggaatcctgacagagaaataatctttgtcaatggtgacactttgaattccatcataaccgtctgggattttatgtattaagattctttgccttttagatttgataaatatgcgccgatattagacgtgtgtgtgtgtgtgtgtgtgtgtgtgtgtgtgtgtgtgtgattccccttttctagtttttctcctactctttttttctcagtttttcgtaaagtggagtgaaagcccatctaagaaaaaggcataataaaatgtaataattttgaggagtacatttgggtatagaacaggatcaaactaattacaagagatacatggctttcccgcttaatgcgaggaaacagtacttatataaacgatatatgtttggggcgtgtatattatgtatataaatgttcttaaaaaataaagaaacaaaaatactggttagttattattatgttttttgtcattctttctagtttaacattgtggtagtaatttattaacaggaatttgctttttactgcttagtttcaccagattcggcattgttgccgttgttgttgttgttgttgttagagtcgttcttgtataattgttcaaacaatttcatcgaggaagtttgcaattcttcggtcttggtctttaactcctcagcgttaacctcttcgccaccttgtactctagcaaccaactccttcaaggaagtgatttgatccctaaccttttgggcttcagccttgtcaaccttaccttcaaattctttcaaggagttttcagtatcgttggccaattggtcagccttgttggcagtttcgatggcttgttttctagcttcatcttgagacttgaatttttcagcgtcgttaaccatttgttcaatttcgttttcggacaaaccagaagaaccggcaacagtaatagaagaatctttgtttgtagctttgtctctagcagaaacgttaataataccatcggcatcgatgtcaaaagtgacttcgatttgtgggacaccctttggagcaggtgggataccggctaaagtgaagttaccaatcaatttgttgtctctaaccaattctctttcaccttggaaaactctgatttcaacagaagtttgaccagcagcggcagtggagaagatttgagatttctttgttggaatagtagtgtttcttggaatcaatcttgtgaaaacaccacctaaagtttcgatacctagagacaatggggtaacatctaataataagacgtcagtaacctcaccggacaagacagcaccttgcacagcagcaccaatggcaacagcttcatctgggttgacggccttagatgggtccttaccaaacaaagatttaacggtttcgacaaccttaggcattctggacataccaccgaccaataagacttcagatatgtctgaagtagacaaaccggcgtctttcaaagccttcttgactgggtcgacagttctcttaactagtggggctgtcaaagtctcgaattgagccctggagaacttcatgttgatatgctttggacctgaggcatcagcagtgataaatggcaggttgatttcagtggaaacggtagaagatagctcaatcttagccttttcagcagcttctctaattctttggatagccatacggtcattttccaaatcaataccagtttcggtcttgaaacgagaaacaatctctctcaacaaatagatgtcgaaatcttcaccacccaaatgagtgtcaccgttagtggacttaacttcaaaaacaccgttgtcaatatctaagatggagatatcgaaagtaccaccacccaaatcgaaaacggcaacaactttagagtcggatttttccaaaccgtaagctaaggcagcggcggttggttcattgacgacacgtaaaacgttcaaaccaacaatttggcctgcgtctttagtagcttgtctttgagagtcgttgaaataagctgggacagtgacaacagcattcttaactggcttacccaagtaggcctcagctgtttccttcatcttgttcaagacgaacccaccgatttgggctggtgagtaagtttgacctctggcctcaacccaagcatccccgttggagtgcttgacgatcttgtatggaacttgcttgatatctctttgcacttcagcgtcttcgaaacgacgaccaatcaaacgcttggtagcaaatagggtgttttctgggttcactacggcttgacgcttggctggaataccaaccaaacgttctccctctttagtgaaagctactacagaaggagtagttctggaaccttcggcgttttcaataatttttggaactttaccttccataatggcaaccgcagagttggtggtacccaaatcgataccgatgacggaaccttgaaccttggttgactgcaaacgtgtggcaatacggaaagagctagacaagcttgacctgtttagtatgtttttagcagcaagcatcttggtgcgtataatatgagatttgtgtagtcttaattatattaaatgggtcgtaaatacaaaagttgtcactctggcaaaggttggtgagcagcggggcgtcgatatgtacagcaggcagaggaggacagcaacgtatggagttttcaaacgtggaacaaagaacccaaaagttcccaagcgtcgagccggcgttggatcgttcgtttttatacaccgcaccgtaagcggtcaccggaaaaagaggcagggggcggtggaaccgggccgaagcccatggaaaagctctgccgttgtgggtgatatacaattattcagcgcatctaaggcactagctttagcacattgtaccattgcgatgatgcggaagagtttaatataagcagatgttagttgcggtagttggtatcatgacagtgagctgaactacgtagcgtcgtgatttatgagtggcacagctaatagtaggaggaaggaggttttgcgcgtgcctgtgatagatttgaatagagtttcagatgaagagcagctgttgccggtggtgagggcaattttgctacagcatgacacctttctgttaaaaaattatgctaacaaggctgttctagatgcactactagcggggctcacgacaaaggacctgcctgacacgagtcaaggttttgatgcgaactttacgggtacattaccgctagaagatgatgtttggctggagcagtacatatttgacactgatcctcaattacgcttcgatcggaagtgcaggaatgagtcactgtgctccatatatagtaggctgttcaaactgggtctgtttttcgcccaactgtgtgtgaaaagtgtggtttctagcgcagaattgcaagactgtatcagcacctctcattatgcgactaagctgacccgttatttcaatgataatggtagtacacacgatggtgcagatgcaggtgctaccgtgctgcccactggcgacgatttccagtacctgtttgaaagggactatgttacttttcttccgacgggcgtgttgaccatcttcccctgtgccaaggctataaggtacaagccatcgactatggcgacgacggacaattcttgggtgagtattgatgaacccgattgtcttctgttccacacggggaccctccttgcgcgctggtctcaaggtatgcacactacctcaccactccagatagatcctcgtgcgaacattgtttcgttgaccatctggcctccacttactacgccaatctcgagtaaaggagagggtacgattgccaatcatttgttggagcaacaaattaaggctttcccaaaagtcgctcagcaatactacccacgggagcttagtattctaagactccaagacgcaatgaagtttgttaaggagttgtttactgtttgcgagactgtattgtctttaaacgctctttccagatccacgggcgtcccaccagagctgcacgttttgttaccccagatatccagcatgatgaaaaggaaaatagtgcaggatgatattttgaagttattgaccatttggtctgatgcatacgtagtggaactgaactctagaggggagctgaccatgaatctacccaaaagagacaatctaacaacgttgaccaataagtctaggactttggcattcgtggaaagggcagagtcgtggtaccaacaagtgatagcttccaaggatgagattatgactgatgtacccgctttcaaaataaataaaagaaggtccagctctaattctaaaacagtcttgagcagtaaagtgcaaacgaagagctctaatgctaatgccttgaataactcaagatatttggcgaatagtaaggaaaatttcatgtacaaagagaagatgcctgattcgcaagcaaaccttatggacagactgcgtgaaagagagagacgttcggccgcattgctttctcaaaggcaaaaacgttaccagcagtttctagcgatgaaaatgactcaggtatttgatattcttttttcgctgaccaggggccagccttatacagagacatatctaagctcgctaatcgtagatagtttacaagatagtaataatcctatcggtacaaaagaagcaagtgaaattttagctgggctacaaggtatcctaccaatggacatatctgttcatcaagtggatggtgggttaaaagtttatagatggaacagtttggataaaaacagattttctaagctgttgcaaatccacaaatcaaaacaacaagattgaagaatatttttagatataaggtagaatacgtacatttacggtaaaaaaaaaaaaaaaagaaaaaaaattgatcttgatacatacgttggtattttactttgaagactgtgcattgtgtatgtacgaaaagaaagggaaataaaaaataacgacaactgcaggactcgaacctgcgcgggcaaagcccaaaagatttctaatctttcgccttaaccactcggccaagttgcctttaatctcttgagtttgtttaaggacaacactgtccacctggcatgggaatattaccattattccagattcgggcttgttattaggactttttaccagcttgatttaccggtcattacttatcctacacatcatacatcacaactacacttggtgaagaaatcacagagccttggatttgtaacaattatatgtttacgcaatttatcttgggaaagcagggcctcatttgtggacatagcacggtctgtcaccctcgtcgtgcaaaaaatattttgacttctactctttttgaagtttcgttgatcgggtcccttccaaggaaaagtcgaatgctgtcactgcgcatataaaggcgagaacgatagtgactgtgatattaagttattgtcatcatataagtaattttttctctgatatctgtagccctagtttttaatattttcgtaaaatgctcaaaaaaatttctgtttaaattcttctggggtatatacacatgttcccgtcagctaaattaaaaagaagaaggaaccgaaagaaggcaaattataaagtaatcatcctcggcatattgaggggaaaatatccgtcaaaaaaaaaagttctgcacgtcgtcataagtgactatggtatcaaacaccaattaacacgaacgtagcgataatgaaggcaacttcgtagctgaaacagaacgaagttagttaggatgaataattatgattatgattattataatattatataaaatgtataaataagatttctagatcaaaaaaacatcgcgtattttgtaagctatagaaatctaaaatatctaatcagatcttggagcttccttgaaggagatggcagcttcttcacccatggcagaaatgatagtgaccatcaaatccttaccttcatcgaaagcagcttgcatgctgtcacccaattcaccttctggtgccttgacatcgtctttggtttcaccgtccatggtcatcaaggacaagtagccatcatcaatatccaacaattggtattcgcttctcttgacaaatggaacttccaagttgtgagtggatggagacaaatcttccaacttcttaccagtgaagatatcaagggtaaccaaatggaccttggcgtgaccgtgcttaccggtcttggaagtggacatgtcgacaatcttacatggtctacctttgatgacaacgaaaccattctttctcaaggcagaacattgcattgggtaggtggcggaggcaccagcgtcagcattttcaaaggtgtgttcttcgtcagacatgttttagtgtgtgaatgaaataggtgtatgttttctttttgctagacaataattaggaacaaggtaagggaactaaagtgtagaataagattaaaaaagaagaacaagttgaaaaggcaagttgaaatttcaagaaaaaagtcaattgaagtacagtaaattgacctgaatatatctgagttccgacaacaatgagtttaccaaagagaacaatggaataggaaactttgaacgaagaaaggaaagcaggaaaggaaaaaatttttaggctcgagaacaatagggcgaaaaaacaggcaacgaacgaacaatggaaaaacgaaaaaaaaaaaaaaaaacacagaaaagaatgcagaaagatgtcaactgaaaaaaaaaaaggtgaacacaggaaaaaaaataaaaaaaaaaaaaaaaaaaggaggacgaaacaaaaaagtgaaaaaaaatgaaaatttttttggaaaaccaagaaatgaattatatttccgtgtgagacgacatcgtcgaatatgattcagggtaacagtattgatgtaatcaatttcctacctgaatctaaaattcccgggagcaagatcaagatgttttcaccgatctttccggtctctttggccggggtttacggacgatggcagaagaccaaagcgccagttcatttggcgagcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaataatgactgaattcaaggccggttctgctaagaaaggtgctacacttttcaagactagatgtctacaatgccacaccgtggaaaagggtggcccacataaggttggtccaaacttgcatggtatctttggcagacactctggtcaagctgaagggtattcgtacacagatgccaatatcaagaaaaacgtgttgtgggacgaaaataacatgtcagagtacttgactaacccaaagaaatatattcctggtaccaagatggcctttggtgggttgaagaaggaaaaagacagaaacgacttaattacctacttgaaaaaagcctgtgagtaaacaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagcttcgcagtttacactctcatcgtcgctctcatcatcgcttccgttgttgttttccttagtagcgtctgcttccagagagtatttatctcttattacctctaaaggttctgcttgatttctgactttgttcgcctcatgtgcatatttttcttggttcttttgggacaaaatatgcgtaaaggacttttgttgttccctcacattccagtttagttgtcgactgatactgttaataaactcatcgggcgaggcttccacggttggaaaagcatatgggctggcgcatatggttataaaatcacctttttgcaattcaattctatctttcccatcaaaagccgcccatgctggagcccttgacttcatcgagactttcacttttaaatttatactttctggtaagatgatgggtctgaaactcaatgcatgtggacaaatgggtgttaaagcgattgcattgacggttgggcataccaatgacccacctgcactcaaagaataggccgtggacccagtcggagtagcagcaatcagtccgtccgcctgcgcaacggtcattaatgagccgtcaccatacaattctaacatggatagaaaaggacttggaccacgatcgatggtcacttcgttcaaaatgtggtgtgtgcttagtttttccaccacacatattttcttccccgtgtttgggtctacttcagggcggtgtctacgataaattgtgcactccaacctcaaccgtaaatttgtcttgattttatgattcataatccgaggtaaatcctccctgaaatgttcaaacttaaaatttgttaaaaatcctagagaccctaatgaaaacgacataacgggtggtacatgtctctgaaaaatggaacttacaaaaagaacagtaccgtcgccacccaaagtcactaccaaatcgaagaaaacatcatgttccctgatgaaatcctttgtccaatacttgatccttgattctctacatttactatcttcacataactcgccagcggcaaattttttgctgtttttcaattcggaatccacataaacagtcacacgtggaaaatgtaccaaaacccattctaccaactctcttgttaagaaatacagtgagacatcgttgagtttcgtaacaatcatcaaattttccacatccagttccactttggtattagatatatctttactcaacattcttacaccatacgccgtggaggcatactgaaagtgtgtattactactcttagaacttcctcttgttccgttaatgctcgtaccaccgccactgtttgcattgccgttcacgagagatgaatctttattcaacagggagcttctgcgcgagctgctttcacttgatattttcctcaacatttctttggcgttgtcgatatcctgagttctatcaatttgctcattgttcatcatggccttcttcatcaagttattattgttgttatgatgatcatttcgaccatcttcctcatttacccatttatctacgccattattcatgtcattctccttcatctcaagagcttttactctacttatttagggagcctattgtatttttttttggcttacgatcacgatgtcaatgatcatttgccctattatacctttttctccgttctctttgcgtagtgcggtgaaataatttcaggatgcatgaaagagcaaataaaagtgacacaccgttatatcgcaaggcgcaccacatcagtaatcagatacctgtgcattcaaaatgagtagaaatgtagataaggccaactcagttctggtacgatttcaagagcagcaagcagagtcggcaggtggatacaaggattattcacgttaccagaggcccaggaacgtgtctaaggtaaaatccataaaagaggccaacgaatggaagcgacaagtaagtaaagagataaaacaaaaaagcacaagaatatatgatccgtctttaaatgaaatgcagattgcggaacttaacgacgaacttaataatcttttcaaagaatggaagagatggcagtggcacattgaccatacacttatggaaaaaaaaaccaagaggaaaaggttagaagacagtcatgtgctgatgaattcaggaaagctgataaatggtaagagatattttggaagagccctggaattgcctgaagtaaaagaatggctcaagcagtctcaaaggcagaatgatgggggttctataaacaccaaatgcataccgaaggatagaaatgatttttattaccatggcaaagtcacagccgccttaaccgaatttgaggctaactggacatccattttgaaagcacattataatgtgcctgtgaatgaagatgaagaagaaatgtcaaggcagacacaagaaatccatgtaccaactctggcagatatggagcattggttagtgcaaagaagaaaaaagaaactaatggatgaacttaacctttagctatggaaaattattcaaacatttagaagaggcactatttcgaatgaccatcacaagcattataatcttcaaacatgtccgagctgcagatatgaagtaaaatagtgatcgggactcatttttttttcttctatgatatcatattgtcccgttcgttattaaatgtaattcttccaccgtactagttatcgaaggcaagatctcctttttacgcttaggtagattacatagatttcataatgtacaccaatacaaatgtatcttatacactcgtcaaatcttatatgaatcatgcaggagtagctctcgttttctttttacgagctacttgaaaaaaaaaaactagcgaaaatcctttgcttagaaatccagatttaaaacaaaaccgccgaaaagggaaagattttatgataggaaataccttaataattctatatcatcccgagtcttaggaaaatgattagatctgtgagaagggttttcatttacgtctcaatattcgtattgataatagttttgaaaagaacattaagtggcacagatcaaacgtcaatgaaacaaccagtggtggtcattggctctggtttggcaggcttaaccacaagtaatcgtctcattagtaaatacagaattcctgttgtgcttttggataaggcggcttctattggtgggaattctataaaggcttctagtggtattaatggtgctcacacagacactcaacaaaatttaaaggtaatggacactcccgaattgtttttgaaagatactttgcattcggctaaaggcagaggggttccatcactgatggataagttgactaaggaatccaagagtgctatcaggtggttgcaaacagaattcgatttgaaattagacctccttgcgcaattgggcggtcactctgttccaaggacccatagatcttctggcaaattaccaccaggttttgaaatcgtgcaagcgttatcaaaaaaactaaaggatatctcttccaaagattccaatctcgtgcagattatgctaaacagtgaagtagtggatatcgagcttgataatcaaggtcatgttactggtgtagtatatatggacgagaacggaaaccgtaaaatcatgaagtcacaccatgtcgtgttttgctcaggtggatttggttactctaaggaaatgttgaaagagtactcaccaaatttgattcacttgccaactactaatggcaaacagactacaggtgatggtcaaaaaatcctttcaaagttgggtgccgaattgattgatatggatcaagtgcaggtacaccctaccggcttcattgatccaaatgaccgtgaaaataactggaagtttttggctgcagaggcattgaggggtttaggcggcatcttattgcatcccaccactggaagaaggtttacaaatgaattgagcaccagagatacagtaaccatggaaatacagtctaaatgtccgaaaaatgataatagagcacttttggtaatgagcgacaaagtctacgagaactatacgaataacataaacttttatatgtccaaaaacttaatcaaaaaagtgtcaatcaacgatctgatccgacaatatgacctacaaactacagcttctgaactggtaactgaactgaagagctattccgatgttaatactaaggatacgtttgataggccattgattatcaatgcctttgataaagatatttcgactgaatcaactgtttatgttggggaagttacaccagttgttcatttcacaatgggtggtgtgaaaattaatgagaaatctcaggtaattaagaaaaattcggaaagcgttctatctaatgggatatttgctgctggtgaagtttcgggtggtgttcatggagccaacagattgggtggatctagtttgttagagtgtgttgtctttggaaagacagctgcggataacatagcaaaattgtactgagaatttatagggaaataaaagatatttttgcaacgtactttacatttcaataattaatgcgacatgataggatatactgtttgctatttctttccgtaacgatatacgattttttcttttctttggagttccaaatgaagaatatatcttgttgggaaaagctatagtattaggtttacagaatatggtagaggtttctccccgacgatataggaatctacaagagagagcatgattctacacgataatactgcaatttcttctttgcgttgaagtgtcaccattgcctatccttttacattatcaatgtcaatgttccctcttctaacaaactgaatgacttttctacacgattcatattatcttcttgcgcagtaaattatgttaacgtaatagtagggtctcttgtgcttcattattttgtaactgtacacataattgacacgtttaacaattagtgagcgcaagtggtttagtggtaaaatccaacgttgccatcgttgggcccccggttcgattccgggcttgcgcagtttcttttctttttttctggaaaataagaaaacttatttatggaagcaaaaatggaataaaggattgggacgaagttagtgaaaaaaaactgaaatagtcctagagtaactccgaagtgtctttgtataagctattatctagaaatcacgagaggggaagaaatgtatcgcagtagaaaccgaccaaaaagaggtggagaaaatgaagttaagggaccaaattctgccttgactcaatttttaagagaagaagggatcagtgctgaaaatatcaaacaaaaatggtaccagcgacagtcgaagaagcaagaagatgcaacagacgaaaaaaaaggtaaagcggaggatgatagctttactgccgagatatctcgagtagttgaagatgaagaaattgatgaaattggaacaggtagtggtaccgagacagaaagagctcaggtttcctacgatgccaggatgaaattagtccctgctgatagtgatgaagaagaatatgaaactagccacatttctgacacgccagtcagtttaagttcggctaatgaccgggaatcattgactaaaaaaaggcaaaatactgcaaaaattatccaaaatcgtcgcagaaagcgtaaaagagcagctgacctattggatagacgcgtcaacaaagtatccagcttacaaagtctttgtattacgaaaattagtgaaaatatatccaagtggcaaaaagaggctgatgaatcatcaaagttggtatttaacaaattgagagatgtccttggtggcgtatcaaccgctaatttgaataatttggcaaaagcactatcgaagaatagggccctgaatgatcatactctgcaacttttcttgaagacagatctaaaaaggttaactttcagcgattgttctaaaatttcatttgatggttacaaaacgctagccattttttcgccacacctaaccgaattatccctacaaatgtgtgggcagttgaaccatgaatcattgctttacattgctgaaaagcttccgaacttgaaatcactgaatttagatggaccatttctgatcaacgaggacacatgggagaagttctttgtaataatgaaaggtagattagaagagttccacatttctaatacgcaccgcttcaccgacaaatcattatctaatttattgatcaactgcggttctaccttggtatccttagggttatccagactagattctatatcaaattacgctttattaccgcagtacctagtcaacgacgaatttcacagtctctgtattgaatatccattcaatgaagaggatgttaacgatgagatcatcataaatctgctaggtcaaatcgggcgcacgttacgtaaattggttttgaatggctgtattgacttgacagattcaatgataatcaatggtctgactgcattcattcctgagaaatgtccattggaggtattgagcttggaagaatcagatcagatcactacagattcactgtcgtactttttcagcaaagtagaactgaataatttgattgaatgcagctttagaagatgtctacaattgggcgatatggcaattatagagctattgcttaacggagcaagagatagtctgagaagcttaaatctcaattcattaaaagagctaactaaggaggcatttgtggcgttagcctgtcctaatctgacgtatcttgatcttggttttgtacgttgtgttgatgactcggtgattcaaatgttgggtgagcaaaatccgaatttaactgtaattgatgttttcggagacaatttggttactgaaaaggccacaatgaggcctggacttacgttgatagggagacagagtgacagtatataataaaataaagacatataaaacgtgtattagatagaaaacggaaaattgactaatgtttttattcctattatactcagatcgtcaaatgttgcctttattttctattgaagggattttatggcatctcgcgaataataaacaaacaataatagtaaaaaaaaaagtgtaaacttatgtattcagcgcagataaaaggaaaaaaacgagaagtttgacgtaaagaaaaaagttcgaaaacttttgtagcagttgaaagttttgtatgctatgtcaattaggcctctcacgttaaacggtttagatgagccagaaacctcttttgaagaactgaatacaactctacctcgctttcaatcccatgaaacattaactttggaagaaaacgtgccaccattgagtacatcaacttatataccgcctccatcctcggtaggtacttctgacactggcacggtattttccaatagtaccagcgcgttttggtctaataagcaagcagacgatgatcaggacatggaggtagaccaggatgatgaatttctaaatgacttccaggaattccaaaataaaaaggatgattttgacgatgctattaaaacaaattttcatttgagaaatggatgtcgaactggccctttcaaaaacgacattttcgcagaagagtttgatagaaaactgagtttggaagataaaccaaggctaaagcaacctagatcaatgatggaattgaaaccaaaaagaaaactatcaaatagcgtcacttcaagaaacttaaggtctggtaattctgtaagatttaagaaatctatgcctaacttagctttagttaatccagctatcagagaagaagaagaggacgaagaacgagaaagagaagatcaacgagagtttaattacaagattgataacgatacgcaggacacaattttggcgaaattcagttcagatgatgaaggtgactttctgacaggatttgaagaattagagggtgaagcaattgatgaaacgatttcttcgaacgataaagaaagtgccgaccatccgcgtttcttaaagaagtcatcctcatctttgccattaaaaatatcacctgcacaatatgatatagtaaagcatgacgaattattaactccaggtcttcataggcgacaacgagattggaatacccagcaggaactggactcttttaaagaaaaacgatcagtaagacactgttctaatcaaaatgtacaactcaatggtccagctaaaatcaaaacaataaaacagcaaattgatcataatactccaatgaagaaaggttctatgatatataacccgaaaactatgaagtgggaaggaaatgaaaacgtcttaagcaaatttagtgatgtagacacggcaaacaggaaagctttattgataaaaaacaagctacaacgagatgcagattctaagaagcaaaaatattctgatctacagcatgcaagagccacttcgagaaatcaaaaggtcatcgggaacatgattttagatgaacaaaatttaagatgggttagtgtttcagaggaagaagcagacccttttgcaggcattcctgagataaacttaccaccagttggcaaaagtatgaaaaaacgtagctcctcaccatttttgcgttccaaaagccaagttaatacgccatttgtttcaaatgacaatgatggcgtttatcaaagtacggctgctcaagcaagactccgtaaataccattcaatgaggacacttaacggtacaacagaaactccagaaataagctctactttccatttgagttcaagagcattggaaaaattttaccacgaggagaacaggtggtgtaaaaagttagcctcatggtttataccccgagatgagaccattatcagtgttgatgaggaaacaatcatggatgaaagtacggtcaatagcaagagaaaatcctatatgtatgaaatcaggaacatggtaatcaattcgacaaaagattagccctttagccttcttataactgtttctttaccgttatcttgagtacattcatttctcttacattccaaaattagatagaaccttgaatcgtgtcaacttttcgccgacatttcgcgtctgacagaaaaagaaatgttgcagaaaattcgaatagatgtttcaaatgaaaatagaccatgagggacacattaacatttcaaacaaaagagcccttgatgattattaaaacagatctttatggtttgtttagcaaacactttggtaatttcatgaatatttgactagcaggaacagaaaatcaaaaatgtttaaccatgattggaagtactccattaattctaagactttcgccgatttaaacattgaattatttcgaaaccacaagttcaaaactgttttaaattacataataggtgtagttgggtggaatggattaaaactcgccctttttgtttctgacatttacacatgtatcaaattgctggcattcaactcctggtcaaacaacatcatcaaaccatacttaccctttaaaatatccaaatggttgtttagcggttgtattttagcatcgattgtgctattgatatgggaggctatagcgggaatgaggatttacaaaacgggaaatatctctttgacttatgtcaacaatttttccagaaacctaaattcagtgctcaattattccaagttttgtgtttataatatgatcgaacgaaagggttttcgacagaaaatgacattttttactttttttcaactgaaagattgtattagattaatcttcacggataccccaaggcaagttattaatggtcttacgctgtggtcagttctcgtaacagtaaataaaaacgaggatctaggcgatctggaatcatttaccggtttgatcaacaaaataaagaacattggccagaccaatcatgaagaagcagtgatattgtcgctgatgctattttcctttataatctgggcattatttgtcttcaagtttctgcttgctgtcatttgctcgatttttgtttattataaaataatcaatgatcaggaatatagcgggttgcgtgagtacatttgtgttaccgtcagcgaaaatgttgatgaacttgttgaaagacaaaggaaaaaggaaaatgatgacacgatttataagacaggtcttctcgaatctcagacttttgacgattttaaagaagttgaaaataaaattgaaacatcttttaatgatacgtcatatgcttctaataatgattctatgattgagctaatagagagaagacccgaatacaaaagtcaggatgtatgtgggcccattcccacaatgaagaaaacggaaacaatggaatcgttcgttgacaatggcaatccacaatataccactagattctctgcgattctagattcaccatatatcaacagctatgaaagtaatgatataaagaaagcaaaaatacaaagcagaagcgtaaatactccaaaatatgaggatttgtcttcttctgacattttcaacaaaatacactctgctggacaattaaaatctacaacttctatggagtttcacgggccattagattctatgccaaatacaacaaacaacatccgtaattttaatagcaacagtagtagacctagaccacctcctttacagacaaaaagttcgattaattcaaaagctgactcgaatgataatggaaggatttatacaccaatgaaagcgtacttcagggagcctgatcttccgaggaagggtttgctggaagatgaagatcgtacatataattatacttaataggctggcaaaagccctttgcatatttcatgaattagatagacgtgattagaaacagccgttagtatgtttctgataaaaataatactttttttgtaacactattttcatatattggattgataccggttatagcacaaacataacagccatgaaagtttctttgaaaaccccttttaacatttgcttgtaagagataggttaattttttatagttgctgagattccattgttggtaaagacttaatattaggtatacagaatatactaggagttctctctgggtatgtaggaatccacaaaagggtgtcactagttcaacataataacatcttttttttattccttctttgatattttgtcatattatcctattattttatcaatccttgcatttcagcttccaatagatttgatatttgtttctcaatattatgtcatcttcatacacagtatgtgataatatactagtaacatgaatactactaaatgagtactaccttaggggttcattacagcagcttaagcgaaagtagaaaatgaggcggatatttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctctacaatattgatttccatcgtgtaagttttctgcacgaagtttattcattcaatttgaagtgcttcgtaataatattactatgcaacttaggtacctcatatttcttagagttcaaccaagttggttccgttggcgtaatggtaacgcgtctccctcctaaggagaagactgcgggttcgagtcccgtacggaacgttgattattttttttttttcgtttctttatagaaaaaattcagacgatattaccttgcgatgagataatcttaccgcagaaagagtgccacagtggtaataactagttgaaggttcatattatataaaaaactctaagaataaaaatggtatctagtgcagttaaatgtggcatatgtcgcggagttgatggtaaatataaatgtcctaaatgtggcgtacgatattgctccttgaaatgctataaagatgctgcaaagcatgttcataaggaaagcgaacaacccagggctggtacagaagctaatgtggaagttgttaataacgataagatcataaacagttcactcgcaatgaataaaacattaaagacgaaggcattcgatgatatatatcaaaatagcgcagaattgcaagagctgttgaaatacaacacggtgaagttccatttggcaaaggtttatagaattttgtccagtactgttaacgatggaagttctggaaaaatgaacagcgatctacaaaaagaactagctgtaaattatttgaatacattacgatatggtggtatacattataatgaagcaattgaggaattttgccagattttattagataaattaaatgcggtgaagaaataagaattatcgttgttagcatgatttttaagattgagcattttattcatttttaaccatataatagtgaaggtgaggactaataacaaagtacttgttgaaagggtcgggttgcttttaggttttttcttctcgttaaggatttcccacttgtctggcaaggcgtcaagcagacttggaaaataatgatattatgtcagaatttttgtgtgaggcgcttctattgcaagtttgtgacaccttataataaaagtgaaccatgtatttacatatgattagggaaagttccaccatcatcttatgatcttcatggccgttttggtcttctttttaacttgaagtccaacttggcgactgtacatatatacatatatatagcaataagtataacaaggcaacaaatcaggtcccattatttaatttgaagtcatctactgccccataagaacctctatattatcagtagattctttcttttagggaaatcgaacctcgatattgtaagagaaacccgcgccactcctaaaaaggtattttgaaggagaggatgatttggagcaacatttggtacactttatcctcagtttttcgctaactacctcgcaacttgttgttgtggatgaaatttttgatattaatttcaataaataaaatatatgcaaatatcattataatttgtcaagtgcgggaaatagactatgcagtgatttagtgtgcaagtttgcccacttcacattcataccaaatatttcttcccactcatttttatcgtattagcactacatacgtgactttttagctcagctttcggactggatagctttactgacttactttctacaagcgatatcattcgtcacagtactccaaagaagtctgggcatttaattttcttctttatcaagtccgccattatgaaggaatgtattgggtaatagttgacataccgatgttctgctggtagcatcgatgaacgaaaataggtaacggcttgccgctgaagatattggaaatgagacagatcattctagggtaaaatgcgctgtagagctagcgtcaattgcgattttcgaacactggctgcaggtatttctgttttctcggctttcattatagtaatgtgaagctactaggagaatcacgaaacatctttttagtaggatgagaacaccacgctctcctaactggaagtaatttttggtatgcttagagatctgttcctctcttatgacttctttttcgcctactataaacttaatatcaacatatttagttagttttttcagagcaatacgtgtttattttttcacaacttcgcatggcattatgtatcattgcagcgtaaatttttacatttagtaatatctaataacatatacacaaaaaagggacagatttttgaattaaataaaccaagcgtaaatcagtattgctcttaccgcagtagggggagttatctactcctgcttaacgtagagaaacaatagtaaaagttatgcttgtgttggaataaaaatcaactatcggctggcaactaatagggacactaccaatatattatcatatacggtgttagacgatgacataagatacgaggaactgtcatcgaagttagaggaagctgaaatgcaaggattgataatgtaataggataatgaaacatataaaacggaatgaggaataatcgtaatattagtatatagagataaagattccattttgaggattcctatatcctcgaggagaacttctagtatattctgtatacctgatattatagcctttaccaacaatagaatcccaccaattatctcaaaattcaccagtatcttaaagagaatgtggattttgatgtaattgttgggattccattgtgattaaggctataatattaggtatgtagaaagtactagaagttctcctccaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacatatctcaacattaattactcggaacttttttttgatttgttatataataacagaaaatccagatttgtacagaaagaaaatccgtgatagtttaatggtcagaatgggcgcttgtcgcgtgccagatcggggttcaattccccgtcgcggagatttttttggctactgttgcggttacatataacatactttttgcatatatcgtaagttatcagacaccatctggctcactgaaagtttatttctatgtgctttctgaaacgtatgtatatatgagattcaaaaacaatatttaaatattttcgatattatacctacaatgcaatgggctccttctaacttgagaacctcttcccgggtgttcttacaggtccatatcctggcggaaactccttatgtctacttctgaatcagaatccaatttcggttttttttcataatgtgtattttcacgatcacgctcacgctcatgtccaagtcccgttatgtcatttaggtttctcgtgtcccctcttccgtgattgattgttcgtgctttccaggattttatacgactagcattcctaggaggatgttcgacacttaaaggcggcatagaaagtctaaatttaggtgctatattttcattaatatttgagaggtccccatttgattcgttgaaactgaaattatacttgactgcgctgtctttttcaaaaggttccttatgagcttcattttcgcggtgttggttttcactgaacttattaagctttctttccctttctttcaccggatttaaagatttatcctgcgagtttgaaaggatatcatttcttcgtttatagcaccaagcccttaactcgtcagcagtcacatttgagtccaatgcacatagtatatcatccaaacaggtgaggtagccctgatgtttggttaaagagtttttctcattagccacccggtaaagtcttgtcaccgcattggcggctagcttgaactcttgagaaagttccaaattaagactctcaatcgcttgctttgtaggaggttgctctggaggtaaacttgattccaatgaatgcatttgctccataattgaatatattctgctcttgaattagatatgtgtcgtcggtaaaaaaggtttcttgaaatgtaattgtatgagctgccacgatgctaaactgcaaaacgacgtaagacaagtacagtagaatgaatggctgcgcttcaccaccaatgatttgtatcaggctaacgtgcacttggaaggtggaaacgatgcttttgtccagatgcctttacgagtaaggaaaaagaaccatttgaaattttttcaagcgcacttttagaacaaattcgaaaagtgaagaaaatataggtggggtaacaaggaaaagaggctacaagagttcgttaatatattatctccgtattgtgtaaaggaatatgtcacaatttgataataactcttcgttaagagcttgaaagaaatatttcaacttgcaagtctgggaagtgaatggagacataaaaaacaaaaaaatctcccgggggcgagtcgaacgcccgatctcaagatttcgtagtgataaattacagtcttgcgccttaaaccaacttggctaccgagagtatttaattgttgaagaaagagtatactacataacacatatacaattgaaaaagagatttcaaataattatccggtccttccaagatggttcagagtgaaatttatactaaagctaagggatggaagagaatactgacaaattaatgaacaaatacttgaaatgagatagcaactgaggaacaaacgtaagtattttcaacggaattagaaatagcgacatcatgaccagcttattcgcaaatgtgattttcggttgggaagtattaagtcagcatcatcatatgaaaatacttcataacttttctggaggataccttttgaagagagaaacctgtattttgcacagtggattagagccgaaacttcatatgctgctgcgttattttccatagctatagtaacgttggaacaagaatcaactattacctatcgaagagttttcatgttactattatattatcccatactgtgtaagaagataacataaggattgagaaacagtaacaaagtctaatgaaagctaaaaatgcaaggattgataatgtaataggataatgagtgacaaagtatcaaagaaggaataaaaaaaagacattattatgttgaactagtgacacccttttgtggattcctacatacccagagagaactcctagtatattctgtatacctaatattaagtctttaccaacaatggaatcccagcaattatcaaaaaattcacctttcttccaaacattaatttgttccacgggtccatttttataattacgaaataattgtgcattggtaacaaagggagaaagcgatatcctaaactagtaggttacagttgataatataaaaagttggaaaatagcttagaaatgaagaagagaataacggcttctatgcggttgtgacttttgacgcgttaggcgtggtgctaaagatggcgaaaaaatgtaacgtcttcccaagaagtacgcttctaaactaaatatgattcatagtggacagaaagatcaccattttgaatgatgggtcgtggcaaattaatactgatagaaggattggataggactggtaaaaccacgcaatgtaatattctttacaaaaaattgcaaccaaactgtaaactattgaagttccccgaaaggtctacccgaatcggaggactcataaacgaatatttgacggatgatagtttccaattatcagatcaggcaattcacctcttgttttcggcaaatagatgggaaatagttgacaagataaagaaagatttactagaaggcaagaacattgtcatggacagatatgtttattctggagtggcatattctgccgctaaggggacaaatggaatggatttggattggtgcttgcaacccgatgtagggttgctgaaaccggatttgacattatttttaagcactcaagatgtcgacaataacgccgaaaaatctggatttggtgacgaaagatacgaaactgttaagtttcaagaaaaagtgaagcaaacttttatgaagctattggataaagagataaggaaaggcgatgagtcaatcacgattgtagacgttactaataagggcattcaggaagttgaagcgcttatttggcaaatcgttgagcctgttttgagtacgcatattgatcatgataaattttcgttcttctaggaggatctgtacatatatcctagtctagtctatctaaaatacttagtctttctaacagcatatcctttgaaatttcttgtatttcccctccaataaacatctcgtccattatcatatagactttgtaaaagttgaatacgatatccagttcacagacattgccgaaaaatgcatctagcacctccacaaacagatggatgtggcacaaatatatgggttcatcgtcaagtaagtccacacccatgacaaaatacagacccgcatacctcctgtatatgagtttcgtcgaatcggaaaactctacgaagttactctgatgcttatgatctctggaagatatgagtctataaatctgcgcaatggcatcctggctacgctgaggatccgaactgtgtacatcgaaccatctcaccaaccgcaccacaccctgcttattaaagcacagtataaactgtactgccattttttttatcccttacagcaaacaagtctccgttcttcacaaaataacagcaccaaacgctatctcaaggcaaacgttcttaatgtacctactgaataaaccattcctccccgtttgtatcaaaagtatccgaaactgttctatgcgtgcaaaatgatatgtcttgcaaaactattggaaagacccttccactacaggtacagtttagaaatgccggagctgcaagtactacgtgccggcagcatgataaacatacccgcgtcctatagccattcaagcctacatatatggtatatacaacatgaacgctttagtacggtcaccccatctacaagcataacctcttgggcaaaggcgcaaatagttgccacgtgcgagtgcggtgcatgggtggctgtcttttcgtcattggcacgaccccttgcaggtgggaggtagaaccaaataatatccggttgacggtaaaagcaggtttatatatagtgttaaagaaaggtattgtcacatcccgtcgctacccttatccaaaccacgatatcgcacgcacaccaggaaagtaaagttgtgtaagccgtagcagttttttacaggttaaccgattgaataagataatggcgggaaacggtaaggacaaagaggtagataaaagtccctctgttagtactttgaaactattgggaaaacgcctgtttaattccagcagtcacacggataactcttcgttactgcttagtgccgaacaattgggcaatgggagaagtttaagaaaaaggccaacgtctccgtccattagtggcagtggtagcggtggtaattcaccttcgtcttctgctggggcacggcagagatctgcttctttacatagaagaaaaaacaatgcttctgtaggattttcaaatgggtctgtgtcgtcacacaagtcctctgtcgcattgcaggacttaattaaacataataataacccttacttgaactctccctctgatattctgggcacaggtactggcattgcctcgacaagagatagggatagagcagttttggatagagaaaaggaaaaagaaagggcgagaaacaaagaaagaaatactcatcacgcgggcttaccgcaaaggtctaatagcatggctagtcaccattttcccaacgagaatatagtttataatccatacggcataagcccaaaccatgctaggccagatactgcatttgcagacactctgaatacgaataaggagaacgatttgagtttttacatgcatgatggtaacagcaagatacggatgttgccccttccaattgctaatccgaacgattttttgcccgaagatatgaaacaatatagtgtccatttaacggataatttcgtatttgatacggacaataaacctattggttcgggtgggtctagtgaagttagaaaggttaaatcaagttacaggcaaaaggatgtttacgctctaaaaaaactgaatatgatataccacgagtcacccgagaagttttacaagagatgctccaaagaattcatcatagctaagcatttaagtcataacgttcacatcacgaatactttttatcttctaaaagttcccacgaccacatatacaactcgtggttgggggtttattatggaactaggtgttaaggacctcttccaactgatggaaagaacaggctggaagaacgttcccttcaatgaaaaatattgtcttttcaaacaagtggcccaaggtattaagttttgtcatgacaatggtattgctcaccgtgatttgaagcccgaaaatgttttaatttctaaagaaggtatatgcaaattgacggatttcggtatttctgattggtaccatgtgatacctcatgactacactagtccagtgaaaacatgccaaggtatgattggctctccaccatacactccgccagaggtaatgtacttcgatgccaagaagcactaccccgaaaagttccaaaaaccctataatccgttggccatggattcctatgccctcggaatcatgctgattaccatgattaacaatatcatccccttcatcgattcttgtaacactgatgcgagattcagggaatttgaagtgtcatatgacaacttcatcaatcatcaaaacccacatttcagggacaagggctgccacaagccgggtcctggttccgaatactctttagcaagaaatttcaagaatactgatgccacgcgtatcgcatggagattggctgacccgaaccctgcaactagatatacaatggatgatttatttaatgatccgtttttccaacaaattgaaacatgtgtcgagccaaatgatgatgacttagtaagggttcctgaattaaggaaaagtacttctaccaatgattttagtgaaaattcattagatgcaccccatgatcaagaggtcattcacacgtctaatccattcctaaaaaaggaaacgctcacttctaaaccaagatcgatgttggaaattgcagaatctccttccttgaaacaaaaatccaaggtaaaagatagcgcaaagaccaaaacacacgatgttggggatgaaggggggaatgaaagcaccaaacctaagcagcaagataaaaaggaaaatttgaagaaagatgaggtcaagaacggcgacaaggacaaagtcattgaagaggctaccacgactaatgtggacagcatattggaaaaaccaacaccaacctccacaaaagtagaggacaacttaagcgaagatgattccacaatgaaggaattaaagtcgatgctaaactccacccctactacaccaacacataatggccccactccgctccctgcaaaggctggcactcaattagataagcgtatgagcgacctatcactcaaatcggaaacaccggcttctacaaagaactttagcgcaccgaatgtttcgtcatcaagcaattcactgagaagcctcggaagtccaagcgtgtcatcctcgaaaaagaagaaggtaattcaccaccacttggacattaccaacagcgttacaaacatgtcatccgtgagcgcctttatctcaagatagacgttaggacttctttaattccctcttttatgctttagtatcgtcatattctttcatacccttccttataagctttttatataaaatatcccaccgggaaaagataaagaacggaagataaatcaaacaatgaaataaagcacacacatataaatccacatatgtacttatatattttacttcaaacaataaacaaacattttattatttatttttcccgtacatcgatgtacgtgatcggtttttctcattcctctcggatccttcgggaccaccatgtctcacccaccaaggtcaaaaaaaaaataaaatcggacgagaaaagtattgggcaaacaacaattatccacgtgcttatcacgtttttttatttaatgtagaatgtaaaccattataccttaaagataaacactttgttaattaatcattttagttggcggtcattttcatttctgctacaagtaccaacatcaagtgcttaaaatataatacggttttctacacttttattaacgatgaactctctggcaaataataataagctttctactgaggatgaggaaatccattcggcaagaaaaagaggctataacgaggagcagaactacagcgaggccaggaaaaagcaaagagatcaaggcttgttgtcacaagagagcaatgacggaaatattgactctgctctgttgagcgaaggggctacgctaaaagggactcaaagtcagtatgaaagcggactgacgtctaacaaagatgagaaaggaagtgatgacgaagatgcgtcagtggctgaggctgctgttgccgctaccgtcaattatacagacttaatccagggccaggaagatagttctgatgcccacacatctaatcaaacgaacgcgaatggtgagcacaaggattcccttaatggggaaagagccataaccccatcaaatgaaggagtcaagccaaacacctccctggagggaatgacgtcttcaccaatggaatctacacagcaatctaaaaacgacatgctcataccattggcagaacacgatcgtgggccagaacaccaacaggatgatgaagacaatgatgacgctgacattgatctcaaaaaggatataagcatgcagccgggtcgtcgtggaagaaaacctactactttggccacaacagacgagtggaaaaagcaaagaaaagactcccataaagaagtcgaaaggcgtcgccgcgaaaacatcaacactgcaatcaacgttttaagcgacctcctgcccgtgagagaatcaagtaaggcagcaatattggcgtgtgccgctgaatacattcaaaaattgaaagaaaccgatgaagcaaacatcgaaaagtggacgttacaaaaattgcttagcgagcaaaacgcatcgcaattagccagtgcaaatgagaaactgcaggaagaactgggaaatgcttacaaagaaatcgagtacatgaaacgcgttttaaggaaggagggaatagaatacgaggatatgcacactcacaagaaacaagagaacgaaagaaaaagcactaggagcgataatccacatgaggcttgagagttaaaaatagatagctaaatgtatttcgagtctccctatgtatctgcgtctctgccccatagcacctctgttaagtttttatcaatattccatcggcatatttgaaaccgcccggatggtattagagaatcactcagcctcaaactcagcaagtaaaagaggacgggacggactttcaaatatgtctttgtacgttattgtttttcatccctaaatggcttagtaaaaaagttttgccaagaattttttgacgttcaatggaaaaatcgccaagagaaatacgcacaacctccgttttcccgccttttatcaaaaaatcttagttttcccttcctttttttttttttgggtcgcagaaaagaaaaaagatagtagtggagaggattacctgaaaaaaacaggcaaaaacgtcacatccttgaaggtccgcgacaatcacgggcctatttctactttggggctttgcttgattatttaagaagaaacattggacgaagatcaagtaagagtgcacttgtctttagtctggcattccgctatttgtatcttatatagttaacaacaactgttatttactttctggaaaacaaccaacgtttatttttatgaattagaatcattgagattgtctaaacgagaggaagagaaagaaagagagaaagagaaaagaaagcgaagcaagatacaattccaatgatgttatcactgcgcaggttctccatgtacgttttgagatctctgcggcttcactttaaaaagataatcattactcttctaactatccagttactattcattaccatatttgtattgggcggtcgctcgtcgattattgacggtaactggaagtcattcatggcgctctttttcaaaccgcttgcttacactaacagaaacaacaaccatgcttctttcgatctgagatcaaaagacaacgtagccaaactttacgaaaaaatgaattttgatacttcaggcaaatggatcgacacgtacaccttgaagaataatcttctcactgtgaaaatgggtcctgaaaaagggcaagttcttgattcggtagatgaattgagatattacgataacgacccaaggctggtatggtcagttttactagatcacttattagaatcagattccaatgaatacgcattttcgtggtacgattgggctaattttgactctacaaacaaactcattgcactgagacacacgaacatatcttgccagttcgtttgcgagggtgcctttgataaaaatgtgctagaaatggtagagagtgaagtccaagagcctttattcgtcacaaataggaataaatatgacgaatcgctctggtacaacagggtaagaaaggttgtcgattctaattctgtgcagcaagccatacatgatcactgcatgaataatgacgcgtattccaatggtactcccttcgaattgccttttatcataagcgaaatttctgaaaggttgaggccagaagtgtatgacttacaagccaaaaaccacttgttatattctaactttactccactgtcattaaccgtactggacagcgataaagatgcatacagaatcaatttgaagacaacagactcttccaaatcaaatatagtacagacaaatctactacagaattacattaagaggcacagaaatgaaatggtaaatggcgacctcattttcaaccacacttccatgtttgaaaaatttttacatcatggatccactaaaaaaaggaaacttgacgttgaagcgttggataaaacaatatacgctggagagtatctagaactatcaccatctgatttccaattcaatgcaaaagagaggatcattgaattagagaccaggctcaggtctgaaggcctaccatctcatgatacccactatttacgaagtttaaagacgtccgtaaatacgtcccctgcattacagcaaaagtatttcgcagaggcctctgatattacggacgcgactgccgatggtcatcatagagacaggcgatttttctcaatcggacataatctcctaaatgaccctcaggagtttgaagcaagattgaattctttgatcagaaattttcagaaatttgttaaggctaacggattaatttcctggctatcgcatggtacattgtatggatatctatatgatggtctgaagtttccctgggatgtcgaccatgatttacagatgcccattaaacatttacattacttgagtcaatatttcaaccaatccctaatattagaagatccaagagaaggtaatggaagattcttactagatgtaggaagcgcaattacggtaggagttcatgggaacggcgaaaacaatattgatgctcgtttcatcgatattgactcaggtatatacattgacatcacgggacttagcgttagttccgatgcggctaaacagtacatgtccaaatttgtagaagaagaaagctcgggcgaaagcttttctgcccttattgaagactataagtttgacgaaaacgactattttgacgaggtggatggtagagaaggtttagctaaatataccatacatgaattaatggaatgggttaattctcatccagacgactttacggatgcagaaaagaatttagtcaccaaaacatacaagaaagagcttgcaatttcgagaagcgattatgctgaaaaagacttgtctccgaaacaaaggtatttggtaaatgagaagtataacctttacaattgtagaaaccagcatttttccagtctaaacatcatatcacccttgagaaatacaatgttcagcggtgtgtcagcatttgttcctaataggcccatagcaacattgaataatgagtataaagttccggcaaaatacgggcttttgtcattccaaggtaaggtgtatttaccggaattcagatactggttctcgtttgcagacatgaagaagtttgcaaatttgcagctgaaagaacccaagataacacgactggaaagtcccttaaatgatttaaaattcagcgacataagcctactgataacaaacattttaaaatgtgggtttcactccgtatttgccagcttatttaattcttttgacagtactgtttacagactcaaagagcttgaaatacagtatgatcctagcttgagtgaggaagaaaaaagtagtctattaaaaactctacggcgaggaatgtcaaaaaaaataaaatcaccagaaaaagatccgatcatatatatatacgaaagaaagttatgggaaaacgtggaaaagttgttgaatgcgtcaaacatctacaacattgcttcacaagttgagaaggaaaaaggtaaagagtttgttgaacggtcccagcaagtatatgaaagaaactttgacggcttcagacttcccgatggcggcaacagtaagactgtaaatgatctgaattctaagggcttaaatctctttggtgataataagaaaacttcaaacaatatatttggttcagaccaaaaatattaaaaaacgttcccttatccttcggaataggataataacaaaaaccattatttattcattcttgcctcacttaaattcggcccttacggcgacatttcaataacataaatatgcgtgtaaccttattaatttataatgtctaatttattataatattccttcacctaaacacttcaaattggacctcacgcaatatagcgccttctagacccttgcccaaattacccagcaactctacgctttcattgagagaatcaagcgaactctcatcatcatcctgtgaacctttaggttttttaccgttaaatttataaatgccagaacttcctgcaaaaatcgtggtaccatcttcagtaccacatctgttagctagcaccaaaatcgcattctttccttggaacttccaaggctgtccaagggaggttcccaaaaatgtcttttccagtactgtatcctttatcacttcctcagaatccaataagtctattgtgtcctccttgtgctttccatctttataatattcatgatctaggggcattctagttttgcccaaaatgctttcgataagagatgaatttttaaaccaattaattctggatttaaagtacaaaaaaggaaaaaatcgtagaatccagtagtttacgtttgacatatctggttcatccatatccttatattcacttgtactgtcgtcagaaggcactctgggcgtacgttgcgaatcaccaattttaagctggtaaattccttgagatcctgccaaaggcaacccttgctcctttaaagcgaaagctattttgttcttagcggcttctaataatgaattgttatgtaacgtctgtttgtctgtgatagaagtagagtttaaccacgccattggacatagaatcaattcaacattattgtcaacgcaaaaagaagagaattcaaagtgattaaagggggccatgaatttgtagggacttaagtccatacaaatacctattgatgctttcaaagtcacatctctgttgtaagagtcctcattagaaagcttagcacactttgaaaaatccatgggaaacgtctgaaatccctctggattctcctcgcaatcccaattcatttctgtatcatagagaaaagtctttctgtaattaaagatctgctccccctgcggatttactaccagggcagaattgtatagcttctgttcatcatcatcttcaggatatcctattatagtgtagcattgaaatttctcggatattgatttagccagttcaaaagagggcccttcatctttcttagtaacataaggtaaaatatcttttctggcatgaaaactgtaacctgtcaatgcaaattcggggaatagtattatgtctggtttcacataggtggcacttttcgtaactttatccaatattgaccatgttctcttaattgtttgatctacttgcccaatttgcggattgagttgaattactagtacctttagtgatactaaaagttttgtgctcatcttagcaccatgaattgcgtctattagcattcactgaatgtcacgatagagttatcgctgtaaactagcactttttagcattgaaatgcttaaaatgtgtgaaactaaagtggttttatttccaaagaagggttatcccttactagggcaacgaatgaatatctattagggctataaaacaaaaatagttaagtgagatatataccctcttgaatggtgcagggtaaataattatatatcgttacgaacgaaagatgaaaaatatgaaaaaaaaaaaaatcaaatttatgtcaagtgaagggcattgcatggcaagtgtaaagaatccaagaagaaaagaaaggcttaaagcaatccaggttagtacttataagaatgtctgttgtaggatcgttaattttttgcttggactgtggtgatctcctggaaaatcctaatgccgtattaggctctaacgttgaatgcagccaatgtaaagccatatatcccaagtcacaattctccaatttaaaagtcgtcaccacgacggcagacgatgcgtttccatcttctcttagagccaagaaatccgtggttaaaacttctttgaagaagaacgaactgaaagacggcgctactatcaaggaaaagtgtcctcagtgtggaaatgaagagatgaactatcatactttacagttaagatctgcagatgaaggtgctactgtcttctatacatgcacttcctgtggttacaagttccgtaccaacaattgattgggttgtgttcgcacatattacaatttgtacattaatatcatccccgctttcatcatgtgaacatctatagaacatcatttataaaaacaaaaaatctatgtactgacgatataatagcgtacattatcatattattcttactatttatcatactcatcgcatctactgttctcgagaacgtgtaaagtgatttatgccattgaatgaaaaattttgttaaggaacaactagaaatataatagtgtcttggtggatgtggcaaatgaggtgtgcgtgataaagagctacaaactcaaagtaataacagctatcatccatttttatagcaatatttgaaaatggctgctcgtccacaacaacctcctatggaaatgccggatctgtcgaacgccattgtggcacaagacgagatgggtagaccctttattatcgtgaaggatcaaggtaacaagaagagacagcacggattagaggccaagaaatcacatatattggctgctagatcagtagcttctattatcaaaacttcgttgggtccccgtgggttagataagatcttgatttcacctgacggtgaaatcaccatcactaacgatggtgctacaattttgtcccaaatggagctagataatgagattgcaaagttgttagtacaactttccaaatctcaagatgatgaaattggtgatggtactactggtgttgttgttctggcaagtgcgctacttgaccaagcattggagttaattcaaaagggtatacatccaatcaaaatcgctaatggatttgatgaagccgccaaattagccatttccaagttagaagaaacatgtgacgacatttctgcgtcaaacgatgaattgttcagggactttttattgagggccgccaaaacttctttgggctccaaaattgtttccaaggatcatgatagatttgctgaaatggctgtggaagccgtcataaatgtcatggacaaagatcgtaaagacgtggatttcgatttaatcaaaatgcaaggacgggttggcggatctataagcgattcaaaattgattaatggtgtcattttggataaagatttttctcatccacaaatgcctaaatgtgttttaccaaaagagggctctgatggtgttaagttagctatattaacgtgtccatttgaacctcctaaaccaaagaccaagcataaattagacatttcttcagtagaagaataccaaaaattacagacttatgaacaagataagttcaaagaaatgatagacgatgtgaagaaagcgggcgcagatgttgttatatgccaatgggggtttgacgatgaggccaatcatctacttctacagaatgatttacctgccgtaagatgggtaggtggccaagaactagaacacattgccatttccacaaacggtcgcattgttccaagatttcaagacttgtctaaggataaattaggtacatgttccagaatttacgagcaggagtttggtactactaaggatcgtatgctgattatcgagcaaagtaaagaaacaaaaactgtaacatgttttgttcgcggttccaataaaatgatcgtggatgaagctgaacgtgcattgcatgactcactatgtgtggtacgtaacttggttaaagactcacgtgtagtttacggtgggggagcagccgaagtgactatgtccctggctgtctctgaggaagctgataagcaacgtggtattgatcagtatgcattccgtggattcgcccaagcgttagacaccattccaatgactttggctgaaaattctggtcttgatccaatcggaactttgtctacattgaaaagtaaacaactgaaagaaaagatttccaacattggtgtcgattgcttaggttacgggtctaatgacatgaaggaactatttgtcgttgatccatttattggcaaaaagcagcaaattcttttagctactcaattatgtagaatgattttaaagattgataacgtcatcattagtggtaaagatgagtattgattttgtataaataaataataaaagataagttttaatcacatatcccacaattttttttctcagatcagcatttggggttacttgattgtacatatacgtgtatataatcagttgtatacgtatatttaaatgaagtgaggggcgtttcagttatttgcatttgtttttgtacctttttccttataagatgagtcatgactcaataatcaaaccatgttgaaaaggctgaaatttctaacaatttccggaccatattcctcataatctttcttagtgtgacagtagcctttgaattcggctgtttgtgccagcagcgagccaccaaaccagacagcgtttctctgcttccgatgagaaatcacggaaacatctacaccagtcgatttagttccacttaacagctcactttgtgcgattctgttatttacgatagactttagatctctttgtaaacgacgtccaaaatctttgaacatggtagacccacctgatagtacaatattgttgtataaacctttacggacgtcaatagggcaagcctggatagtttgatccactaccgtgggtaaaggagtcaagaagtctgaggatgcaatttctggattgaagaagatttcaggtgctaagaatctttcgtaaccaatatctacgacttttctccttgtcttttcttggttttccaccacaaattgggcaaatttagaaggatctttatcgaatttgttaaactcctttacaatatctggacagacgtaacagtattcttgcttaatcttttcggcagttctcaaggaagtgtctgcttcaccacgttctcttagcaaggattggatgaacaatgtgatgtctctaccggctattggaatgtttttaattgctgagccaatgacgtaaccttccgccactgggatgacgtgggtgacaccatcaccagaatctataacagtaccagttaatgatctatccgtgacttttgaagaggtccatgacgcagccagagccaaaactgcttgcacagcaatatatagaccagcacaattaaatgattcaaaaaaaatctccgccacttgctctctgttttctggaggattcagtggtggttcggtcaataggaaaaaatgatcttcaggctctgttcttaaatacttgaagatggaattttcccagaatctttccatgtgatcccaattttccacttgaccgtgtctgattggatagctcaaagagtaagagggtccttgggatgctactaaagcctcatttccaatatagaaatccaaatcttctgtacctcttttaccggataaattattagacagcaaaccacctgttgcaccattgaaattggttgcagaggtggaatttccaaagtatgatgcttcattactaactgctgagggcgcaccaacgcccgaggacttctttgtatttgaaggtgcagctgtggctattgcagtagggaagacccaggagggagaatcattaccggcgaaaccgagcttggtcagcccggtaccattgtccatgacaacagcgggattgtttaagtatgacattgaatcctaatttcttgctcaatcgtgaggccttacggtagggccaattcttgattaaactactctcatatatttttgtttgaaacttttgaaaaggggttctcgccattttgaagccgcggacagccgggtgactactgaaagtccttatcgaagggtcttcttgagcttacgttaaaaaagagccatagtagcttcacgagagagtcattggtaaagtgaaacatacatcaaccggctagcaggtttgcattgatatggaaccgcatgaggagcagatttggaagagtaaacttttgaaagcggctaacaacgatatggacatggatagaaatgtgccgttggcaccgaatctgaatgtgaatatgaacatgaaaatgaatgcgagcaggaacggggatgaattcggtctgacttctagtaggtttgatggagtggtgattggcagtaatggggatgtaaattttaagcccattttggagaaaattttccgcgaattaaccagtgattacaaggaggaacgaaaattggccagtatttcattatttgatctactagtatccttggaacatgaattgtcgatagaagagttccaagcagtttcaaatgacataaacaataagattttggagctggtccatacaaaaaaaacgagcactagggtaggggctgttctatccatagacactttgatttcattctacgcatatactgaaaggttgcctaacgaaacttcacgactggctggttaccttcgagggctaataccttctaatgatgtagaggtcatgagactcgctgcaaagactctgggcaagttagccgttccaggaggtacatatacctctgatttcgtggaatttgagataaagtcttgcttagaatggcttactgcctccacggaaaagaattcattctcgagttcgaagccagaccatgctaaacatgctgcgcttctgattataacagcgttggcagagaattgtccttatttactctaccaatacttgaattccatactagataacatttggagagcactaagagacccacatttggtgatcagaattgatgcgtccattacattggccaaatgtctttccaccctacgaaatagggatcctcagttaactagccagtgggtgcagagattggctacaagttgtgaatacggatttcaagtaaacacattagaatgcatccatgcaagtttgttggtttataaggaaatcttgtttttgaaggatccctttttgaatcaagtgttcgaccaaatgtgtctaaattgcatagcttatgaaaatcataaagcgaaaatgattagagaaaagatttaccagattgttcccctattagcatcgttcaatcctcaattatttgctggcaaatatttgcaccaaattatggacaactatttagagattttaaccaatgctccagcaaataaaataccacatctcaaagatgacaaaccacagattttaatatcgattggtgatattgcatatgaagtcgggcccgatatcgcaccttatgtgaaacaaattcttgattatattgaacatgatttacagacgaaattcaaattcagaaagaaatttgaaaatgaaattttctactgcatcggaagattggcagttcccttgggccccgttctaggtaaattattaaacagaaatatactggacctgatgttcaaatgccctctttccgactatatgcaggaaacgtttcaaattctgactgagagaataccatcactaggccccaaaataaatgacgagttgcttaacctagtctgttcaaccttatctggaacaccatttatccagccagggtcaccaatggagataccatcgttttcgagagaaagagcaagagaatggagaaataaaaacatcctacagaaaactggtgaaagtaacgatgataataatgatataaaaatcattatacaagcttttagaatgttaaaaaatatcaaaagcagattttcgttggtggaattcgtgagaattgttgcactttcttacattgagcatacagatcccagagtaaggaaactagctgcgttgacatcttgtgaaatttacgtcaaggataacatctgcaaacaaacatcactacactctctgaacactgtatctgaagtgttatcaaagcttctagccattacgattgcggaccctttacaagatatccgtttagaagttttaaagaatcttaatccatgtttcgatccccagttggcacaaccagataatttgagactcttgtttactgcactgcacgatgagtcgttcaatattcagtcagtagcaatggagcttgtcggtaggttgtcttccgtaaaccctgcatacgtcatcccatcgataagaaaaatactactggaactgctaacaaaattaaaattctcaacttcttctcgagaaaaggaagaaactgccagtttgttatgtactcttatcaggtcgagtaaagatgttgcgaaaccttatatcgaacctcttttaaatgttcttttaccaaaattccaagatacctcttcaacggttgcatcaactgcactgagaactataggtgagctatctgttgtagggggcgaagatatgaagatatatcttaaggatttgtttcctttaattatcaaaacatttcaggatcaatcaaactctttcaagagagaagctgcacttaaggcccttggtcaacttgcagcctcatctggttacgtgatagatcctttactcgactatcccgaattattgggtatattggtgaatatattgaagacagaaaactctcaaaatattaggagacaaacagtcactttgataggtatactgggagctatcgacccatatcgccaaaaagaacgtgaggttacctctactaccgatatatctacagaacagaacgccccgcctatcgacattgctcttctcatgcagggcatgtctccttcgaatgatgagtattataccactgttgtcattcactgcctgctaaaaatcctaaaagatccatccctatcatcttaccacactgccgtgatccaagcgattatgcatatttttcaaacccttggtctaaaatgtgtttcattcttggaccagatcatcccaactattttggacgtaatgcgtacatgctctcagtcactattagaattttacttccaacagctttgctctttgattattatcgtaaggcaacacataagacctcatgtcgattctatattccaggctatcaaagatttttcttcggttgctaagctacaaataacgcttgtaagtgttattgaagcaatatcaaaggctctggagggtgaattcaaaagattggtccctcttactctgaccttgttccttgtaattttggagaatgacaagtctagtgacaaggtcctctccagaagggtattgagactgttagaatcgtttggtcctaacttagaaggttattcgcatttgattacacccaagatagttcaaatggcagaattcaccagcgggaacctacaaaggtctgcaataattactattggcaaactggccaaggatgttgacctttttgagatgtcctcaagaattgttcactctttacttagggtactaagttcaacaacgagtgacgaactctcaaaagtcattatgaatactttaagtctactgctaatacaaatgggcacatcctttgctatcttcatccctgtcattaatgaagttttaatgaagaaacatattcaacacacaatatatgatgacttgacaaacagaatattaaacaatgatgttttacccacaaaaattcttgaagcaaatacaacggattataagcccgcggaacaaatggaggcagcagatgctggggtcgcaaaattacctataaaccaatcagttttgaaaagtgcatggaattctagccaacaaagaactaaagaagattggcaggaatggagcaaacgtctatccattcaattattaaaagagtcaccctcccatgctctaagagcttgttcaaatcttgcaagcatgtattatccactagccaaagaactttttaataccgcattcgcatgtgtttggaccgaactttatagccaatatcaagaagatttaattgggtcattatgtatagccttatcttctcccttaaatccaccagaaatacatcaaacattgttaaacctggtagaatttatggaacacgatgacaaggcattaccaataccaactcaaagcctgggcgagtatgctgaaagatgtcacgcctatgccaaagcgctacattataaagagattaaatttattaaagagcctgagaactcaactattgaatcattgatcagcattaacaaccagctgaatcaaacggatgctgcaattggtatattaaagcatgcccaacaacatcattcacttcaattaaaggagacatggtttgaaaaattagagcgttgggaagatgcactacatgcttataatgaacgtgaaaaggcaggtgatacttccgtgagcgttacactcggtaagatgagatcccttcatgcccttggcgaatgggaacagttgtcgcaattggcagctagaaagtggaaagtttcgaagctacaaactaagaagctaatagctcccttggcagctggtgctgcgtgggggttgggagagtgggatatgcttgagcaatatatcagcgttatgaaacctaaatctccagataaggaattttttgatgcaattttatacttgcacaagaatgattacgacaatgctagtaagcatatattaaacgccagagatttgcttgtgactgaaatttccgcgttgatcaatgaaagttataatagagcatatagcgttattgttagaactcaaataataacagagtttgaggaaatcatcaagtataaacaattgccacctaattccgagaaaaaacttcactatcaaaatctttggacaaaaagactgctgggctgccaaaaaaatgtcgatttatggcaaagagtgcttagagtaagatcattggtaataaagcccaagcaagacctgcaaatatggataaaatttgcaaatttgtgcagaaaatctggtagaatgaggctagcaaataaggcattgaatatgctactagaaggaggcaacgatcctagtttaccaaatacgttcaaagctcctcccccagttgtttacgcgcaactaaaatatatttgggctacaggagcttataaagaagcattaaaccacttgataggatttacatccaggttagcgcatgatcttggtttggatccgaataatatgatcgcgcaaagtgtcaaactctcaagtgcaagtactgctccgtatgttgaggaatacacaaaattattagctcgatgttttttaaagcaaggtgagtggagaatagcaacacaaccgaactggagaaacacaaatccggatgcaattcttggttcttatctattggctacacatttcgataaaaattggtacaaggcatggcataattgggccttagctaattttgaagtaatatccatggttcaggaagagactaagctcaacggaggtaagaatgatgatgatgatgacacggcagttaataatgataatgtgcggattgacggtagtatcctaggaagtggttctttgactattaatggcaacagatacccgctagagcttattcaaagacatgttgttccagcgatcaagggcttttttcattcaatatctctattagaaacaagttgtttgcaagacacgttgaggttattgactcttttatttaactttggtggtattaaagaagtctcacaagccatgtatgaaggcttcaatttgatgaaaatagagaactggcttgaagtcttaccacagttgatctctcgtatacatcagccagatcctacggtgagtaattcccttttgtcgttgctttctgatttagggaaagctcatccacaagctctcgtgtatcctttaactgtcgcgatcaagtctgaatctgtttcaagacaaaaagcggctctttcaataatagagaaaattaggattcatagtccagtcctggtaaaccaggcagaattagttagtcacgagttgatcagagtagccgttctatggcacgaattatggtatgaaggactggaagatgcgagccgccaatttttcgttgaacataacatagaaaaaatgttttctactttagaacctttacataaacacttaggcaatgagcctcaaacgttaagtgaggtatcgtttcagaaatcatttggtagagatttgaacgatgcctacgaatggttgaataactacaaaaagtcaaaagacatcaataatttgaaccaagcttgggatatttattataacgtcttcagaaaaataacacgtcaaataccacagttacaaaccttagacttacagcatgtttctccccagcttctggctactcatgatctcgaattggctgttcctgggacatatttcccaggaaaacctaccattagaatagcgaagtttgagccattattttctgtgatctcttcgaagcaaaggccaagaaaattctccatcaagggtagcgacggtaaagattataaatacgttttaaagggacatgaagatataagacaagatagccttgttatgcaattatttggtctagttaacactttgttgaagaatgattcagagtgtttcaagagacatttggatatccaacaatacccggctattccattgtcgcctaaatctggtttactaggatgggtaccaaatagtgacacattccacgttttgatcagagaacaccgtgatgccaaaaaaattccgttgaacattgaacattgggttatgttacaaatggcccccgattatgagaatttgactcttttacaaaaaattgaagtattcacgtacgctttagataatacaaaaggccaagacctttataaaatattatggttaaagagtaggtcgtcagagacatggctagaacgtagaacaacttatacgagatctttagcagttatgtccatgactggttatattctgggactaggtgatcgccatccaagcaacctgatgctagatagaatcaccggtaaagttatccacattgatttcggcgattgttttgaagctgccatcttaagagaaaagtatccagaaaaagtgccatttagactaactaggatgttaacatacgcaatggaagttagtggaattgaaggcagtttccgaattacttgtgaaaatgtcatgagagtcttaagagataataaagaatcattaatggcgatcttggaagcttttgcgcttgatcctttgatccattggggatttgatttaccgccacaaaaacttactgagcaaactggaattcctttgccgttgattaatcctagtgaattattaaggaagggggcaattactgtcgaagaagcggcaaatatggaagcagaacaacaaaatgagaccaaaaacgccagagcaatgcttgttttgagacgtattacagataaattaacgggcaatgatatcaagaggttcaatgaattagacgtccctgagcaggttgataaactgatccaacaagccacttctattgaaaggttatgtcaacattatattggatggtgcccattctggtgactgcggtgtcatttttcatttcgtgctttgtttactatttattttttttgtattacgcatttgtatacgtgtgcaagtattgtgtattattattattattatcattatttttgtaatatctcgtcattatgtgaaatgaaggatgatataaggtacataaattgtgaaatcaactccatttaaaacaactttattggatagatggcacatggtacttttcacaataggtattggcaatatcagtccattttgttatgagcggatgtttttcttgcaagtcaaagtttggatcaaatatggacttactaagtactttgttaatgcgtaattctttttgagcatcaatatatgccttactgaggtcctcatcttcatcaccaaaacgtgttcgtaggccaagtaaaatccccataattatgccaacttgtttccctaatttagcgcccgttgggaaaccatcattgaaaccctcttgcagcttttcttctttagaactcactattccgtccaagtaccccctcttgctatgattctctcttaacttcactaaatctggagatcgttcagtttcgacatcactgtctgatgcccatacatcgtcccaagtattcgacatctctatatactattgtaacactgttccttttttgttctcttctatcaaaaacctttctcatcgttatttttcactcttttacttcgcgtatttcaaagcaatcaggaagtaactcaagcgaacaagtcaatgctataagagaagtaaaatagagagacagcgagaaatactgggggaaagtattggcaatcacttgagatgtttgaagggtttggtccaaataaaaagcgtaagatatcaaagttagccgcagagcaatcattggcacaacaaccctgggttgagaaatacaggcccaaaaacctagatgaagtgacagctcaagatcatgccgttactgttttgaagaaaaccttaaagtcagctaatctaccacatatgttgttttatggtcccccaggaactggtaaaacgtctaccattttagcgctaacaaaagaattatatggacccgacttgatgaaatcaagaatattggagttgaacgcttctgacgaacgtggtatctctattgtaagagaaaaggtaaaaaattttgcaagattgactgtatccaagcctagcaaacatgacttggagaactatccgtgcccaccgtataagatcattattctcgatgaggccgattcaatgactgccgatgcacagagtgcattacgtagaacaatggaaacctattcaggagtaacaagattctgtttgatttgtaattatgtgacaagaattattgacccgctagcgtcccgttgttccaaatttagattcaaagccctagacgcaagtaatgccattgaccgtttgaggtttatcagcgaacaagaaaatgttaaatgtgatgatggagttttggaaaggatcttggacatttcggcaggtgacttgagaagaggcattacattattacaatccgcttccaagggggcgcaatacttgggtgatggtaaaaacataacttctacccaagtggaagaattagctggtgtggtacctcatgacattctaatagaaattgttgaaaaagtcaaaagtggtgattttgatgagattaagaaatacgtcaatacgtttatgaaaagcggttggtctgctgcgtcagtagttaaccaactacatgaatattacatcaccaacgataactttgatacgaacttcaaaaatcaaatatcttggttgctgtttactacggattccagattaaacaacggaacgaacgagcacatccaattattaaacttattggttaaaatatcccaactctaatatacaggcatctttatataattgaatatagaggcgacataaagtaagaataaaaaaaaaaaaatctatccataattcctcttatcttctcagcacatcacctaaaagtcattttgatacaagtactctttaaactgagcgaaggctttaccacgatgagaaatagcattctttgcgtctttgctcatctctgcgtaagtcagtccatgactatcaaaaggttcaaaaattgaatcccagccgaatgtagtgggtccccggcttggaacgatcttgcctcttgtaataccttgaaagaagtgatattcaccccgagaatcagcaaaacaaatggtggtaactgcttcagcgtttttattttcaaagggttccaacattttcacaattttttccaatcccatgctctttaaaaaccattttatataagcacctggtagaccgttaaattcgtcaaatctcaacgcagtgtcttccacaaacactggcttacccttacccaaggccgcaacagcttgctttcccttagctaacgcaatggcattcagatccgtgtcctgcaattcttccaggtctaaggcctcattgattaagtggatggttttgttgttgttgtcgacctcttgagtcaaaatcgactgcacttcctttaacttgttggcattgccagtgacaaatacaatttcgttgttgctcattctgctatcgttcgtttttagatatctctatgtgagtgtttcctatgctttgaagaccagtgttgaaagctgaagctcgagagaacggtttcgaaaataaataatttttttgctatttgatacatttgtatatataacggaaatggcgggttttgaaaagtataaaatacaagattatacaatgattattgttactatcattattgatgatgctgattcttctaattagcagttggagcatattctagttcgttgctgttttcgtaatcatacatatctagcgcaacgatacaagattctctgacgacatcgacttcatcgttgaggtaagatttcaagacgtcgacaacttctggagaagcaatggcacccaaggcttcagcagcttcatgcctaaccattggagcttcttcctttctgcccaaaacttcaatcaaacttgggacagcagccggactacctatttgaccgaagacgtaggcgatttcatgcttgaaaagggaggattctgcactgaaaccagtggccaaggccaggattgcttcatcagtaccgatatctctcagtctgaacatggctctgtatctttggaacaaaggttgcttaggatcattcaataaggcctgtagttctgggatggtagcatccttttctaatggtagaggtggggctgggtcaatactcgagtatagggattgttgcaagttttccttatccttggcacctccatgggtccagttgattctgttaatggccagttcacaggtttctctcacagcaacgtgtggatcctccttagcagccttatttaggtcatccaacgaatccttgtcacctagggcacccaaagcctcagcggcttcgtgtctcaccattggttcttgattttgatctaacataacgtgtcttaaagttggagcagcgtccaagttcttggtttgacccaacacgtaggccacttcgtgcttcaacaactcagacttgtcattgacgaaggattcggcaatgtattcgatggcctttttggcttcctctggcttagtggcaaattcttcagcaacagtctttaagttgaacagagctctaaatctgttggccaaaactgttttgccggacttgttgactaagatgtcccttagttgctctagagtgcattcatcgacgttttcttggaaatgtttttcaaagttagtagacatgtttttttttttctttcttgcgtggtatgttagaaggactacagtttatcctaacctaaacctagagctaccgtcaaatatacacgtgtattcactggatttgccttatgtaatttatatgataaaaacttttcagctcatcgagaaaaattttctttcctcccacgcaggatagagaaaaaaaaaaaattttttttttttcttgtttctcactgcattctacagggatttctgtggaaggattacctctattgttcaaaagataataaacgtgggagtttatctgacgttcgtctttgcaattccattgtctttttttttctctgcgggtcgaatgatcgccgaaccaaaggactatacgtagttatttagtttctaatatacttcgcgatattttctgcagtctcgctactggccgttttccctacttgttgcatagcttcctgatatctcctttgtaggtctggagcagagttctcgttgacctcaccttttgttctttcttcgcctgggaacgtgtattctctctcaacgccttcgtcctcatccctatccacaagaccatcattggcatcctcttcgaggtcgctaatggcatctatgctgtcgttgtcgctggctgcagcgctgctcttctcgtttaaccctagatccttcatcaggccattcaatgatttttgctttctcatctcttcctttttcttttttaggttcaatgctttttcacgttcttgcttatagtattggtcgtattcatcaactttcttgtctacgcattgcataaattcgtcgaatccgtctccggtaaaactggaaacgcccacgacgtctagctgggaatagaattcttcaagcatcagtgacatagaattgaccaatgagctcatgtacccggagcccagcccattgtcaccattcaagtcttgatcttccttgattgctgcttggaaactctcaaaatccgtcatccattccttagcaaaatctgccttgcacacgtcggtcttgttgaaaacgacaatcatgggaagtttggtcttatacagaatggagcaggcgtacagcatgttactcatgaatgtagttggggatgagtttctaggcgtatccacgatatatgcaatcactgtgggaaagctggaggcaaaagattccgtgataatggcacccgacgcactccacacaaaacattcgatttggcctggagtgtcgatgatgcagttttggaacttgtccttcttctgttccaccaacctaataacttgatcaatcttggtgctgaacaaattcaaactggtgacaatggcaccgttcggacctagctggtaattctccatcactttcttgtatttgattgagtctctgatatcgatgtttgcaccataggggactctcaatactgcaggatcaagattgattacgtatggtggcgttttctctgcccgcaagtgggagtttaacctttgcatgaaagttgttttaccggatccggccataccaatacatatgattgtgctgagactcattcttgctgtgtcgttattgcgttttgtagttgtttgtgtgcgctagatgctctcattgtattccttgttaaatagagcatcgcattaaaatttttttttttcactttcgcgaagaaattgcttatggagctatatagaaacggtaatagcataggcttctaacattatagaatatatagaaatagagcacttacatattctttttggccttatcacggttagcgtagatcatggcagtaaaaggttcttcccaacgaagagcgatcttgtacatgaagtaaactacggcagaaacaaccagccccgcaggctttcctttgtaaagggctatgcccaagaaggacaaagtggaaccctggtacatggggttgttggaaacgttgaaggggaagccggtgactctctcatccatcaggatgccgaaatagtcacccaagtacgtccctgtgatacccagcttgtacatggaactcaaaacaagcacttgccccaaaccaaagagagccacacccagcttggtccagttctcgcccgtgatcagagaacacgtaggctgttcacgcaatgcagactcgtacaccatgtctctgacgatacctagcgaaaatatggtcgccgccaacatgtaacagccctttctggccccaccacacatcttggtgagagaatgcttgtggtattccattcttgcaacgatgttccaaaagataggattgaacatcgtgcacacaatggccagctggaacttggaagactgtaaatcgacactgtggatgagttgctggatgatctcttggactgactccttcatcgcttgacttgcgctattcttgttgtcttcaattgctgtttatggctctgtccaagaacgttcatgttcttcatatgtgttctcttataaagaccccttatccagtggtcattgcagtggcagtggacagaaaccaacgatgcatgtgtgggtttgcatatgaagattgaaaaggcttctcatatttcacaaccggtgcaactttccacatgcactctcattgacacctaccctggtcatcaaggaagcatgaacaacaaggaagtcgaattatacggcggcgccatcactactgtcgtcccacctgggtttatagacgcttctactctaagagaagtccccgatacacaggaggtgtacgtcaattcccgtcgcgatgaagaagaattcgaagatggactagccaccaatgaaagcattatcgtggatctcttggagacggtcgacaagagcgatctgaaggaggcttggcagttccacgtggaagacctgacggagttgaacgggaccaccaaatgggaagctttacaagaagacactgttcagcaaggaaccaagttcaccggactcgttatggaagtagcaaataagtggggaaaaccagatctggcacagaccgttgtcatcggcgtagcgttgatcagattaacccagtttgacacggatgtggtcatctccattaatgtacctttgacaaaggaggaggcgtcgcaagcaagcaacaaagagttgcctgcaagatgtcatgctgtttaccaattgttgcaagaaatggtacggaagtttcacgttgtggacacgtcgctgtttgcttaatctttcaaattttaaccttatgtttatattacctttttatttctactatatagcgtattacatgttttttccgataagtataacgaaatttcccagcagcgaagaaagtgaaaaaataacagtgaccataatgaacattcctctctttccattttgcacgtattcttgcagagaagaggcactctactcggaagacagcagatagatatatagactgtagcggttaacgatggccaaaacaacaaaaagagcctccagtttcaggaggttgatgatattcgccataatagccctcatctcattagcatttggagttagatacctatttcacaattctaatgctactgatttacaaaaaattctgcagaacttgcccaaagagatttcccaaagcattaatagtgccaacaatattcagagttcggattctgatctagttcaacattttgagagtttggctcaggagatcagacaccaacaggaagttcaagcaaagcaatttgataaacaacgtaagatcctggaaaaaaaaatccaagacttgaaacaaacacctccggaggccaccctaagagaacgcatagctatgactttcccctacgattcccatgtcaagttcccagcatttatttggcaaacttggtccaatgatgaaggtcccgagcgtgttcaagatataaagggcatgtgggaaagcaagaatccgggctttgcgcacgaagtgttgaaccatgacgtgataaacgcactagtacaccactacttctactccataccggaaatcctagagacttacgaagctctgccctccatcatcctaaagatagattttttcaaatacttaatactgttagttcatggaggtgtttatgctgacatcgacacgttccctgttcagccaattccaaactggattcctgaagagttgtcgccatccgacattgggttgatagttggagttgaggaagacgctcaaagagctgactggagaaccaagtatatcagaagacttcagtttggtacttggattatacaagcaaaacctggtcaccctgttttgagggaaatcatttctcgaattattgagaccactttacagagaaagagggacgaccaactaaacgtcaatctaaggaatgatctgaatattatgagttggacgggttctgggttgtggactgacactattttcacgtatttcaatgactttatgagaagtggtgtcagggagaaggttacatggaaattattccataacctaaatcaaccaaaattgctaagtgatgttctggtctttccaaaattctcctttaactgtccaaaccaaatcgataatgacgatccacacaagaaattctatttcattactcatttggcatcacaattttggaaaaatactccaaaggtggagcagaaataagtacttctacgcagatataataaggaacttttttgttaatttttttttgctgatcgatattaatactttttaagaatgaagaaaaaaaaaaaataatataccagatgtatttacttatatacaacactcactctttatatatatagagaaagaagaaataagtgaggaagccaaaagcggactcattcttcctgtttgattttcgcctctttttccaacctggcttcaatttctcttaattccttttctctttgcaacagttcttgtcttttcaacagcagttcttgctgaactctctcctcaaatgcctttagtcgctcttcttctaaccgtatttgctcctcacgtgtcatgtaggtttcgttattttcgccagtgctttgcccgtgcatatcggatgctgggttgagaacatcgttattaatattattactttgcttgaagggatttgtgtttctccttgttgtggtggacgatgacgacgaaccattcaattttgtcagatttggacgtatggattctgccgcgacagattcacctgataatgcctcggttctatatctttcatataatatctcatgtgtgtagtttttcaagtcatgtaaatgagagatcaataacgcattccttaagataacaaaatcagagatcgatgaatcttccacgtccagtatgccccatggatactttctgccacgaattgtcccaacatcgccgcccatttcgtaaacttcattggatccaataatagcaaaaggtagaagtgtacgtaggtacatattggtttcgtaatcttcgtctgatatttcatcttcatcgaaagggaaattataaattggcaagttccatctgtcgatatcctccatgatcaattttttattcagtttcagttcatctcttgtcaaggaatctgatttgctgatcacagggatgatgttaactaaggatcccaactgtctgatgaattccacatcaatctcttttaaaccgtggccagttgggttgattaagtaaagacaacaatgaactctgccgtccttaaatcttgggtttcttctcacacgactttcttccaataagatttcatcatattggtggcgaatgtagtcggaaatgatttcgaaagatggagaattgtcgagagaatcaccgaatcccggagtatcgatgatattaagttgaatcttgacaccttcatcatcttctaattcgaccgtctcctctctcaattgtaagtctatttctgtggacgtatctgtgggtaacaagattgtcgtcgaagtgtctacaacttgctgaccgcacaaagtatttataaaagtcgatctaccagatccggactggcccacgatcatcacagtgaaggttatacctcttttcaaatgctttctttttcttaatgcagaagatgcgtcaattattccggacatggctggtggttagcaactttaggccttgtgatgattgactttctaaacggctccagatcgggtcgccaatacgtggtgtctacctattttacttttcgatcaaatacttttttgtttatttttctttatgttagaaggcggaaaaataaagaatactggcgatcctgcatggtcgggtaacgacccacgagcattgtgttgtgtaaatatagccatatttaagctatatttatctgtataacatatacgtgtccgtatgtgcccgaccaaatatgttactgcgatgaaatggattgagaacgatgtttaaatgttatgttccatgttgtgttttccaccaaaaaaccgtgaaggacaattcaatgagcaaagggtttaacggagctataacctgcttttgtagatgaaaaaatagaaaattcaaatatatatatatatatatatttataatagcatgttaatttacagatatttggacttttgcaaagtcagtaaatacatggaataagaatactagtgattgaatagagtacatttaaacagatttatttatttctttcctttgttgactctttcttagaatatgaaaaaaaaaaggggctccggtggtgatgaggagagaatatatatgcatgtatcaatcaagaccatttctaatgaccaccaccaccaatttcaatggttggtgggcaacccaaagtgctctttaaagaaccataaataccaaattgcaaggaggtcaaggtaccaaccatgaccaaacgagtaggcaacccagcaaaggaaccgaaaaatcctaactgtttggccaactgagccaacaaaccgactgtggattggccaggagccttcttagtcttgttgaccttggacaacagagtgtctgctggctgggaaacaatggcagcggccaaaccagcagtcaaaccggaaagcaaattcaacaaagtagtggaagtagaggacaatttttcttttggaccggcgaacccgtagtagaactcggaggcacgttcaaagaccaagaatttagcaatgttgtaaggaatttgcttgaacaaaattggagtgaacccactgtagaaagagccgataccttcttctttcaaaattctggaaaaccctccgacgagtccattagcgaactgtggttgggagaccaatctgattctagtggcttctaggggacacaaggcaatgtctgccaagaattcggccatggcagcagaacccatgtaaacagagttcttgtagcgagaggcggtatcgtaacccaagttgtcaatgaagaacttcttgaacacttcgtaaccaccgaacttgaaggcaccttggatagagtaacccaacaaagtaggaccaaacccggtcaacaacgcaccagcaccttctccggcgatgatttgcttgaaagagccgaccatacccttgttgtacacggtaggttccagttggattctcgtcttaacgacatcgatcgggaccatactggagtgagtcgacccgcaccctatggcgccggctagggcgaatttcatgtagtcagagacagagtactgtggaatagcaggagcagcagacacagacatggtgagatgagactttttgatctttgtagttcttcttcttgcagatcactctgttctttgcgatggttcttgtagataaaaagatcgggaggatggatcgcacttaaaaatcttctcgaaacgggccgcggccgggcatgggacccgttctcgacgctgattggctaacgatggttgggcagagtctcagctgctgcttgctcacattcgacaaaagactagaggaaagcagtaccatgctgcgatactgttgcatcgcagcattccgctgtccaaaaacaatacctgttgtattgtttgaggctggcaggcgcttgggtagaaacaacacccgatactggtgacagggctatctataaatattaaaacttgactccgcaattcgtcgtaaactgccttaaccatcgtaatggacgccgtgcaaatgcttcgacttttcccagtagtcaggcattgcgccagacacttgtgctgcttaattgtcgtaatgaaaacatatcggtagcggcctttttttattttttttctctatgggctgacgctgtcacttttcaacgtcgctccgaggcaaaaaagccaccgtcagaaataattactgtcacacacactagatgtccatgtatctttagcatatataaagcgaaaataaaagaaagagtcaacgccgatatgaacaacacttccataaccggaccacaagtactacatagaacaaaaatgagaccactaccagtgctagaaaaatactgtatctcgccacatcatgggtttttggacgaccggttacccttgaccagactgagcagcaagaaatatatgaaatgggaagaaatcgttgctgacctgccctctcttttgcaagaggataacaaggtgcggagcgtcatcgatgggctggatgtcttggacttggatgagacgatcttgggcgacgtcagggagctcagaagagcatattccattttggggtttatggcgcacgcttatatttgggccagcggaactccccgggatgtattaccggagtgtattgcaaggccactgttggagacagcacatattttgggtgtgccaccgttagctacgtactcctcgttggtgttatggaacttcaaagtgaccgacgagtgcaagaaaacggaaaccgggtgtttggacttggaaaatattacaacgataaacacatttacgggaaccgttgacgaaagttggttttatctggtcagcgtgcggtttgaaaaaatcggcagcgcttgtttaaaccatgggttgcagatattgagagccattagaagcggtgataaaggagacgctaacgtgatagacgggttggagggcttggctgcaacgatcgaaaggttatcgaaagccttgatggaaatggagcttaagtgtgaacccaatgtattttatttcaagataagaccatttttggccgggtggacgaatatgtcgcatatggggttaccacagggtgttaggtatggagcggaaggacagtatcggatcttttctggcgggtccaatgcgcaaagctcgttgatacagacactggacatccttttgggtgtgaaacacactgcgaatgctgcgcattcttcccaaggagacagcaagatcaattatctggacgaaatgaaaaaatacatgccaagagaacatcgtgaatttctttaccatttggaatcggtatgtaatattcgcgaatacgtttctcgtaacgcttctaaccgtgcattgcaagaggcctatggacgttgcatttccatgctgaaaatatttagagataaccacattcaaattgttaccaagtacattattttgccctccaattcaaagcaacacggctccaataagccgaacgtactaagtccaatcgagcccaataccaaagcaagtggttgtttagggcataaagttgcctcatctaagactatcggaaccggtggtacaagattaatgcccttcttaaagcagtgcagggacgagactgtcgccactgcggacattaaaaatgaagataaaaattgacattatacattttattaacgcccccccttttttttttttttttgttgatgcagaagcctcgcaacttaaagcttttcagttgtttcttcttggtcatattttttatacatatatacatacatatatgcatgtgctgtgtactacatgctgcctttcttcaatttttatgtatagacaaggaggccagaaagatattataaacaatgttttttatgtgaacttcgaagtactttgaaaatcaaccctcccatcttgcgagacggtcgcaataaacagtgagggtctgttggcaagctcaatgatctttgaatttacatcgttagccacttgtttctctaaattgacaccgttatcattcacgttgctcttcttaacgtggcccttggacgttagtttagttagaatattatctttggatgttgtcatttcatgcgtttgaatcaatattgttcttggacctttaatcttcataaagtacgagtcgacaccataaatgtatcttttttcgtactggttacggatccaactgcgcattcttttgaaaaattgaacagtatgtccgtaagcagattttagcgtttggttcttaatgaatttaggtgccaccgtatcattacttgaatctccgacgtacgcgccttccacgtgtaactcttgtctctccactgaatttgcaatatccaattgactttggccgttgatggccaaaatgtttctggaattaaccagaattttgtcgctttcatcaattaactcaattgaatataccaacccacctccacatactaacacatttcctctcccattcagaatttgaaatttccgtggtagttgtgattttgatgagttcgagactaaagaccttgcagagggaaagataggcgatttgatttccagactggagttctgttcaaatgcgataattgaatccttgccaaatacattccaatcctttgtcccggtcaaattcagtacggacaagcttcttgaagaatcgaaaggtcttctcgatgtttgaaagtttggggcagccagaatttctaaaacggaggatccaataattctatgaaacaatgaagatttgaatgaacgaaatttaatcaggtttgaccaaaaattcagccatttataggaaagggataaatggttcaaattgtgaatggaaactaggcaatcctttttgatacaaattggaatatctggttgaacagtgatagatgcaattttaccattttcgtctactagcctgaaacgggaagtcgcaatatccttgcttaagttctcgatatatgtcctttctttagttacgacattactctccgtcttggccgcttgtgggctcaaaagagaaattgatctctgccaaactcgagtattcacccttgggcttatcatgatgggtggatatccttttctgtgcttctgttttgtttatctgtatccgtttattcgccagccaataaaatgactgggagcacgggacctttgaaattttgcccttgttagtaaatcgttataaaaatacttatatagatattttatagaaaatgaaaaataaaagaaatagccaatatgtaggtatatcgaacttaaaggtcacctgtcgaaatcatttccttcttctctctttttcttttcaatcagatgttttagagcggtcaagcaacgtaaataccaacgtgtgctatcgcattagtcgttttgtgattggccatgctgctgcttcacgtacgtagcactacttaatgaaaaaatacgatcattgttattgaatgcagaatctgcatggctgtggtgtgacttggagaaggtatcaaacccttttatgatgttaccagaatagtgtgattttgacccatgggctcccccatgacctgaatggttgttattactattgtgtgagaaatactcggtctctttatcatatatctcttgttgtaagttgtcaaaggtatcttcttgctctcttctatcttggagggacttttttagttccgctttcaatgcttcataacttttcagctcatcagtcattttcttctaggcgtaggttggtaacaaacggaaagatgatggaaaatggctgttctctaaagatgtttatcttacgtatattctttgctttcgttgtggctttacacacctttaatcattaatttaatggcatagtcggcaagttgttgaaggacctgggttaatcgcctacatgtgaggtttttttaaaaatatcaattacatttaaaaaaggaaagcagtagtaccaaaaatcgggcaaaaaaaatttacctaaataaaggaatgcataaatgaagccgtttaatctttgtatttaatgagaatattacatatgaaggtctcttgagaaagcatcaatagtggacattagctaccttttaaataaatgaacgggtatgtcacccatgggttcaaactcttcatcatcctcgtcttcactgcgtacttcatcgtattcgtaacccaaattttcttttatgtaatagtgatctttcttacttttcctcttttccaaaaggtcatcgaattcgtcctcttccatattcatttgattgaatttgttaagtattctttgtaagaatggtgtgttctccccagcagttgccgtggtattagcattcttcatagtattccttgggggtagcaagggaggacccgatgttggagttgattctgaactacggcttggagcaatattttgcatacgttgtgaccgattaggcggagggttcggtttacgattgggtagagtgttatttatgttgctattaacattattattgggcttactaaaaaaatcgtttatactcttttttcccttgagcatatttggtgaattatttacgtccacaaatgtctgttgaattcttttggtaaaagtagagaggtattcacttgggttctggttacctaatttctgttgtccatttcggggcagtgtatctttgaactgtaactctaattgttttaattctttttgggcgacctctaatttgaaactaagttcattgatttctctgtgttttgcagctaatttatatattaaatcttggtctgttgaaatcggacttgcgtggtcgctcacgggtgactgatttgtcgtagatctttgcggacttgatataggtatagcaagtcttttgggctttaaaggtgtcgtaacccttggtgattttgattcaggctgcacttcatgttgtttttgatgcggctgttgctgctgtccttgggagtgtttatcgacaatcgacagcttatgtaattcaattggttgactaattacacgctggtcttctgacattactttagggcgtatgtatggatgtattttgtattgcttttggctagttagtagtattcctcaatcgtattgtttttgattttgaaaaagctaacgataaaggtcaggaaaaaaaaagaaaattgtatgtaaaggaatgtctggagagagttacacaggaacagaaaggtccagcaacggtttctacaaccaatcatggatgttgatataggatgttattttgaagagaaacgctatgacgacaaactgttagacttcatcagatatgacgttaaaacacctaaaaagactaaatatatactacaaaggcctacggcgacagatgaagagagtgtacgattacaaaggttttaccaattaggagtagatctaaaattgaagtattccaagcggaggtcattgaagaagcaagggcggatcaagaatgctactgaggaattgctgcgattagccaatgaacagttgaaacttttcaacagaatagtagaaagagaaaccaattggataatttatccgctgtgggtaatggctaaacaattaattcgtctggcaaacgaatctagtgaacttaataaagactcaattgaggaatgtggacgcactatccatagaagctttactatatgcctcaatgataggaacccaagattgaatgaaaataaaaaaatcgggtgttatatgtttgctaatctagagttttccatctaccatcggttaagtaataaagatatgattaaaaatttagtgaaagtcctcgagagcagagtgaacgcccgggatataccaccgttgaataaaagcctggcaatggaacataagtctcaagtggtgttgtataattattatctaggtcaatactacggatgtctggaaaacgatcacgaacgcgggttcttccatttaaatgaagcattattgcaatgtccaatgctatatgtggaatctaccggcaagttcgtcttacagggccaaatggaaaagataatgatactgctggttccgcttgctcttttaactaaaaggttgtaccctcactgggatcatccagtaatcgccggagtaattactaggagtaagcgcttaagtcaagtttatccgacattagtgcgtagcgtaatctcagggaacctgtcactgtacgaggctaccgcagcaagccatgaaagatttttcctttcgcaaggattgcatgtcgtcatcacattacttcgagaggtggtcttcactcggttggtacaacgatgttggcaatgggggaatgatcggaaaagtatcatgcccttgaaaattcttctggcaacaaaacaacacgatagttctgccaatgaggacgaagaggagcagttggatgccctagaatgccgtctagcaagtgctatagcaagtgggcttttgcgtgcttatctttctcactccaaccgctgcatcgttttcagtaagaaggagccctttccccatagcaaatgatagaaaaatagtcaataattgaacgaagaaaaaaaaaagaaagtttgttcataaaagaatatcatattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgctgttacctaataacttcatgtgatctgctcccccttctcgttaaataccaccttttcatcaaccccgtagggcgcgacacgtctaaaatattaacctctgaatacttattgggtcaaaatgaatgttgataactttcctttacaaaaaaaaaactaatagagtatatgcatttcggtagtgaaatattcgttaatgctaatatgctcagtagtgatcctagattaccagttttactgcagccatcgtacaattttggaacgagtataaagagagaaattaaaaacgacaagaaatattcgtactagcttctcttccggcttgatgacagtcttaatatcatctgcaactcttgaaatcttgctttatagtcaaaatttacgtacgcttttcactatataatatgatttgtcaatgtgatgagtgaatgtctccctgttacccggttttcatgttgatttttgtttcaggctctaaatgtttgatgcaatatttaacaaggagaacagaaatgttttgtgacagcacctgtcaattttaggatagtagcaatcgcaaacgttctcaataattctaagaatgacatcagttcaaaactctccacgcttacaacaacctcaggaacagcaacagcaacagcaacagctttccttaaagataaaacaattgaagttaaaaagaatcaacgaacttaacaataaactgaggaaagaactcagccgtgaaagaattactgcttcaaatgcatgtcttacaataataaactatacctcgaatacaaaagattatacattaccagaactatggggctaccccgtagcaggatcaaatcattttatagagggtttgaaaaatgctcaaaaaaatagccaaatgtcaaactcaaatagtgtttgttgtacgcttatgtaatgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcctttagcttcgatgcagatagtttgatcaagtcattttgtttattacgtcccagttcgcgagaaatgatgttaaccaatgcccacccttttaggtatagttcgctaagttcaacgctcctcaaagcattctttaatgccttttccaagagctcggtcttggtttgtttcttgctacgtagagcctcataatacagagtctcacttagcctaccaaaacaagcgtaattgaatggtgtaatacataggacctgttccaaacaataacaggctttttcaaattggcccatttcgaaataaatctcgctggcataccaccacaattctgcatcaagcgggaatttatctgtaagagctaccacttctttaagaacactttcttggctcaagttcttggaagttgtcttgatagctatcaatttctttgcaatagagacataagtaacgaagtccgtttcatactccagatcatcattcaacaaattttccagatattcaatagcgcctttatcatttccgtttatctgcaataaagtggctttcatgattaccattttatacgaattttcaccaagacgatctcttaatgtattataaacaacttgcgcatcaacgtcttggtttcggtacaccaaaacatagaaaagcatttccatcaagaagaaatagtttccttctgttagtgcagagtctccgcttttcatgtaaattttcatttcattttctagttgcagtaattgttctggattaaattgagtatacgctttggtattcataattgtcaaaagcttttctctaaccaaatccttcaacattgttttatctactgctttctataattttctccgttccaatgcgatccaatgcctttcattcatacatagttatttatttcattaacgatccaaatctctttacttaacttcactagtcaacgcttctaacacatcacgcgatacgaagattaacagtttagtataatattgcaatacatacccatttcacacatcggtcaaggtcatcaagcacttttagttatagtgtgtcctatagttctttcagattgattgaggtttcatattagtgttgaaagcctagctaaagttctctgggcgtgcaacattcgaggacacatcggttgtttatacctcatgggattatggatggtcaaatagataaaatggagaagcgatatagcatgaccaaactggagaataggttaaggactttccaagatggtgttgcacttgaaaaaaaaaagttaaagtggagttttaaagttattccgtatcaggcaatggccaagcttggattttactttgatccagtgatcgatcctaagacatctaaactgaaaaaagactctgtaagatgttgctattgtcatcgtcaaacatacaatgtgagagactgcagatccaaaagaaaagatgttcttgagactctaagcaatataatgaggcaacatctgactgttactgataacaaacaagtttgcctccttatttacttgcgcaataagctattgacggactatagcttccatatgggggtttcggactggaaaaatgacaagtacttcagcaatccagatgatgaaaacgtgataaacctaagaaaatttacttttcaagataactggcctcacagtggttctcaaaatgaacatccgctgggtatagaaaagatggtgaatgcaggactcatgcgatacgactccagcatagaaggcttaggcgatccaagcatggataaaacacttatgaacgatacctgttattgtatttattgcaaacagttgttacaaggttggtcaataaatgacgatccgatgagccgacattataaggtttctcaaaatgggaactgttatttctttcagacacgtaatcgatttgagagaataaaaaatgacaatgacagtatcacgaaaaattgcgaagtctctccaactttaggcgaaaatgggaaaagagaagtgatcaacacgaaaaccgcttctcaaaggcagtgtcctttatttgagtcacctccatctagtactggtcctcaacttgacgattataatgagaagacagatatatctgttattcaacataatataagtgtgcttgatggagcacaaggcgaaaatgtaaaacgtaatagtgtggaagaaaaagaacaaatcaacatggaaaatggaagcactacattagaagagggcaatataaatcgtgatgttttagcagataagaaagaagttatttcgacaccaactgcaaaagaaatcaaacgtccaaatgtccagctaacccaatcatcgtcacctataaaaaagaaaagaaagtttaagagaatatcgcctagaaaaatctttgatgaggaagatagcgaacactcccttaataataattctgccaacggagacaacaaagataaggatttggttatagattttacaagccatatcataaaaaatagagatgtagggagaaagaatgctattttagatgacagcacagatgaattcagtttcagtaaccaaggacataacacatttgacatacctataccaacctcatcacatttgctcaaaggtatagattcagataatgacaatgttatacgagaagatgatactggcataaatacagacacaaaaggagcgtcttctaaacacgaaaaattttctgttaattctgaagaagatttaaatttcagtgaagtgaaactcacaggtagagacagtagtactaatattcttataagaacgcaaattgtagatcagaatttgggtgatatcgacagagataaggtccccaatggtggatccccagaagttccaaagacacatgagttaattagagataactctgaaaagagggaagcacaaaacggggaatttcgacatcaaaaagattcaactgtacggcaatctccagatatattacattctaataaaagtggtgataattccagtaatattaccgcaatacccaaagaggaacaaaggagaggcaatagcaaaacatccagcattcccgctgatattcatcctaaaccaaggaaaaacttgcaagaaccaagaagcctatcaataagtggaaaagttgttccaacagaaagaaaattagataacatcaatatagatctaaatttttcggcgtccgatttttcaccatcatcacaatctgagcaatcatcaaaaagctcaagcgttatttcaacgccggtagcgagccctaaaattaatctcacacgcagtttgcatgcagtcaaagagctttctggcctcaaaaaagaaactgacgatggtaagtattttactaataagcaggaaactataaaaatactggaagatgtgtctgtgaagaatgagaccccaaataatgaaatgttactttttgagactggaaccccgatcgcatctcaagaaaacaagtcaagaaaattatttgatgaagagttttctgggaaggaattggatatacctatagattcatcaactgtagaaataaaaaaggttattaaacccgaatttgagccagtcccatcagttgcaaggaatttggtgtctggaacctcttcatatccacggaattcacgtttagaagaacaaagaaaggaaacaagcacaagtttggctgataattctaagaaaggaagttcatttaatgagggcaacaacgaaaaagaaccgaatgcagcagaatggtttaaaattgatgaaaatagacaccttgtaaaaaattacttccatgatttgttaaaatatataaataataatgatgctacgctagctaatgacaaagacggtgatctggcttttttgattaagcaaatgcctgcagaagagttggacatgacattcaacaattgggtgaacctaaaagtgcaatctattaagcgcgaatttatagatgactgtgataagaaattggacatattgagaagggattactatactgccacaaattttattgaaactttggaagatgacaatcaattgatcgatattgctaagaaaatgggcattttatagctaactaatttgataaacaggctaaaggtttgtattttttgtagttttgaaactgtgtatagaatgtttcgccgcatcgcagatatctgcagggaactgttgacatagcatcttctgtggacgtgacaacgttacgtatattcgttgataccgcaagtctatagcgtatacatgctaaggcaaaaagtttcaaagtgaatgcattatgtatttatatgtaaataagtaagaaaagtgggattttgaaaataaaggtgtagtaggacagtaagtattcaatgaaatacaattataacatatcttcatcgggcgttcctgatgcttcatccatttgagaatcaatggcagtgtcaggcattgattcgtcaattgtgttgttgttattgttcctaaccatgttctgattacgaagtcccatttggagattcctcatctggtcaggtgatatttgcattctattgccaaactgacgccagaaatttggattttctgtttcattgtcatcattaccattgttagtttcattgttacttgtatcgtttgccccagcatccgatacaatattcactatgttgttggcgttccggttggcgtcattgtcattattgttattccatgctgatctttggtgggctattaatagttctctttgtctggttaacaatgttatgttatcttttaaatatagtctcaaaacaacggtggagagcttgtacttctgaaccaccataatgaatttgtcaatgaataaaagtcgccatattaaaagccctttttggtaatctatgttgcccgattcctgaaccgttttttgtactaaacaaatttgtctgtttaattcaatcatttgcatataggtttgagtcatttcatgaagtaaaaaaccagtaaactgaaactgaactcttaccaaactagcaacattcacctcgaaatcatcaatatgatcatttaactcatggaattttctaacaatatgacacatttcactgttaatttcccggtttacaccaggtgctacgacataatcttgatcatcgtccacatcactaaatggatcttcacaaaacgtcttgtttacttgcaataatagtgagttaacttcctccgagctcatcctaatgccatcaaaagtattgagataccaactgaatacttcatctattcgttcaaaattgatattctggaaaagaaaatcgttatttagaccgttgatttgatttaatcctgtagcagctataattgcagcggaatcttgatttaaatcagttatgattctcctaagagcatcttcaagtgtttcaccgttaaatatcaaattcttggatctaatatattttgtcaaaacatcatttacatcgacatgtggtccaaaagcgggcgacgttaaatttactaaataatggcgaagtttatgaacacctttccctgaaaatacgcagaatatttgacgttgattttcactaaagtctgagggtgcaggcctgcaatacatcgttatatcggggcgtaaaaatgacggaacagcagtcaaagacaaatgtgagagccttgggcaagacattagaagctcatatatcggatatattgttaaattagaacagtaagataaatgtaccctttctaaagtatcatttcggcctcgcaaggaaaccatattcaacaaaccctcgtcagtcatttgcgtacatttgacaaggccaattctctttaattttggtaagtctgctagttcataaagagttctattggttaaattcgtacagcacgcaaagtccacatactgtattcttgtacatgaatgaaagagtgctcttaccccgttatcagttatattgaaacagtgcccaaaatgcactgtttgcaagtttttgcccagcttcgataattggaacaacgatgcatctgtaattcggctacacttgcctagaaaaacattacgtaatttaggggctaaattgactatactttctatagttttatctgtaatattttcacatccagaaagatcaatcaatcttaaagagggcatatcgtcaactactttagaaagctcctggaaaagattatccgtaatattcgtattatgagttattctgaattccctcagctgaactaacctagtgaggagttttaacaaactagaatcagtgacatttggacttaatgttatatcgacctctacaagcaaagggcatttgttggctaatagttctactaattcgtcattcatgttattgtttgctgtgatttttattcttttcaacatcggggaatggactatgaaattccgcagtgaatcgaatgttacattccttgcctgaggaacataaaagccctgtactctgggacaatatgtcgctaaggtatcaaatacgtcatcggaaacgtctcttattccagtgatatccacactttggagaaatttacatcctctcaaaacagccgatattggaacactggttatatgcttgcaaaatactaaagttagtcgctccaaattcttacatccgacaaaatagttaagctctgtatcgtgcatgtagtcaccaacaaatgaaaaatttaatcttttgatcattaaacgatagttgaatacagtttcttcagaagttaacttcatagtccttaaaaacaagtctaattgactctttttgttgatgtgcggtctgtaataaagtatcttcacaattatttcagcccagagtttggaaacggtaaggaattttacaatatcatatttttggttaagtttatctaatattaagtgtaatatttccgagggtagcatgtttagggcaaacacaggtgatcttcgggtgacactcgtacatatgttttgatttgatggattcgaaagcacattatttatgaactgccttgaatatctcgaaagatcttgtagcccttctttcaagtcagatgattcagtagtatctatggagtttatccaaatgatgaaattatctgttggattttccacttgttgacctcttagcttggaatggcagtatgcatataatgactttttgtactcttctataattgttaatatttttagccttaaatttctaatttccatgttttctgtctctagcgccctaagcctcattctttgtaatttatgcaaataactaattgcttgtggggagttatcaatacgtagctcctttagtttaaggttgtctagctcaatttcgttcagtattttttttctacgtttctctataacaaccagaaactcttggatttttttgcccactattagcttgaattcgtggatttgcttccgttcttcctctggtaggttcggtaacaatcgattaagttgatctatttgaacattgacaccattcataaggtttgtgttcacagtgtttatgtcaatcccgttcagcgcatttgtttgctgttgtggttgaaatgtcagcgaaaagttttgatttagcggttgtccgttgttggttggcaaaagcgtttcccgttgaatactatcgaacctaaagatattatttagcgttgcatccctaacctcacttgcatttctttccgaagttgccgtttctctagttcgtgatggcatttgtggtcttgtgctattattattgttgttgttgttgttgttgttgttgttgtcgtcaaaatcaccgctactattcagccacaattgagggcccaaatttggatgtatatcaggtgggtgcagcctattgctgtcattgtggttgttgttatcctgatccattatagaccttcttagtataaaggaaaccgcaaaactgtttagcctcactaccaatgataattattgtgccgaaatcaatgagaaatttcaagatttcacgcaggtgtaagcttaaatgcaatgccttaatttttgggcttccctgctagttggacacaagtacgattttgatattcaaaaaccgggcttctaagagaacgattaaatgaaaacgaattattgtgtaaaatcgaaaaactggtgaagtatggacaaaagaaagtaacacacaggcacagttaaatttggtgttatgtattttgccacgccttttttgataatcatatcactaaatttgttaaaaggcaaattttaaaacaagttcctttaccaaggaaggtccataggcgggtaacctcagtagtaatgaaagcctagtaatgatgactataaatgttcattaacacatctgggtaataaatgatgatatttttaaaaactgtataaaactttatggatttatttaatcatgattaggtgtagaaaaaaaatttggcgatatgatggcttgaaaaagacacgtcttcccagtaatgaaaatgcccaaattcttcattagctcgctcatattctattaggatttgaaccataaaaccgttgggggtaaatgagatagttttgaatggatgcaggtatgagaagaaaacggcgtggtctcccaatgatgacggaaataaaagaaaacatggggacgtcagtttgcagagtgtaaagtcagagtttcaaaaacggtgttatcgtcgttatagttcgtgttgttattattgttgttgttgttcgtatgaggttgtgaggagccaacattgtttactaattccatagtagtgttgttatggttagttaggctcagttgtggcaacgataaacgggttccgttattaaagtttagcatatcaaactgggaacttaagtcatcgttgttcatagcatatccattactggcgttgcctgaaaagccgctgacagggaagacgccaggataactaaaatagcccattgaagaattagaattggcattcaatggttggcccggggataatgtagaggcagaagaaccatttgtagtcgtggtgttcattgtggtatgtttagatccaccacttttaacgctagaaacagaaagacctctcatgtgttgtccagaagtatcaggagtggcgaacatgtgcgaaatgctgctgttatgatgctgctgctgttgttgttttgtcttgttatgagtactagagggtgatgccaacccgacttcttccaataaacggcggcttggttggatttgagtagaatccgtcaatacttttctgacttgtttaatgatgtgggctcttaagtcatcttctaataatggcattgctaaaactttatggacaaaggttgggccataatttgtttcacataaaagctttgttaattcctttggtggcgaagaatcgtgtgcgttcacgtttccaaatagggaatctaggatgatttttctagcgttatcatcccctctgtaattcaagaccttcaaaatagtcaaagaagccaatctgtggccacataactctacaattcttttcgtcaatcttggtgccaagatagaatgtctgttgggtaaaacactagtatctaaaaaccacgttactaacaacgcaccattgctattagtgcttagatattcagcatatgtaacgatcattgcactcaaaactattgattgttcaggagttacaatgtcatgtgcctctaaacaagctctgactgcccttgcaccatatctattctgaacaataacccaaaaattagctattatactttcaaaaataaactggttccaggggaatccaaatttcaaaacgcactgtatgacataatttccgaattggtcattgattaatggagtacagtagtccttgaccccttgcgtcacttgcatgatttgtctcggagtatgcgccatagtgatcatcttctgacaagcccatgttccgtttttgtgaacacccatagaggttaggtatttgcttgttttcctcagcatgatgtctttaataatatcagatgaatgttcaaataatttttgaacgatagtgttacccaagtaatctgaactcaattcgggcaattcgtcaagcattgcaatagccaactgttcgatctctaagtcggaaaatgcgtttgaatcgattgattttcgcaattcgcgtaattttggtggatcgaactccctgccagacaatggttctggtaaaggtccaaagttttgcgtatcggaagtgcctttgtgattcagcgatttttttatcaacgaattgatttggtattcatcggaatttgcttcaaaaagttcgatgatctctcttaacaaatcttccttttcgttaacgttaggtggtggtagagggaaaggacattgttctttttcatttgctgagttattgttgtttccgtgcatactattgttattattataaccatggagaacattgctaaaaccagcagaacccgaactatggttttggtgctgcgattgttgtgattgctggttaaatacaggtatagaaacatttccttgttgttggaaagtcacagctccattgaataactgctcctgtaataaaggctgtggttgcaaattgttgttttctaaacccaatggcaagccttgagaattgagaagaaattgtgggggttgttgatgcataggtaagattttggcaaatgaaattttacttggtgctccaatcatagatacctccttgccctgtaaactatctaaggcttttacggcactttccacggaagaaaattcaactaaagccatgtttaaattccttaaagtcctagcagatatgacttcaccatatttggagcatagggttgccaaggaagtacttgttaagtttatcgcgttatttaattgtggctgctggtgctgtaggggaaaaacgttggaaatagaaatggtatttgtgggtaaaaggttcgatatttggtttattgatggtacagtggggtccattgttacccaattgatggattgcggatctatttcatcagcaatcaatggagattcctgtgttggaatagtatagtgcgatgaaatactggcacgagcgggctgttcgtacagtggagcgtcggtatatatgctagacgcgttggattgagatctctgtctggtatttgaccaaacagagtttgggatagccaagttattcgtattcatcttattatctgccatttggcttccactagtagataccatgttgtcaaaatatgcagtttttgtcgaataatcgttgagcgtgtttgaattagttgtattattgcttgtcgtaggttgcaattgttgcaaaaggtgctgttgcatgggatcgttcgcactagcatttgaagaccatattccgctcgaagtacgaggcttgggggcgattgatgaaatggaagttatctgagaagacattgtgttgtttctcgtcctcgagatctgatgtggcaagttaaacgagtcgctagatcctcggggggcaggaattaagaagttattactcgagtcaggaaaatgcaccaatttttccatgtcttgaggaggggttaaactgccaggtctatccatagttacaccgtctatagaactttccatcatcttactcctggaagggctggcccttggtgtcttggacgccaccgtagattgggaactgttgttgctagaggaaaactcagcaccgttctttccgtgactatttttcttcgaatggtgtaacttggcactgatggagggcaaaaggttactcaatgtattagaaaattttcctgctcgcgacctatatgatccaagcttttggggttgttgctgcagttggctattactctctccattgttctcgtattcttcctcgtatattgggatagtgatgccagggtcaatcacctcggggatgttggacaagttgttgatgttcatctgcttacttttatccatcttaagaaggaataaatagacgttcacgctctttctcacacatacacacaaatctctcgaagtgcctcttattgttttaactattcatctctatgcgccattggtcatcctacgagaaacgcccccctttgtcccaataattgtcggcgggtaatttgtccaaatgaaaaagagacattgtcgcgaggaacgaatagatgacccgatttggaaaaaggtaaacaacaatgaaatattcctcgagaaaacaataatgtttatttatgcaaaggaaacacttagaagggaacatctccattcactaaacttcgttggtttggtgtatatttctttgattcagtctgtgcaagaagaattttttagttcattaaattatataaaaacaaaagtacagaagcatgcacgacgcagagagtaccgtagattctctactgaaggagatagacaatgaaatggaacaaacaaagtctaatatcacgcaaaattggttccgaagatacaccacacaactggaagcttccgctgcaggaaataggcgatgataccatggaaatgttggtcaaacacaatactaggtcgaatgctacagaaaatagtagaggtcgatcaccttctaagatgtctaccatctcaaatgaaagccttaatttggggtctcttacgtgtaaattcggaacttgaagagtctccagccgctgtgcatcaggaacggattaaaaaactctgttgccaacggggcacttggtcatgccaattctcccaaagtgcttaataatctgaaaaatatggcacaagatatagataaactagcccgtgatgaggaaaagcccgtaaaacttagcagctctccccttaaatttactttgaaatcgactcaaccactgctgtcgtatccagaatcgcccatccacagaagttctattgaaattgaaacgaattacgatgacgaagatgaagaggaagaagatgcatacacatgtttaacacagtcacctcaaatattacactctccatcaaggattccaataactaacgcagtgtcgattaataagctcaatcttgatttcacattgaatcccaacgaatcagacaaaagtctagtatctgacacctcagttgatagcacaggacgagaactagatacgaaaacaatcccagaattaccattttgtatgtcatcaacgcccgaaatgacgccagtcgatgagaaatgtaaccttccaagtaaattgttgaacactagtaacaattcacattctgattcaagatcagccaacagcctctgtggaggatttaaacatttcaacgaatctagccgggtgctgattccagccaaaataatccagtcactactgatgcggatgcgcttattgaaaacgatgttgtgcagggaccttcaacagaatatggaacatatcgatgaagcttttgatgagaaaaaagttcttgacgaaggttgcagcaatgagcccgttacctttttgggtgaaaatgacactaggtccatagtatactctaataaagggaccaatgctaatgttcaagaattttcacaggaagattctctagcgcacagtgaacccaaattcaaagatcttaatgctacatcggatgacgtatggaatgaagacaaagaaacagacgcaaatatttcaacatctacaaagtcagaggaaagctacattgctgactataaagtaacgagacaagaagactgggataccaaaaagcttcatcaagaaagtgaacatgcaaatgaacaaccggcaataattcctcaaaaggattcttcagaagaaacattcactgaactaaataatgaaagtgaattccaaaggaactttaaggatggagaggaataccgaatcgttcaacacgaggagagcctgtatggacaaagaacaaagagtccagaagaaaatataataaatggcagtgaaattggtgtcgaccatggagaggccgctgaagtgaatgaaccattggcaaaaacttctgcagaagaacatgatctttcatcatcatgtgaagatcagtcggtgagcgaggctcgtaataaagacagaattgaagagaaggaagttgaaactaaggatgagaacattgaaaccgagaaagatgaaagtgagtaccataaagtcgaagaaaatgaagagccggaacacgttcccctcttaccacccctgccaagatgggaagaaattcaattcaacgagccatttatagatgaaaatgatacctccaatgattccatcgatttaaccagatccatgaaaccatcagattacatttctatatggcatatccaagaagaggaaatcaaatccaattcaccagaatccattgccaactcccaattttcacaacaatcctcgattaccactgcatctacggtcgattctaagaaggataatggatcaacttcgttcaaattcaaacctagaatagtgagcaggagtaggatttacaatccaaaaagcagagtatcctcattgaattactacgataatgaagattacattttaagcaacagtgaatggaatgcactcgaccctatgagaagaaatacactcatctctaaaaggattcaagataacataagaactcaaaagggtcacgctccacttattaggccaagcatcatgaaacttaatggcgaagattctggttttcagaatcatttcttggaggtagaacaaccgcaagaacacgaaaatatcccattaagtacgcacctaagcgaacaagatatcacaacaaatgtaggcctcgatgaacagaaattaccaaccaatacccaggacgaagctgaaatttccattcgggaaatagagagtgcgggtgatatcacttttaataggggcgatttactatctttatcctttgatgaggaattgggtcaggattttgctaattttctagacgctttggatcatgactccacatctttcaatcatgggccggatgattcatccagttttcaaagagacagttcaaagaaaagcttcaattctctttgggaaagcagttacgaactaaaaccgccaccttccataagaaagcaacctattgcccccgacgtcctgcaaaaattattagaatcagatactaaagatgacgcagatttggaaaaaattagagaagagcgtataactgaaccaaggactggtttggggattggaatgctgaaaacaccagttaaggatgtttcaattgcgctagctgcaagcattaaaggatatgaggcaagtttcagcgatactgactctcgtccagagggcatgaataatagtgatgccatcactttgaacatgttcgacgatttcgaagaagataaaatgaccccttccactccagttcgtagtataagtccaataaaacggcatgttagcagtcctttcaaggtcgtgaaagctggaaacaaacaagagaataatgaaataaacattaaggctgaagaggaaatagagccaatgacgcagcaagaaaccgatggtttgaaacaagatattcctccactgctagcgcagacaaaagataacgtcgaagcaaaagaagaaacgataactcaacttgaagaaccacaagacgttgaacaagaatttccggatatgggaacactttatttaagtataaaggctatttccacgcttgcattatatggaactaagagtcatagagcaacatatgctattgtttttgacaatggggaaaatgtcgttcagacaccctgggagtcgcttccgtatgacggtaacatcaggatcaataaggaatttgaattgcccatagattttaaaggaaaaaccgaaacatcctccgcttcttctgaaagagatagctacaaaaaatgtgttatcacattaaaatgtaaatatgaaaaacctcgacatgaattggtcgaaatagtagacaaggtgccggtgggtaagagtttttttggaaagacaaagtataaatttgaaaagaagtatgtacagaaaaaacctaaacaagatgagtgggattatctatttgcacaagacggttcatttgctcgttgtgaaattgaaattaatgaagagtttttgaaaaacgtggcatttaataccagtcatatgcattacaatatgattaacaagtggagtagaatcgcagacaaaattcacggctcaaaaaggctgtacgagttaccacgcaaggcgcctcacaaagtggcttcgttggatgtggaagcatgtttcttagaaagaacttctgcctttgaacaatttcccaaacaattttcattggtcaataagattgtttccaaatacaagttgcaacaaaatatctataaagaagggtatttattgcaggatggtggtgatctgaaaggaaagatagaaaacaggtttttcaaactgcacggctcgcaactttctggttatcatgaaatctctagaaaggctaagatcgatattaatctgttgaaagtcacgaaagtcctacgtaatgaagacatccaggcggataatggagggcaaaggaattttacagattgggtactctttaatgaatgcttccagctagtatttgacgatggtgaaagaattactttcaacgcggaatgctctaatgaggaaaaaagtgattggtacaataagctccaggaagttgttgagttgaatgttttccatcaaccctgggtgaaaaagtattgtgaaaagttagctgaggaggaaaagactcgaacaaccggtcataatttgaagcaagattttaattagaaggtgattaatggaatgaaaacagcatataatctgatgactgagaggtctttagtttaaagattaattaaatacacataataagagtaaatacgtgaatcatggacgatatatttttatttcaatttcacagatccccattcatttcgaattttgattttgattttgattaggctgttggttcatgggtggcatcatacctggcatggggaatggtggaaagctaccaaacataggtaagggtgggaagcttggatgcattggtggagcgggagggtttggtgttccagacatactattacccatattactgttcagattagacatatttgcattgtttacgttgttgttgttatcaattatattaccgaggtttgagtctgtatcattcgcggaattcaacttcccttgctgttggagggataataggcccattaggatcctcctaggattataatcttgttgtagtttttcctgtctatgtaaatactccatccaggtaaattcgttaaaaccgtaattgaaataatcacttaagttggcccccggttgcctccagggtttctcctttaatacttcaggatctattgtcgttatgccaacactatcaaagattccctctttatccaggtctatagaaccagtcattgctttcggtacatttccatcgctctctgtagcttttacggtcgttgccgttacaccttgatttgcttctccttctgttattagtctttcatctgatgtctttgtgatggtattggatacatctgtagctacgctaattacgtctttgcttgaagatgtcgctgcggtagaataagaatcgagtagttttgcatctaacctagtagggtcaggacccagacttatgataacctctaggtcagaatcactatcgtcatctgaggagtcagagtagatatcttcatcagaacgatcatctctggcagtagctggagtttcttccacgggagagtcgaatttttgccttttaactatatcaggattactggacgcacctgcgtctgcttcatcatctcttgatcgtttagatgaaggtagtgctaattcggagtcggaaccatacaagaacttgtcgtcttcgtcttcactggagctcatttagagaaatgctaataattttagtgtaggcaaaaggaataagaatgcaaagcacgatggtgcggtttaacaaagtgaatttggtgatgtactctctcaagatttatgtcgcattattcgctacgaaggtttttcaagattaaaacgaatctcctttcccatcgcgacatacgataaggctaataacgctacggtattatgtcatggagcttgagacattgaatacatatatatacctatatataatatatatatatgcaaatacacaaattcttagcaatttgagtgagacaatggaaataaagaaatgagtgtgaatggatatattttgagggaagggggaagattgtagtacttttcgagaattaagaataggttttactaaacttgtaggatatttcttgaaacctgaccttgtcataataatcttgatcattagaactgctgaaggagtaagccgcagcatatcttgacagtttggagttcaacttttttaggaattctaactcttttgaatttaatttttgtagtgatggcggtggtgatttttcaacgtcgaaggcaatttctaatgggtaatagtaggagggcacctgaggttcatctataaatggatctgcctcatatacattatcggaggcgttgttattattgctggtattattatagtaattacaattagtgcttttatggttgctatagtgacgattattaaaggaatgtatgttatcagtatgtggtggaaactgatcttgatattgggagtatgaatccgtgttttttgaatttattgattcatgaatatttgtgggttttgaataggtataattagtggtatatgggtagaagtcttgtgtgtatgggaattcattgaattcaaaattttcttggaatattttgatatctttttgtgcatttgtattagtttcatattttattgtgtcactaatatcgatatcatctccatttctgttgctcttttgaaagttatcatggttattgaatgatgagtggaacgtagatgcggattcatcattagaaaaaagagatgataatgaagaggatctggtactttcagagctcttttttcctctttcaggaccagttgccattgtgcagtccttcgtagttttcgtttccttggaaataggctgagaatcaatattttccaaattcagaaactcttcattgaacaatatttgaggattaattaaatgaattggttgtgtatgaaccaagttctgcagctgagatgaggcaattttgtcagacttttcaaaatgccaacttctaggggaaattgtagatccaaaagaaaaacaaggacggtcttcttgatcggtggttgtgtcataataaatgttaggttgttgttgctgttcaaaaggaaagaggaagaaaccatcttctaaggcagcgtgaagttttccatgcatatccgcttgcattttgtttgtggggagaggaatagaaaagcttttcttttattatttttttcctttttcaccagtaatgggtgccagtaggaatttgtttctctgtaggtgactaatgacagtagtatattatgcttttaatctttaacaatactactggtcgatttataatatgataatgtaaaataaatcgtaataggatagtcgatgtttgtatctacttcacgaaacagttatggtatacggtagtttaaatatctgaagaagcaaaaataccgaactacaagggaagcattttgagaaaaatattaagatcaaaagataattaatttaccttaaatacataaaagaggaaaagtaatatacaaggtaaacaacaggcaaggaacaagatcaaaaacgtccgaccccaatttagtagtaaattacagtaagagaaaaaggtattggggctgatacatattaattgtgcgttgttgttgttgtttaattttagattggctattatgagtacacacaaaacgttgtaaacgcaatcacccatggataagcgctccctttaaaatgcactacgaaatcattgatctactaactttaaaccggacttaaaccatcaaagggtgctctagatctcatcgatgtattctgatgcagccaaaattgcgcaatcaatcacgtttcccgatatagaaaactaattggctgtgttacgtggctgggggttctgtaattcctttcttccccggtgaatcatcaagattgggctaagcgcctttgatcctttccctcgaagacggaaatggggccgcaggataaaaaatggtgtgtctgtaattccgattttttgcttatgtaatcatgtaactttcttctagtccctttgcagacatgcatgacacttccttacccgaatagtgagttagatctgtgttaggatgcaggatgggcagttcaaaggcttttcttatcgtatctttaccttttcctgtaactaagaaggtttttgagtgcatgtaaaggcacataaatgaaactttaattccctgcgtatttaagacccaagaagccaccatgacgcttccttgatgttgtatctacccccaatcctggcgccccctcctgcgggcacgcatgcgcctttgatccttcccctcgaagacgaaaagtaaacaaagatacgcactttttttctccaacgcagtattgaaggtaccatcacatgcttactcactttgcggctgctataacaccgtggcagtgtaacgttttaccgtttgtcctttgctaccgcattttaaagtggtacaagatgttgagagaaaagatttcctgcagccatgattaggagaggtaatagcggatgacatcaacgaataagctttatccagcggcttgtatagttctgtgtacacaattactgccgggctctctgagcatttgcgtttctcgggctagcttcattacttagtaacttcaaattaatgaaatatttaattatcatgattccaaacaaaactactttaatttcaatcacatttttgttatctgcctgaaacgatagctgtacgggtacgttcttgataaataaaactcagtgtttaaaactctctttttacatctgttcgccgatgattgcttgctcggaggtactagtcatcggaattgaggaaattccttttctcctttgttttctctttatccccgcgtaaatacgcggaatgccaataatcaagtacacattctttctccaagttggccaaaaaatagttcaaattctttaaactaagcgctattaattattattaattatataagtttgaaaatatcaatgcaggaccctatttcttcacgagggtgtatccagaaacggtttcttatatagtgttggcgctcacttttttcctacccacgtctatatatgcaacgcctacttgttttaatcaacatcacaattttatgcttttgaggtacagcagttagccgtacgttttcggcagtcgctaaaaatgtaagcgcggcatttactgccatttagtggacttcttgaggttcttttgacatccgcattcttgcagcaaatacacccccacccttcttttattgagaatatctactgaacctccgtgagggaatacattaatcaaattactccaacaccatacgggccgtggcggaaagaacagcatgatatagataatatatgatatgaattgatttttttttctttttttcttgcggctggtatggtattgtaaggatgatagtgcattctatgagtgatttttgtgacggtgacgtacgatctctatacctttttagccgcccatcttctgcctttcatttttatgccaaccctccatccatacatcctttttaacccatacatatcatttagattattgttttttaattttttttttatcagatgttgttcatcgcgaaatttataatctttcgattgaatcgcacttgtcgtgcataatgataaataccttccggagagaaaactcagacccactgggaagttcctacctgccgagtaagaccagcttgaaaaatttgaaatttcaactgagaatcagaatatattactgcccttcgtgttgtagggttattcattaactatatacgatattataaacagcatagataatcaaacaaaaaaatgtatgcatataatagaggaattggatgactaaatgttcttatattggagttagtggagatgcgtggtagatttgaattaaatagaaagtgctggggttgataaaccacgaaatatcgcagttgaggagaatgataagccaggatagatggtagcgcatttttggggcaatctcactgtaggtccaccacaactcaatatgactacatcgaatcagttataaggcaagtttttagtttactaacaaatatttccatcttattttttttttttgcagggctaagagaacaaagaaggtcggtatcacaggtaaatacggtgtccgttatggttcatcattgagaagacaagttaagaagcttgaaattcaacaacatgccagatatgactgttccttctgtggtaagaagactgttaagagaggtgcagctggtatttggacttgttcctgttgtaagaagaccgttgccggtggtgcttatactgtttctactgcagctgccgctactgttagatctaccatcagaagattaagagaaatggttgaagcttaaacttctttcattcattttctcttggctttcactaggtatatctattccataacgactatgttttgtatttgttaatttacataaaaccatatcagtacatcaacgaactgtaaaaaagaaactttagcataattattgcggatatttaaactcacttgcaggtaagagcaaaaggcgattgatttccagtccgcctcttgtcacgtgatttagtaagaaattttgacagcaccctcggtttaatggaaaagaggggcgtttttcgatgaacccgaggggagactagagaatcatctcggttgaatggagcattatttttttagtagcgcccgcccggagaaatggacgttggcgaatgagccatgaattattaaccgcccatgtctaccagataccacatcgtatgacagtaccagcctagtcccggtaaaccgcaaacggaccttaattgtgacgaagggcccaaatttgatgggtcggtgttaatgattagtcctcattgtcataataaagtgtgatgatggaggcaatgatgatatacggtagtactactgctcgaggtgctatcttttaaccaatcctttgagattcttgtcgccacggagttactaccttttacaaaccgtaatgtcacattttgcatatatcttatgtataaatatatagttcacttactacttgttctcgttttgttaactttcttgttgtagttcttcttgttcttggcgtttccccctttgttttctatctgcttcataagtaaagtgcaaagcattttggaagatattatcaattgagtcattgaaagaaacttggcatcttccctattactaaaactaagaatacttgattcaagaaagaagtttatattagttttagccgtaagataacataacaaagaagaagaaagaaaaatgtctcaaaaaaagaaggcttcccatccagccatcaatctcatggctggcggcacagcaggtttatttgaagcattgtgttgtcatcctttagatacaattaaggtgagaatgcaaatatacagacgggtagctggtattgaacatgttaaacccccaggatttattaaaactgggcgtaccatttatcaaaaagaaggtttcttggctctgtataaaggtctaggtgctgtggtcatcggtattatacctaagatggcaatccgtttctcgtcttatgaattctatagaaccttattggttaacaaggaatcaggaattgtgtctaccggtaatacttttgttgctggtgttggggctggtatcaccgaagctgttcttgtcgtgaacccgatggaagttgtaaagattaggttacaagctcagcatttaactccgagtgagccaaatgctggtcctaaatataacaacgccattcatgcagcctacactattgtcaaagaagaaggtgtttctgccttatatagaggcgtttccttaactgcggcaaggcaagcaactaatcagggtgctaacttcacagtttattctaaactgaaggagtttttgcagaattaccatcagatggatgtcctaccttcatgggaaacttcttgcataggtttgatttcgggtgctattgggccgttttccaacgctccattggatactataaagacaaggctgcaaaaggataagtccatctcattggaaaaacagtccggtatgaagaaaatcataaccattggtgctcaactactgaaagaagaaggttttagagctttgtacaagggtattaccccaagagtgatgagggtggctccaggtcaggctgtcacctttaccgtttatgaatatgtaagggagcatttagaaaatttgggtatattcaagaagaatgacacaccaaagccaaagccattaaagtagatgatgaacaatgggactacaaaatgaaataaagaaaaaatagaaataggctagaagatcaattattaatcgccctattcttccttattacctacacaaaataaagcagcaacataagaaacaaaaacaaaatgaaaacaaaccaaataaatctatgtaagcatactcatttcaatttgatattcattacttgacttttttgtccttatttgaggctccataagcgcgccatttttccctactcccttttttcgtaaatagtaataatgtgctgaaaagaacaatgaagtagttatcatacatattccgtcgtgtcgatatgaggggaggtgtctctttctttcatcccttgtcgcaacctccaatatataagagcataagcaactgatcttactttagtaattaacttagcatacctagcccgaaggaagaaaaaaaattcacctcaacaacatggttcctaagttttacaaactttcaaacggcttcaaaatcccaagcattgctttgggaacctacgatattccaagatcgcaaacagccgaaattgtgtatgaaggtgtcaagtgcggctaccgtcatttcgatactgctgttctttatggtaatgagaaggaagttggcgatggtatcattaaatggttgaacgaagatccagggaaccataaacgtgaggaaatcttctacactactaaattatggaattcgcaaaacggatataaaagagctaaagctgccattcggcaatgtttgaatgaagtctcgggcttgcaatacatcgatcttcttttgattcattcgccactggaaggttctaaattaaggttggaaacttggcgcgccatgcaagaagcggttgatgaaggattggttaagtctataggggtttccaactatgggaaaaagcacattgatgaacttttgaactggccagaactgaagcacaagccagtggtcaaccaaatcgagatatcaccttggattatgagacaagaattagcagattactgtaaatctaaaggtctcgtcgtcgaagcctttgccccattgtgtcacggctacaaaatgactaatccagatttattaaaagtttgcaaagaggtggaccgtaatccaggtcaagttttgattcgttggtctttacaacacggttatttaccactaccgaagactaaaactgtgaagaggttagaaggtaaccttgcagcctacaactttgaactgtcagacgaacagatgaaatttcttgatcatcctgatgcttatgagcctaccgattgggaatgcacagacgcgccataaaaagaaaatgcgaaccgtagaataacgtatatagaacatataattagtttacgtttcacaaagtattaatattacatgtagctttttcaggactttcgatctaaatcaaagattaaaggagctgctagaggtagaaaaggaaatcattgacttttcttgaagatttatgagcgggtaactggagatggaaattttcagaaaaattgtaaatggatgcgatgacttcgatgtgacgttactagtcttaccattgtaaaaaccactatcggtgccaaaagataagcgcaatcaactaagaaatttaccacgctctttgtattgtatttatctccaatttaatctttcttttggtgtgaaaatttagcgaaaatgtcattggtgaattcgttaacacactacgaaattttaagaattccatcggatgcaacacaagatgaaatcaaaaaggcatataggaatcggttactaaatacgcaccccgataaactttctaaaagcatacatgatacggttagcaacgtcacaatcaataagattcaagatgcttataaaatactatcgaatataaaaactcgtcgcgaatatgataggttgatccttgaaaactataaacgccaaggatttcataattgtggtgatgggctggatgaattttccttagacgatttctcatttgatgaagataagctggagtttatgatgaattgtcctcgctgtcaatttgttggtggttttcattttagtgagagtttgttagatgaatgcattgataatgtagacgctatggaacggagtcattctggttatcaattattaacccaatgtagcgcatgcagcttatggctgaaggttaattttgacatcgaggaagagcaagaaggacaataatgaaaatgggaggggaaattgagcatatcagataaatctgtttatagaattattattttacttcgtgggaaatcgaatggtgtatataaaagaggttgtaaaattgacgaaataaatagtatttaggcaactaaagataaaaaaatattatttatttttattcgcggtgcgttgccagattttttttgacatgcggaattttggtaaaaagaaaaatgcagatatgaatagtaaacaaaggaataaaaagcctttcatgaagaagttcgtgttcgagatcttcttccttctttttcgctgtcgacgatagatatgaatgcttttgccattgatttcaaatccgtcattaagctaacatgacctgaagaactggcgattttacaaacaactggaaagcctctctgttcaggcaataaccatttatggtgaacaacaccgtcgcccggaccatagtaaaaatcttcataattcccatcttttatatcttgtataccgttcactttagcacctctaacagtgggaaccttgttaccgtaaaccatggccaatggaggatattctttgttcgggtcgtaatctaagctatccaaataattctttgtacgttttaaagttctcgctaaatattcacagctatcttcataagatgtatggaagacttcatcgaaaggcacatcccttggtacctgtttattattgccggctacattcctaacaacaggtgcatttaggacaaacttggtagttgcgtttagggtagctttaagcgaaagcgctgatttcgttttccttggtaataattttgatttttcgtgagctgattcctctcttttctcattgacgagaggtgacaagccaagggttttccaaacatctgtatcaaaaaaatcgaaatcatacctctctaaggtaattttgtcaacaaaacatctaccatctaacggtagaaaatagaaactacttctcataaaaaagttggttcttagtgaaaatagtttattccacatcacatcatctccaaacctaataggacctaaaatatttggacattggcttggggaacccacgtaaataatacctcttatcaaatgagtacagtcttgcaacactttatgtgcgaccaatccgcccattgaatgggcaatgatgtatattcccttcttatttttttgcttattgtaaatttcctctagtttagtcgttaaatgcttggcagatatgtccaaggataatctccaatcatagccaaactgctgaacatttaaattaggatttgcgtctagcctctttatcaacctcttagagatatcaacaggccctatatgtgttagcattccatcagggacaatctccttctgagttttaagttcatcttcgtcattaggtccgatcaataaatcgactttcgtcatattcaaacctgcctttaatgggatccaaattcgcttatgagtagtagcatcccttagcacactacctcgatatccacccattataacgacatctccttccaattcattccatatagattctaaacgcgaacggtaatatccgtcatgagttttgtcgaatgggtctgctgttatttgcttaatggagttcttcaaggcatccatttccaaagattctttaacagcccttaaccttgaattatcaatgcccctttcgtatttaaataattctatctcttccaaggaagaaatggaggttgattttttcagtttttgcttgatctcattctttcttagattctttttgatgaactcatctggagtcttgggaagcacagttttaattatggctaatggtgaacttgatcggaaatttgtattaccaaatggtaaggaaaaggagaaagttttatgagagctgtcatagttcccgtcatgcgaataagaaataatttcatcgagatcttcatcatcagcgtcaagagaaatggcactcgcttgcttctcttctaaattatgatagttattgggcccagttgtttccttctttcttcccctttgttcactatcgctgtctttttctactttattgcttataactcttgcacctccaatcaaggtatccactttctccattgtatccaattcaccttcgctttcatttacggaaaaaaagcttacatcactaccactatcacttgaatcagaaagacattgcttgttatatttatcattatcggaaataagatcagtagccggagttgccatcattgtaatactccccagttaacctctacaagttgattcttttacgtatcaccaaaataggcaggctattcttacccagtcctttctttttaagggcgtcatagagttgtaagcattttttgagaatgcagtgatgagctattaacttctcaaaacttcctgacgttttattacccggattgaagtaccttgtattcttggagatgtctgtggtcgagttaggaagtgtgaacatgcctatcaacgccccaaaaaccagtgcagataatgatctggaacaatttttccgtgttttaaacttcctcagtagaagtatttttatttagtcgactataaaggtggaagtccatacttaagagatattaagggtattttgatcaacaagtaagtaacaatcgttataaaaatacaatagcaaaagtatgagcggagaaaatcgtgctgtggtgccgattgaatcaaaccctgaagtttttacaaattttgcacataaattaggtttaaaaaatgaatgggcgtatttcgatatctatagcttaacagagccagagttactagcattcttaccaaggccagtgaaggccattgtgctgctatttccgataaacgaggatagaaaatcgagtaccagtcaacaaattacaagttcttatgatgttatatggtttaagcaatcagtcaaaaatgcgtgcggattgtatgcaattcttcattctttgagcaataaccagtcattgttggagcccggctccgacttggacaattttttaaaatctcaaagtgatacttcaagctcgaagaataggtttgatgatgttactaccgaccaattcgtcttgaatgtaataaaagagaatgtacaaacattttctactggccagtcagaagcaccagaagcaactgcagatactaatctacactatatcacatatgtggaagagaacggagggatatttgaactggatggaaggaatttgagcggacccctctatttgggaaagagtgacccaactgccaccgatttgattgaacaggaattagttagagtgagagtcgcctcatatatggaaaatgcaaatgaagaagatgtattaaactttgctatgctaggattgggccctaattgggaataataattgttttattactgcgtagtcaaatatgtatttacagaattcttttaaatatataattcacctactcatcatagccaccgccaaaagaaaggaaacctccagtttgtctggaatgtctcgaaaaataatcgaaatcgatggacacagcgtttgctaataacacggccctttgatccaaagttagtacttgagaacttagcatctcagtaggataaatattatcaaagcatctctgcgaatcaaatctaacaacataaacaccagtatcggtaaacatttctcttcctaaaccaacccaatttctgtctacactcgccattatcttaccatcagcatctgttacaggaaaatcaaatgataagaaaggtgcatctatcttaccaaattggtcaaaagtggatccttctactccatctttctggaataattcgtaacgacgcctccagagatgccagttctgaatggtctctcctactgtcgttccttctttaccgtcgtgatagtgagtggagtcactgccattatcaacatacgcggaaggaggtatgatagtctttatatgagaattgatgaacgaaaagggccttttaatcgtcattattacatttccccaattatcaaagacatctaccaaaaaaggacgatgtagacgataaaactgccgcattatggcctttgttatagaaaaatctctttccatcattgatgctattttgtttccgttcacatccattatggcatacctattagcctgctcgaaacctagaaaaacgttcataaattctatttgcctttcgataataactgtcggttcattaagtatcgtagtagctataggatcatgtacttttattatcccgctattgctattttctttaaatgcttttactgatggcgccttcgttatttggttcttttcacgaattactctcctaaatggaccgtttctgattactttaccagaagaaaccgttaatgttttactcagtgtactgaaatttctcatacatgatcggtaagttagaaatattgccgttctatgcatgtcggtgttatcctttatgtttgacctttaatcttcttttgttttgtcttttttcatttcgtacttttcaaatccttattgccggtaggcttacaaacttgaatgaagtatataacgaagtcaatgaaacctctcccatactaggttcggaacctgttaaggggaacaagaccgcgcacttgttatgaaaattcttcctataactatattgaaagctatttttccacatcggcagacaaacgactgtccagacttagtaaagctcttggtcgattttgtacattgcctttcctttacagctccaagatattatatatatttttgacaaggtaatcaattgccccacaaatcttccatataaaaacctatatatgctattaaccgaatggcaattccctctatctcatatctcacctctacagtaatccttccgtggtatctggtctatagaaatgggtactgtttcatttaaacgtgttatcacttgatccaatggttaccatctgactttggcatcaatcccttcttaaaaagtaaccaatcaatgatatgcgattgtttatgaagtccattcaacaaacaatgggagtttggccgagtggtttaaggcgtcagatttaggtggatttaacctctaaaatctctgatatcttcggatgcaagggttcgaatcccttagctctcattattttttgtatttttttttttcacttcccatctttccaagaatcttaggagaggtgccgcagtacttttttggactgagcaagaagtatcgcaaagcatggaaaagtaagaagggtatagcaaaagtcttttcacaataagaggatattttgcaggcaaatttctgaagaccacataatatcgtcttcttggcgcaactaagacgcagagaaatgcttgttttcaaaaggggtattcacgtagtacctaaactaccaaattctaaggccctactgcaaaatggagtgcctaatatactcagttcttcgggattcaagacggtgtggttcgactaccagcgatatctatgtgataagctaacgctggcgacagcgggacagtctttggaatcatattatccatttcacatattgctgaaaactgcaggaaatccattacagtcaaacatcttcaatttggcgtcctctatccataataaccatttattcgtggagaacattctaccttctgctgttgaacatggcactaactcgaacgccgttgtgaagacagagccttctaggctttttttatccaaaatcaaagattcattcaacggcagcgattgggaagtagtgaaggaggaaatgatttaccgtgctgagaatgaagtcttgggacaaggctggttatttctagttgaaaacaatgagaaaaaactcttcatattaacgagcaataataatggtacgccgtattattttcccaggaaccagtcatttgatttaaacagtgcgatatccatcgatgaatttgctaccttgaaacaaatgaaagaactgataggaaagtctactaagttgaatggtaaggttcaagactggaccatgcctataatctgtgtcaatctgtgggatcatgcttatttacatgattatggcgttggtaaccggtccaaatacgtgaagaatgttctagataacttgaattggtcagtggtaaataataggatattctctggtatatcgaagtaatgaaaagaaaggaagcgatagcctcttaccctcatatgtaattataaaggtatcgggtagaaggggatctaccaaaatcttatatactgtaaatagttttattttatcctctcgctcgtgttttaaacaaccttaatggcaattactttatcattttcatctttcagcattgtggccctatttctatcgcataggggcttcaaacaataatagagcaagctttcgggcattctatggaactcccaattgactgtttcatcaccttcactcaattcgtataacgtaatgacttgattcagttttccagagtcttcgaaccactgtagtatcaaagaagcccaactgtctaagctcttccataatataaaatatctcgtagtggtggtattgctgcttctcctaccactttggtcaatcggtaagcatttgccttctttggtcatttgcgaccaaatttcatcaataaatacctgtgatacagatctttggatgtcctcattattaaaaagatttttcgagattttttttgaatcgtcattatctgtacttccactatctagttcgttgtcattgattacagtcccgtcaacagacatgtaccaaattttcttggtcttgcaatattgtgatatgatgtctatccacgtacttatctgttgtctccttgttaaagaattgggttgacgggtatatagtggagggaatgagtatactggaggtaatgcagacataatacacttgctatattagcgcaacaagaataattctgagtgatgctttgaattcaaatggtttagttgagaaaatgttaaagaaataactggacaagcgaactgcctgcaaaaatttttgacaacctttctgatatgcttaacttttatgaattaggtatttttcttaagggacaacaaatccagaagaacgaaattatttgaggaaccagttaaaaaggttatttaacgaacactattaatgcaaaaaaatctcttgtacatgttcattactctattcatggggtgtaatcatttgtaggcacaaaatgcagactcttcagtagaaaggagcaagttcgatgaacagtccttagctaacgcaaatatctaaaaaaatattcatatgaagactctttctatctactatagtttacaaatataatactgtatataagaccatttattggcttaaaagattttaaccaagagcaatcctatggaacgttctgtcccacttcactcaagtttttgaaagggtaaaaattaaaaaaattatagaattaacagtaaaatgtgctacgttccaaaaaaaaaaaatatgcactatagtatattactacatgtaatacttcggtcaaatacactgggagtaagtgaaaatagagattgttatctccattagtttcttcacattcaataactactttttccgtatgaggcgcttacctcatcaaaatgaagaaaaaaaaaagtatataagcagcgtgattgtccgatcgaaatctttcatttctcaccctctctctctttaaacagtcgcccacacgttccctctttttttttttcgattgttttagttccccccctgccttttcttctttatcttgtcctttttagtttatcacattttttttgtttttgagtatttatcttgtatctaactgtctatctgactaggaatcaatttgtaaagttctaaaaaaaaatttaaaggcggctattgaaaatgaaatacgttgttgtttctggtggtgttatctcaggtattggtaagggtgttttagcgtcctctacagggatgctactgaaaaccctcggcctaaaggttacttccatcaagattgacccatatatgaatattgacgccgggacgatgtctcccttggaacatggtgagtgttttgtacttgatgatggtggggaaacggacttggatctcggtaattacgagcggtacctcggtattaccttaagcagggaccacaacatcaccaccggtaagatatactcccacgtaatttccagagaaaggagaggtgattatttaggtaagacagttcaaattgttcctcatttgactaacgcaattcaggattggattcaacgtgtttcaaaaattccagtggatgacacaggattagaaccagacgtctgtatcatcgagttaggtggtacggtcggtgacattgagagtgcgcccttcgtggaagcattacgacaatttcagttcgaagttggaagagagaatttcgccctgatccatgtttcacttgtgcccgtcattcatggtgaacagaagacgaaacccacccaagcagcaatcaaagatttaaggtcattagggcttattcccgatatgattgcctgcagatgcagcgaagaacttaacaggagcactattgacaagattgccatgttttgccatgtggggccggagcaagtggtcaacgttcatgatgttaactccacgtaccacgttcccttattgctgctaaagcaacatatgatcgactacctccattcaaggttgaaattaggtgaagtgcctctaaccttggaagacaaggaaagagggtctcaattattgactaactgggaaaacatgaccaaaaacctagatgattctgatgatgttgtcaagattgctcttgtgggaaaatacactaatttgaaggattcctacctatctgtgaccaaatccttagaacacgcaagcatgaagtgccgtcgtcagctagaaatcctctgggtagaggcaagtaacctagagcccgaaactcaagaggtggacaagaacaagttccacgattcatggaataagctcagttccgccgacggaattttggttcctggtggatttggcacgagaggtattgaaggtatgattcttgctgccaaatgggcccgtgaatccggtgttccctttcttggtgtctgtcttggattacaagttgccgctatcgagttcgcccgcaatgtgataggccgcccaaacagcagttctacagaatttttggacgagacactactagctcctgaagaccaagtagtcatatacatgcccgagatcgacaaggaacacatgggtggcacgatgagattgggtttgaggcctaccattttccaaccgaactcagaatggagcaacataaggaagctttatggtgaagttaatgaggtgcatgagagacatcgtcatcgctatgagataaacccgaaaatagtgaatgatatggagtctcgtggctttatttttgttggtaaggacgagacgggccagcgttgcgaaatattcgaattgaaaggccatccatactacgtgggcactcaataccatccagagtatacatcgaaggtgctggaaccatcaagaccgttttgggggcttgtggccgcagctccggcacacttggtgaagtgatcaaggacataaatctaagcgagggaaatgaaaatgaatgaattgatgcgcttactacttacttacatacggtttttattcaagtatattatcattaacattagttggttagaccaatgacaccacaggctggtcttggaccggcattaccagtcttcaaagattcttcagtgtcacccttacctaagtcatcttggccggcgtggataacgacgcttctgcctacaacggaggtaggaccgataagcttgatcaaagagtccttgaaggagcccttggccacaccattttcgtccgtctttacgttacccatgtcaccgacatgtctgacttcgtcagttggagcaccatgtgtcttcttgaaaggattgaagtgaggaccagcagagacacaaccattggtggcatctccaaactcatgaatgtggaacccacgttctgcgttaggactgttaccagcgatctcgtaagagacagtggttggctcggattcggaagcctgttcgaacttgacaacaccagagacaccggcatcaccctttaacactgcgactgcttgaaccattataaattaattatgttttatttgtttgcgcgattgctttcttgcctgtttttccgcaacatagttacagctaaacatttgcccaaaaccatcttcttatatatatatctgcgatggcgagcccagcggaagggatgtccgcttactaattccgacacaccggtttaaccccccggcgtgctggggtgggtgcccctaagggagcgggttctgtacttccagtaagcggcatttgcgctgtcatcgccttatcgaacccgctactgagatcatgtcctgagtgggtgagtcgcacgcccaatcggctgcacttcagagatacttacgtccaatttcgcatcatgccaatattacctgtggaagttgaaactttttttgcagatgccgataattttcacatggatgagtcgcagtgtcgtcgtacgtgatgagggcaggcttgaaaattattcttcgagcccaattctctttacttataggcatgccatgtctaattaggtagtcatctcagtttatcttgtgcagggtagaaccaaagataacagcaaaagaaagagcaagcaattatgaccgcaccattggtagtattgggtaacccacttttagatttccaagccgacgtcacggctgaatacctggccaagtattctctaaaggaaaacgacgcaattttggtcgatgccaaatcaggcgatgctaagatggctatttttgacgagctcttacagatgccagaaacaaagcttgttgcaggtggtgctgctcaaaacactgctagaggggcagcatacgttttgggcgccggccaggtggtgtacttcggttccgtcggtaaggacaagttcagcgagagattgcttaacgaaaacgaaaaagctggtgtcaagtctatgtaccaagttcaaaatgatattggtaccggtaagtgtgccgcattaatcactggccataaccggtccttggtcactgacttgggtgctgccaatttctttactccagaccacttggacaagcattgggacttggtcgaagcagctaagctcttctacatcggtggtttccacttgaccgtgtctccagacgctatcgttaagttgggccaacatgctaaagagaacagcaaacctttcgtgttgaactttagtgctcctttcattcctcatgtcttcaaagacgcattggccagagttttgccttatgctaccgtcatcatcgctaacgaatcggaggccgaagccttttgcgacgccttccaattagactgtgccaacactgatttggaagctattgctcaaagaattgtcaaggactctccagttgaaaagactgtcatcttcacccacggtgtcgaaccaacagtggtcgtgtcctccaagggtaccagcacatatccagtcaaacctttggactcttctaagatcgtcgacaccaacggtgctggtgacgccttcgctggtggctttatggctgggttgactaaaggtgaagatttggaaacctctattgacatgggtcaatggctagctgctttgtctattcaagaagttggtccctcttacccttccgaaaaaatatcttactctaaatagattcttcttacaatataatagaaataaaatatactctacgtgttccctctagcttttcattcgtagacatgtttaccgcttgttcttaaaccaaataagccaccgttaccacaataaggaaaagaggcgctataaagtacagcttcaagaaaaaaggacaagcagcgctaagaacaaaatactcgttcatcctctccacatacggccgtacacaagcaacaataacacaataatatggactgggcaatcaatgtcgcccatccacgattactttacaaggatcctaaactttcagtaacgtttattgtgccgagcttatttcatatcattattgctttcgtgttattaggaatatgtgcatccgattttctttgccccaacgtggcccatatatcagatcccaacagccttcgatcgaatggttctttagtctcaaaaacggcgtcccatgcatctcatactggggcattaatggcagttctactatcttggtgtaactcttcgcctgacctattttccaacttaatgagctgggcaacctctacgagagaaacaaggtcaacctcagtatcgctatcaattggtgaggtgcttggcgcttgcggcattatcctgtgcattgtagagggctccatttttattattatgtcaagaactcacattgaaatctcgcaaattcaaaaactatccatcatgagagacttgttattttctttagctgccatgtgcgtaatgagttacgtttcccttatgaatcaggtcactgtgctgaattgccttttgatggcgttcctttatgccttttatctagtcgttaagttaactttcaagcttaatcattctgcagaaaccccagatgaaactgctgcggatacgagcctcagagaagactccgtttctccttttttggatgactctctgatggcttctggtttactaccaccaatacaacctggctttgacatatccaattctataacacacggcattaagcctagtttgctatctgctatggatttcaatagtttcttatcaatgcttgaaaactcatctttggaggaggatgactcaaggaatgaaatggcagaattgaacactctacgtagcatgacgccgggacaacattggtccgcctctgcaacagttgcaggagaggcaacgagtgctggaagacctttcagtgagccaacgaatgcgtttacggaatatagagattctgaaagagcaataaatagttccccagcggtgttcgccccctaccgtgacaaccctgatgatgaagagtctcaagagcaagtattattggagacaacaacgcatggtcattttggtgcgcaagaaatgcgaaggttctccaaaaggtctctgggctggattataaaaattttcataccacatctctcaaatttttcccagaaatccatctcagatgcgatcttttccataataactgttccgtttttcattattttcaaactatcatgtcctcaaccgccttcagatattttgagttatgatcccactttgaacagatactctttaacaacgttacccataattttattatttatccaatcaattactgcacccttcctcctttgcagtatactttctgtgcttttgacatatcatctaggctatctcgtttaccttttccctcttatattagctatggccttaattttactattgacggcttttattacaaaggtaaatctgcataacaagtttactctgtcattagacagctctaacattttacaggaaaagctacaaaaaagaaaactcctcgaaaggcttaacacaagcatccaaataatttttctagctatcggcataataaatatcataatttggatatcacttttagccaattctcttattgagatgatggaaatttaccaaaaaatattaggattatcgaaagctattttgggccttaccattttcgcatggggcaactcagtaggagacttgatctccaacatatctatgtgcaggctctacaaaacccaaactcactaccaagacagagttcgtttagccacaaaattttttatgatatcatgcgcatcttgcttaggaggcgtaatgctgaattctatgggtggaataggctttagtgggctagtatcaatgctttttattggcgcttttaatgataacgaatggtggttcctaagaaaggttaaattacaagaaacaagtcaattggataatacattaaattacaaattcatagtttcttgcgtcttcattatcctacagattattctcttgctgttattcttcggagggcctaacaatattaaacggcgcctcacaaaggagatgaagttagtcggaatctctatgtgcggactatgggcactagccacgttgattaatatacttctagaactgtttagctaaagcttgcaagagtgcctcccgaaaaatttgtttttgtgacatttatctggcgccgtaacagatccgcgcagaacacagaacaccaagaaaagaagtactatttaatttcaagattacttagactccgtcattcaaatcgcccttttattcaaacaaaaatgggccatatattctttctgtctcaaccttcgtttccttggatgaattattttgattgagctccaaaaaaaaagttgtagccaggaactatccaaaacttcgattgagaaacccataacaatgatgcctgccagacttttcatactatatcttttttgtagtactcatgcctgttgttcattgttcgtccaacctgcccatcaccctatatatctatgagcgtctagtatattttattaaggcaagctctatatcaagctgcatatctgacaacttacttcttgttaataaaaccttcaacgacggaggttgtccaccacatattaacttctgcaatgatgagataattaacccaacagcgcctcaaacagtggttgaattagttcttaatgcaaaaaaaggtgaattaggctcgggttatctggctgttgaccacggaaaaaaggttgttattttagcatttagaggatccacaacaagacaagattggtttagtgattttgaaatatatcctgttaactattctcccctttgcgttaaggaatatcgtaagcttatagaggaaggaaaaatcagagaatgtgaaggttgtaaaatgcatagaggatttctaaggttcacagaaactctcgggatggacgtctttaaaaaaatggagtcgattctggaaagctttccggaatataggatcgttgtcactgggcactccttgggggcagcattagcaagtttggctgggattgaattaaagataagaggctttgatccgttagtgctgacattcgcaacaccaaagatatttaacagtgaaatgaaacaatgggtagacgagttatttgaaacagatgctatagaaaaggagtcaattcttaaagatgaaattcaatttcgtaagggctattttagggttgtgcatacaggtgattatattcctatggttccaccattctatcatccggctggtttagagatgtttattaacaaagttggtctacctcagaatgcggaagatattgaataccgtggtaaaaataacaggttaactttaaaggatggatttcgagagggtatgagcggtttggttgaagactggttacatgtctatgaacatcgagcctacttcattgacgtagtgggatgttctggactttaacattcacccacttttacgtttttgtctataactagcatatataataccgctctagagttactctaaactaaatgcgaccactattcttaactaataattgttctttttacaaataactctttcaaaacttctaatcttttctcttacgttttccatttatctgctcttcttctgaaactctttttcctgcattggccctctctttgttacatgaaagaggttttagggttggtaatatttctggttgtaaacttcttgaatacacttgggtagctaactgcttattccagttctcctggccactaatcccggctacgctttttgttgaaatagtattcttctacagcatcatagctatcatcacacatgtctactagtttccacgtatgtcttggaggtactctatcttgaccgtagatggaagctttaaaattttcatcccttgggaaatattcctcacgtggaattttttgagcgctgcatggctaaattctaccgaatccaatacgtatatccactactcaacatgttggggcacaagtgattacacacttaatatctctgtcatagaagctactacagagaaattggttgacactagattattaacaacactcgagaatgcaaccgcttggattaactcaaactctattgatgaagacgaagatgatatgcctcatgccactaacgtagcagaccggcttgatgggttatcccttagcaagcgcgtatatagcatctgtcactacgaattttagtgcggattctctccgtagcgtaaacgttctctatacatcatctacccatgttgctccacctagcagaacatttcagaaagaaagaagtccaagtaatggccaacaaccagaaggacagctttttttatgaaggccccctactgcatattcattaagcttaagcttgatcggtgaaaaatgctataatctacgtgtactggtcacattgttgcacatctcaattaatcaacgctctattattatacggaagatataaaggcatagtaaatacacttgcctgaggtattgattgatgaattattttccacggcccatgcgttactcacttcgaaaatacatttgaattttagtgataagttttgcgatctacttttgttcaagataataatactggggtagaatatactctaagaagtctctttgaaattaaaaatatctctaaaaaaatccattatataatatacagtaatacaattagaggcaggtttttcttttgcacaatcaatatgctttgaaaccaataaattcatcccaggaacggacttctggtggaactataacgtcatgagattccaaaattttgatcttttctgcaatttttgccttcaaacactttgcaaataacaaagccgtttgaggttcattgaacaatgggatagcaaaatcaatagcattccttctcataatatagtcaacatcgtcagtgctctcagctctcttggaggctaaattgaaaacagcttttatgtcatattcttgaaatagttcacgcaattttctcttatcattctttggaaatttaatcaaagaaacctttgcgttcttttctttgatgtgttcctgtagatacgttttagtggtctcattagttgtgtatattctgtaaccaatagtggccactatggaagccacttggcccaagtattctcgagatgtatcacctccaaataatataccacttggaggtagtggtacatggaagttcatggtactttgaatagcagtccaatagctttcaattaaatctctaccaaatgaagcaacttcaccagttgatgccatttcaacccctaagaaaggatctgcaccagccaaccttgtaaaggaaaattgaggaactttagtagcaacatagtcgtactttttgttgagcatcaaatcaacaggttttggtacaatgtcaccgcccaaaaatgccttgacagcaatttcaataaaattaacgcctaaaacttttgaaacgaatggaaatgatctagaagctctaatgttacattcaatcactttcaatgtatgctccccatccttgatgatttgcatattgaaggggccagtgatcttccaagcttttgcgaccttatcagcaatgtcttttagggcaatcttcacatcgtcagaaagatgttgtggcggtaagactaaagaagcatcaccggagtgcacacccgcattttcaacatgctcggaaatggcatgtaccaagacattaccattataagcaacggcgtccacatcaatttcttgagcaccttcaataaatttagacatgacgactgggtggtctggagaaacgtcagatgccaaagttaatttagccttcagttcctcctcattattaacaacactcattgccgcaccggaaagaacatatgagggacgaatcaacacagggtagttaactttagaagcaaataattttgcttcttctactgatgttaattcactccattcaggttggtcaacatcaatagaatccaaaatagatgagaatttgtgtctgttctcagctctatcaatatcgtttggattggtacccattatattacagccgttatcgtaaagtttcaaggcaatgttttgaggtaattgaccaccgacagaaataatgcaaccctcagattgctccaactcataaatgtccatcactctttcatacgataattcttcaaagtataatctatcaacttcatcgaaatctgtggaaactgtttctgggttataatttatcatgatagttttcttgccttgatctcttaatgtcttcgcggtgttcacggcacaccaatcaaattctacagatgaaccaatacgatagacaccagagcctaaaaccagcataccattttcgttgaactccacatcgttctttgtagcattgtaagtggtatacaaataattggtttgtgctggaaattctgcggccaaagtatcgattctcttgacaaaagggattatacctaacgtttttcttaaacttctgatttccagttcgttaatgtttgtggaggcgtgtttatttatagtaaccgcaatctgcttatctgaaaaccctaatttcttggctctctgcaagagatctttactcaagtcacttaaagatttaactgattcaagctctttatagatattaacaatgttcatgcacttgtaaagaaaccatttatcaattttactcaattcattaactctctcaacagtatagttttcatggattaaggcctgaccaatggcaaggactcttctatcagttggagttctcaaggcttcatcaagttgatcgccgaattcagtagaaccttggaatcccaataatgatggatccacctgtcttaatgctttttgaaaggcttcttcatagtttctaccaatagccataacttctccaactgatttcatagaggaaccaatggatctgtccacgtattggaacttagaaagatcccacttaggtatttttgccacaatataatccaaagatggctcaaagttagccactgtagtttttgtgattgggtttggcaattctggcaaagtatagcctagcccaattttggcggcagtgtatgctaagggataaccagtggccttagacgccaatgcagaggaacgagataaacgtgcgttcacttcaataactctatagtctagcccatcaggttgcaaagcgtattggacattacattcaccaataacaccaaggtgtctaatgattttaattgcggcggatcttaacatatgaaactcttcatctgatagggtctgcgaaggagcaaaaaccatagaatcaccagtatgaacaccaagtgggtcgaaattttccatattacatactgtaatacagttaccaaccctatctctgaccacttcatattcaacttctttccaacctttcaaagatttttcaacaagaatttgtggggccaacgacaaggactgtgcggcaagttccttcatttcacttgcattgttagcgaaacctgagcctaacccacccaaagcgtatgcagatctgacaataactgggtatttgaccctttcagcagcctccaaagcttcatccacggtttcacaagcaaatgattctgcgatgggaatgttgatatcctttaacgcagatgcgaaaagatccctatcttcagaagtgatcaaagttttgataggagtacctaaaactttgacgttgtatttagccaaaacaccagattcatccagagccaccccacaatttagacctgtttgaccaccgaaggttaaaagtatagcatccggcctttcaagttcaatgatatatgtgatgtattctggtgtaacgggcaagtaataaatcttgtccgccagggaatgagaagtctggttagtagcgatatttgggttaaccaatatagtaaacttgttatcttccttcagagctttgatagcttgagaaccactgtaatcgaattcaccagcttgaccaatagagagccctcctgatccaatgacaagtacagaatttactccttcaactaattgaggtttgtagtcctcggtagtaaaagcagaattcgtaggctctgttgatgtataaatcgatgtcattcttttcttcctgtctatgtactgtattgctcttcctttatagaactaattttaactatagatgttagtttttcgatgcttaaacttaaatagcgcttcaaaaaagagataaggcatactatagaagacgtattagtaattatatatatacaaatagcatggcagaaatgcttatgacggaaaaaaaaagattggattttctcgatgcttactcaaggtgacacaatcgttacgacatggaggttcctatctctgatattcaaaagttattgccatctcatcaataagagtcattcacaataatctatagaatgccgcaggaaagaagacagtggtggatgagtcattttctcaaccctagtttacaatctgaatgtttaggggatttactatttttaattaggacatttgaatatttctgatagggtaaaatcactttttagggtttctgattttctattttcctcatttttcacaataataacaatgttgccattcttttatcactaccctaaatgtaccaaatattagtaagaaaagaaacattataaagaaaaggaggttttacaagggtcacttggtgagattaggtcgtcgttattatttttattttgtgggcggggtgtaatagtgctaaaaagagggaaaagaaatagtataccattccgcaaagatggagtacatcaagattgccaaagtatctaatgtagtgctgcatagaagaggtacggccacacaaggtactttacatttgactactcaccatttgatctttgagtcaccacaattgtcgacggaattttggtttccatatcctttgatctatggagtgcataaaaacccgggtagtacattactgtccaagttgacttccactaatcaaatccaattggagggaacggattcacagaattacaagctttaccagggtaaggatctatggtcttttgtaaatatcaaggtaattgggaaagattatgcggtattctcattggatttcggtggtgatttacatctacaggcaagaaaggtgtatgattccatcttaaatttgacggtcctgtccaatatcacgcaactatatgcatttatttacatatccaacaatctggaaaggaaactaccttcacccgatagctgggatatatatgacccaattaaggaatttcgaaggcagggcctcgacagtaaagatgaaacatgtccttggaggctatccacggtaaacgaacactatgaattttgtccaacgtatccctcaaaactttttgtaccaagatccacgtcagatatattattgaagcatgcttcgaagtttagatcacagaaaagaattcctgttttaacttatcatcacaaggcaacagattgcaacattcttaggtcatctcaaccattaccggggttgatcaatcagaggtccattcaagatgaaaaattagtttgggaaagcttcaactcattttgtaataaagatattagaagaacgaaacatgtaatagtagatgccagacccagaacaaatgcattagcacagatggcgttgggtggcgggacagaaaatatggataattataatttttttttagctgataacaatatgggtgtcgataaaagtctaaaactgcccacagttacacggttatttcttggtatagataacattcatattgtttccaacacagctgcatacatgacggaagttatctgccaaggtggcgatttgaatttaccactggaacagaatttaattaggagtcaaaaattttccaattggttgaagttgaacactcttattttaaaatccgttgatatgcttttaaagtccatcattttcaatcattccaacgttttggttcattgttctgacggttgggacagaaccagtcaagttgtatcactattagaaatttgtttggatcctttctatagaacttttgaaggttttatgatcctagtggaaaaagattggtgctcttttggtcaccggtttttggaaagaagtggtcatttaaactctgatattagatttcatgataacactatgcattccaacttcaacgatgtggataccaatggcgatgatcttgacataggtgttaacactcaagacgattatgctgaagatgatgaaggaggtgaagatgagacgaatttaattaatttgagtagaatttccaaaaaatttaacgaaaactttaaattgaacaagaaaagtctaaagttcgtctccccagttttccaacaatttttagactgtgtataccaacttttgacgcaaaacccagatctatttgaattcaacgaaagatttttaagaagactagtttaccacttgtattcatgccaatatggaacattcctttccaatagcgagaaggagaaatttcaacagaatttgccaaacaagactaaaagtgtctgggactacttcagatctagaagaaagcagttcataaatccaaatttcatacagagaaaaagaagcggcatgaatgagcacgatcaaaaccttgaagaggaagaaaaagtggagtggatttcgccggatctgaagaaagtccaatggtggtggcagttatatggaagaaaagattcagaaatgaatgatgaattacgccataaacgagactcagtacccatatcggtggataaaaagagtaaagagcatagtaattccgatggcggtaagggtttaaatttgtcaatttttggatttgatatgtttaatagaaagtgatctggttaacggcaaagaagacaaataagtgagttagtattttgcatacaatgatagaagtatagaaaagttcaagcatttctccgttgttagtatacatatatatatattaattttaatgaataagggtacatatattatgagcataacgagtggccgatcggcaaaggggcttacaattttacaacaccagatttccaactaacaccacaccactgagatattagtatagccaatcctctcactgcctccacagtttccttatcacaaccaatattcaaggcacctttcaaatgcccacgcaattgaggattaacatcttgtggaaccaaagaagcaattatcactaaacttgtctcttgcgcagatagtatctcatcaaaggcaaacaaagggccatatacatggaccagtgtataataccataagtctgggtacgaagagtttagattgtttaccacgcgggttgagactttgttgtatattgaattccaatgccgtaagccgttctgtatggtatgatctctttcctggattgtcttgtcatgcttccttctcatagaggtttccgaaaggggagaactgtttcccatggcagcctcccacgggtctattgggtctaagtgcggtactaaaatgtccggagtagtttcctttagcatagtcaggccattgatcgctcttggaaggccggccagaggtcctgttttaagaataacttctctaaattttgctgtcaattgcttttggaaaaaagtaggttgttggtaattctcattgatcaaagtttttctcattggtaattctgagcgcagtaagtcaatggtttgggaagctaatgtgaatctatacatgtgtgcattatcattactcagtagcatggcatagtggtataatttaggtatttcctgtggctcattacaaacactgaacgtggcggccgcaacaaggtaccatatattcttcagtttagggtgaaattgtgataattgtatcagcctttgtgcatttagtatctggttcattcttgaaatacttgcaaaatatatatgtattttttatgataaagtaaaggaagtttggcaagtggagcctgcagtgtggcacttgtatatatgtatgtgtaagtcagtacacaagtataagcatatatggttatgcttcgttgagtaattattagtcacacatttttttaggctctttaggatctgcattttttttttggcaagcacgaattgaaggacagaaaaaagaaaaaaagtgatgagattgaaacaataacaaggtaaacaagtaaatgggaagccaataaacaaaaaaaaaaaaattagagtagaaagaaccgagaatggttaactcacatggaatacggtatattcggttgaagcaggtctttaatcgtgcattggaccaatcgatttcgaaattacagagttgggacaaggtcagttcatgcttcccgcaatatgtgaatagcaagcagggcgctataaacgtcgccaattgtcagcgccaattaacggaattctggacggagctttgtcaacgagagtttaaagaaattatggaagaacgaaacgtcgagcagaaactaaatgagttggacgaactgattttggaggctaaagaacgttacacggatcgtgatcaagatgaagtaaacaaagggcccgcgatcgatgagctctccagcaaagagcttgtggaatgccatttatacagccaacggatgcatgccatacacgagatagacgagcggcttgcgaaagtgaatgagatgaacgaccagttagcccaggagttgaaagacttagagacgcaagtagaggtagagaaaaacgaaattggcaagatgtacgatgagtacctgggctcccacacggaccaaccggccaacgtgctgctggtacagagcctcaatgatatggtcttggaattgaaggaaaactattgattagttgtataaatttcataagtgacgtataaggaacctgttttatgtattcattaagcgaggcgaaaagcgaggcgacatacttcttttcacatcaactcgaacagagaaaaaagtagacatagaaagaacccaaagaccacaagagcaaacaatggtacagctgagaagaacgtatgtatatatgttcgtggtaagctcgttggtatgcacgtatcttaggcatcactaccaacaaagtgtttcaagcgatcacgtcgactaacgacaaagttgctcactttgtcgtgttcatgtgggagtcgtggctgtttgtaaagatgtttgctgaggacatcgtgactttccgcaagctacaggccaacaagtacgtgttaggggtgctgatctgttcattatgcgcaagtgtaacgagtgaattcgcccaaagcgtggtttcgcggggacaaagggtgttcgatgtgaaggatattatttgtaatttctggggcagtctgcttggtgtgggcattgccttctaccaggaccgataaaaagagattatacggaaaatcatataaatgtgtttatgtacaggcaagtttacgtagactagattactttaattgaatatatgctctgtgagcaatggctgtcttgtgaatctggtccctcttttcaaaggcagacgaagtgcctttggcaatggcagtgagttcttctcccaaacgcacggcgaagtcgctcgacactctttggtttgcgctttgtacgatccagttccacgcgatcctatttctttgcctcttgttcagaggcacaggaatgacagaagccttggccacgcctgtgttgaatgtcttggtcatcatcagcggagctagttcgtcgagtgacttttccaaagcctggatggggtcctgccgggtctggcagtacaccagatataaggccctggacagaatggtttgtgccttttccttcttaccgtggcgcatgatcatgtttgtgatgtgatccagcgttgcgttcttgcgtggaggaatgggcacggacttcagtgcctcccattgtgccaactgctctgcagttggctttatcttggagcccgcctgtgaaccctgtaagaggtctactttggactggcccggtggagccagcgaggtctctggcaggtattcttttgcagagaactcttcccttagctcgttgatcgcttcaagccactcgtcgacccctttctctgccgatggttcgctagctggtgttcgtactgacgactggaaacgagcaacacatgtcccactttgccacaggagacgtggcctgactaacatatacctcctcgcacaatgcagcattatattcacctcagatccgtatctatctatttttcttctgaaaacgatagctgctgtcttttctgtacgtgtataatgtgcattgtatgtagtaagctatttctcaagcaaatgtagattggagccaagacgaacatttaaagccgtatagaactactttgtttcttcttcagatgatcatttctcatatatggtcacgtggctcgatgtttatcgctttatctttttttttttttttttttttgcttttcattttggctctgctctctgtattagctcatcatttaacgcaaatgaccacgagacaataaaccgacgaggaatgtgctcatatgtctcgccaatacctctaaataattgaccgcgcgattatttagtgtgaccagagcaaagtagctttgcgtccgaccatgcaaccatggatatactcaaaaatggcaatagtgtgcccctaatacgtttgctggccagtatccctttctgaaataagctaaacccttgcaaccaccaggggtgccgccgtcctaactttccagcctggcagcgcgtcgagtcgccgaatgttgcgggcgctgccccgcccgcaacaccgcgcccgccctgcctcagcttaaccgaaaccacacgggtctgccatcttccatataccctggctcttctttcacaatgcccgctcacaacgccaactgcaaaagaagcccgcccttagtcggttttccccactttgatataacccccccccccccccccccgcatcaactggtaatttaacccaaacaccacggggtcataatttaaaagcgaaaaaccttaaagcgttctcgaagaaatcttcctgtagatgatgtcgtagcaaacttatcttttagagtgtttgtgcttactgcattgtcagatcaaaatttacgtagccgcccttttcaacccctgtcgaagagtagcataacagcagcgtagtgaacgtgcatgttcacaaatacacgtacaatattaatatacaatagtaaggtgatgaacacacacacacacacacacacacacacacacacacacatatatatatatacaggagatcaagttagtgtgaggggacgactactgagtttgaagttctttaaagtgttaaagttatttttcccctctcccacctcgttggcaacctctcacccaccgcttagcagcatgtctccgtacatgaccatacctcagcaatacttatacataagcaagatacgttccaagctgtctcagtgcgcccttactcgacaccaccacagagaacttgatctacgaaaaatggtgggccacgccaatatgctggacaggatcctcgacgaaatagacgaaatcgacagcgaggtagtactgtgtgacgctgccgatggttcttctactgcagaagctcattccgcttccccagcatccagcgactcttctcctctcactaataacatccggcccattagcattatgtgattagcatgcattttccccttttcctttcttaagaacatttttacgacgcggatctgcccgtcatcgcatacgaatgttgaatcacgccagaatcaccaaagaaaaaaactcgttcagttcctaggttttatgagccaggaacaatagacttttatcgcatattatttctatacgtgcacttatatatgcacacatatgtttatatacatatacatacatacgtgtttcttttcagcctgtgtttttgtcgggtccaaaaacatacaaggcaacataatattttgacataactcaacgcaacataacagtataaaacatagtttaataaaagagaaaaaaaaaacaatatttttaagctatcgctcttgccgcaatgaacgccaactctaccacgacagcaatcggcctcaccagccccttcgaaaagctgtccttcttccctcattcgtctaatttaatactggctcatttgcatgagatcatcttcagcttcgtcttctaccagctcgcattctccgttgtcgcaccgttcttgaataaagtggtctttcgcaagcactacaccacgatccgtgacccactgctgaaaattgatttcaatgtccacaccgtctcgatgatccaggctgtcgtctcgaacaccgtcctgttgcccaccctcacgacgccaatgcattataatgttgtcacctacacagattcgtacagttcaatggtatcttccctcagcgcagggtactttatctgggacttgactatgtgcgtgcgttacttcaagctttatggtctcgagttcacgggccacgccattggctccgtatatgtgatgctgttgtccttaagaccgttctgccaaccctggatcggcaggttccttatctacgaggcctccactccctttgtgaacatcaattggttcatcatgcaatgtaacgccaagagcaagaactctatccctctgtggtttaatgtcgtcaatggccttttgctcatgactgtgtttttcgtcgtcaggatttgctggggctccatcgcatccgctctcttattcaggcagatgtggaaggtaagagacgagttacccaagttttctgctgtcacgatgatgtcgctgaacattttcatgaaccttttgaacgtgctttggttcaagaagatgattagaatcgccaagaaacttgcaaaaccagccccaacgtcgaagctagactaaacctacctttttttctatcttcaacaacgaaacgccttacacacacacacacatacatctacatacatacatacaaatatacatatatgtaaacttgtatattcattcctattaaccaaaaagaggcaattaaacttttccctctttttctacgtcatttactcaaaaactctaattccttcgtctctgttctgccattttctccagaaaaaaatcgacgggaaataaaaaaaaaaagacaacgaacaagagaaaaagttcgcgaattataaaccacttctataattaacaggaaaaggaaggaaaaaaaaggaggaaatagaaaactgcaggcctttattcatgtttgatcttaagacgattctcgaccatcctaatatcccgtggaaattaatcatttctgggttctcgattgcccaattttctttcgaatcttacttgacgtacagacagtaccagaagctatctgaaacaaagttgccacctgtgctggaagacgaaattgatgatgaaacttttcataaatcaaggaactactcccgggccaaggccaagttctccattttcggtgacgtctataacctagcccaaaagctagttttcatcaaatacgacctcttccctaaaatctggcacatggccgtttctttattgaatgcagtcctgccagtcagatttcatatggtctccactgtcgcacagagtttatgcttcttgggtctcttatccagtttgtctaccttggttgatttgccactctcttactatagccattttgtcctggaagaaaaatttggtttcaataaattgaccgtccaactatggatcaccgatatgatcaagagtctgactttggcgtatgctattggtggcccaatcctttacctgttccttaagatctttgataaattccctactgatttcctttggtacattatggtcttcttgttcgttgtccaaatcttagccatgacaatcattccagtcttcatcatgcccatgtttaataagttcactccattggaggacggtgaactgaaaaaatctattgaaagtttggccgatagagttgggttccctctagataagatttttgtcattgacggctcaaaaagatcttctcattcaaacgcatatttcacaggtttgccattcacctccaagagaattgttttgttcgacactttagtgaacagtaattctactgatgaaattacggctgttttggcccatgaaatcggtcactggcaaaaaaaccacatcgttaatatggtcatctttagtcaattgcacaccttcctcattttctcccttttcaccagcatctacagaaatacatcattttacaacaccttcggctttttcttagagaagtccactggcagttttgttgatcccgttatcactaaggaattccccattatcattggatttatgttatttaacgacttattaactccactcgaatgtgccatgcaattcgtgatgagtttaatttccagaactcatgaatatcaagctgatgcttatgctaaaaaattgggctacaagcaaaatctatgtagggctctaattgatctacaaatcaaaaacctttccaccatgaatgtagatcctctgtattctagctatcattattcccatccaactctagctgaaagattgaccgctctagactatgttagtgaaaagaagaaaaactaatctatagagtacacatattagcatgtaccgttaaattcagcttcgttatgtctatatctacatacatacacaggtatctactataagaataaaggaaagaaaaaataaacgattaaacattttatttttttgcatcgctatcatcattacctttctcattgttatcatcattatctttcccatcttcatcgtcattttcttcatcattgattatttcaatgatttctgtggtttcagtcttcacggtaaatggttggggttcttcaatatcctcatcattaaccatgaattggttcaatcttttgaactcttcatttttctcctccctaatggcattatacaaaagaaaatttatccaaacttctgcaaaacagtaaataaaaacagagttattgtgaacgtaaaagtttgactcccaaaggtacgagatacttgtcaaaataaaaaaaattagtaatctaactggcacaacagattggaagtatttaacattgttttctaacaggggaattagatcatgaacaccgttaagagtaaacagaagagcgaaaagacccaattgaccactataacgtgacagtgttaactgcggtaaattcatcgcttgcgttaagactatgaaatatgtattttgcaaaatagaattaacgttctttaaacaaaagaaggcgatcgtgaataaaaatgctactctgaaaaaagcaatattggtggagttcaaggcttgagccattttcttagaatttattctttacttttgctgaatgcgatactctattatgttgtaaattgttacactaccattcaattgtctctctttaaagattgatcgacattattttctttacttttttggtgttttcgcgctaaaagtggcgtgctaaatgccaagtattattctaaaaaatcattacgccatacacaaatattgaagactatctatctaacttaacaccaacttgctttattaaagagtcaatatccttcaaagacttagtgaaatacaattcatcgtcaatataaggttcttcaccgtcgctattgttcaagttttgtattgattttaagtaatcctgcgtacacaggatactcactttactgtccgtcgtggatagttcattccactgcctaatacttaaatggtttttcttgtgtcttttatacgttctaattgaatcatagttattctttcgcaatacaaaggctattgaacatatagtcttacattgggaacaaaatatatcgtattcctcatcttcatcgtttggatcagtatgcacctccaaaagagttgtccgtggtacaatggcctgaattttccgtatgcgttttaattcagtattataaaagacgatcaatgaagagtaacattgcctaacaaaagcatcattgaacaatagagtatctttattgtacttgtccaaaacattgatcattaaatcaaacatatcaaaaacacatgctttctgagttaatttataatccgtaatcgcaccaaatccatatggtagccagaaatctatagtaaaattgacagcttcattaaaattataacctgtattaaaaccagcatggtaacatttaggaaacgtgataatatattcgttgggcttttgcacagctttgtacacaggaatacctgatttcttgaaatttggatcgtacggagatattaaagtcactagctgatgcagtaggtctggttgtttgataaataagtctggtgacatatcatttaatagatcgttgaatttcgtacatcccgattcgggaatgctgtaccagaccttagggtcaccttcatgttgatagttagcacttagggtatactgatcttccatatgccaacaaaatgtggaaaataaggagcctatgtaaatccaaggaatagtcatgccagaaatatttcttttaaataacggtaatagcgaattatgagccataggcaagttagttaaattcataggatgatcgcaatatttgaggtagtctatcaattcgtccccatttatatttttgggtataaattctctcgtcggaaagccggtaatttgacctggcaattcgttatgtatgtcagcaccgtatttaactgtcgttaatgaactgcgacgattcttggtcactaagctccaaaacatctcttccaactcatctatagacagttttcgtgctggtaataaccttgaattttgacgtttacaatattcttgaaactctggtagagaatagtcatgcgtgtcctgagtgaatccgtaatatccgtttccgacgatacaagtgttacaaatccaatcgccagagggaacacgttccaaaggtggtgataaacaatatatatggaatggtttgtcacatgaatcacataaaattgttctttttggatcatttgtcttgcgacaaacaatacaagcatcatcatcgtcctcctcaaaatccgacccagaattcgaatctggcccaagatcgaaatcgtcctcgtcatcacttaataaggattttggatactggtcagcatgcagcgccgtgtgcacgttctcgttcagtgaatgaagaaatatgtagtatgaggcaatatatttctcaaaaatttcctttaacaagccgattggtacgttgaattttttagaaatggtcctccatagactgatgtcgcctcttaattgggaaatatctctaaatttcaattttcgcctgaatgactgtgtagtgtcagtaagtgtccgattgtcttttattagttcagagaaaacgtcataaaagtacacttttttttttagtatttccgatgcatgagtagaatctgaatattctacaatcgtataaggttccctaagtataagtttcgatggatccttaacggatcttttaaaattatttaactgtttcataaaaaatagcctacacctatttttcaggtctaggttctccagattttgaattcttggttgaaaagtaaaattttccatatcaatagaaagtggcgggcagaacccgtttggtggtacgaccttgaccataccatatcgtacaccaagccttttaatgtgggggttagagagataatcgatcggatttttgaattcttgttccgttggatacagggcaggaatttcctccatgatagtgatacgttttttgtgcaagatgagattagttaatatgatctagaggtaaaattgactaagtagtcagatcttattctacattgagcctgcgttgtcaacatgcacatctctgtctcttgggatgataatttttcaatgatgattccagggttactttaacgttacacaaaagaaattaattagtgcggctgtttctgtgagcggggcagtaagtccgaagcccttgatattagcccataccctacacattttactcgtttgccctacatcagataaaatactggccctaagccctcctaatctcttctggttacacctagggtaaaatatctgcctttctttgcattcaatgcgttacttctatatcacgagatgagcatacggatcgtgtataatactaaaaagaaagctcctgaaagagttgtgacaagcaagactgtatactactccttctacgaaagttagttcgagttcttgatggcacttggctattctatttcttgaacctttgagaaagaacagaagtaaaaggctgtgtattctgctacatgaaatacagtagtagtcacagtacaaaaatactctaaaccagtaataaagccacatatatatgtatttcctttcacgtgatgcgctgggatgttatcatcttatacgcaattagccgcccatatgccacccggcgcaccgggtcgcacacacacccccgtgattcgcgatatatagcggccaatcaacggcgacctccaagcgcgtgccgggtgggcccctcgccggccaagcagcgcaaggatattcccatcttcgagctcttagatacaacgcttataaagaacgcactttttgcattaacctcttttttgtattacagaacaaacattttaacttgcccttttttaaactttctttatctctccaggacaggccaattggataaattttgcaaagatcaaacagtaacacaaattttagcaacctaaacccccctcataaacgaagacaaaagtgctcctcctcaagtcaaatttgtctttcttttctttcattttttagtctgttgttatccaatttatactgaatctttgagagaaaacaaaaataaaaaaaagaatggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctatctccgtcccagttgggagagaaactttagggagaatcatcaacgttatcggtgaacctattgatgaaagaggtccaattaagtccaaactaagaaagccaattcacgcagaccctcctagttttgcagaacaatctacttcggctgaaattttggaaacaggtatcaaagtcgtcgatctattagctccttatgccagaggtggtaagattggtcttttcggtggtgcaggtgtcggtaagactgtgttcattcaagaattgattaacaatatcgccaaggcccatggtggtttttccgttttcaccggtgttggtgaaagaacaagagaaggtaatgacttgtaccgtgaaatgaaggaaactggtgtcattaacttggaaggtgaatccaaggtcgccttagtgttcggtcaaatgaacgaacctccaggagccagagccagagtcgctttaactggtttgacgatcgctgaatatttcagagatgaagaaggtcaagatgtcttgttgtttatcgacaatatctttagatttactcaagctggttcagaagtctctgcccttttgggtcgtattccatctgccgtcggttatcaaccaactttggccactgatatgggtctcttacaagaaagaattaccaccacaaagaagggttctgtcacttctgtgcaagccgtttatgttccagccgatgatttaacagatcctgctcctgccactacttttgcccatttggacgctactaccgtcttgtcaagaggtatttcagaattaggtatttaccctgcagtggatccattggattctaaatcaaggttattggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttgctaaagctgaaaagttagccgctgaagccaactagaagaaataaagcttaaaccaagggaagcaaaatttgaaataccgaaggtagaacaataaggatgatgggaaaaaaaagataattttttttttttgtttttccctgcttccttcttgtttattggtattattatgttacgatattcattcattatcctattgatattttctttatattcactaaaaaaaaatttattctataagactgactataattttttttactcccaactgtaagtaaataaagactcacctacgcatacattttttatatatactataagatgtaggatcttaaagaaaaataaagagaaaaagagaagcacacaacctgcgataagttgtaagtttgcctcaacagctattctactcactttttgtatcttcggttagtattattgggaagtcatgttcatcgtactcactttcgcacatgcgattacgtgtattaccctgattttctttctgtattagcgtatggctgactaatattcacttggggtcaacataacttactttcacatatcatggtagctgttttaattaccattctattagatgcgctgtattccaaattaccgttctctcattgagcttcttccttaaaggttcttgcctcgctttcccactggacatgttcatcagtagaagatgcagaattaaaggctttacccttaagaatttgctgtggttcaggtcatcatcaactcgatttgtttcaactgaatcaccagatgcgagcgcaattacgaaaccagatggtattttcaattattctctgttggaaaacagaacatacatcaggatacgaggacccgacacagtgaaatttctaaacggattagttacctcgaaactattacctcattttattaagaaaaatctaaccactgtagaagagaatgaagtgcctactgaagaaggaacgacgaaggttgatccaattattcctgtgccagaatttgatgcacgactgggaaattggggactgtataacgaaaaaggtattcaagggccatatatttcaaggtttggtttgtactctgcatttttaaacggtaaggggaagttaataacagatacaattatttaccccactcctgtgaccgtaagcgaacaaatttcaaattatcctgagtatctgttagagcttcacgggaatgtagtggacaaaattttgcacgttttacaaactcacaagttggccaataagattaaattcgaaaaaattgatcattcctccttgaaaacctgggatgttgaggttcaattccctaatttgcccaaagatattgaaaacccgtggtttgataatctactggatcctatggctctaccaaaaaattccatagatgctaataattttgctgttaatgttttaaattctttgtttaactcagatcctagaatattgggtatttacgtagaaagaagaactgagtcaatgtcaaggcattactccacatttccacaatccttcagagttgtcacttccgagcaagtggatgatctctctaagctatttaactttaacgttttcgacttcccttttcaagtaaataaaaaagcttccgttcaagttagagaaatcagatttcaaaaaggtcttatagatagcactgaggattacatatctgagactttgctacctttggaactaaactttgatttttttccaaacactataagcacaaacaaaggatgttatgtaggacaagagctgacagccaggacatatgctacaggcattctacggaaacgtttggtcccagttaagctggataattatcaacttttagatacagacccagaaagaaagtacgcagaattccatatcgacaacgttgtagaaaagagccttgcagagaacgagccaaccctcaatccatttaccaataaaccgcccgaacgaaccaagagaaagcaaaggccggcaggcttattgatttctaatgaagggctgtatggcgtagctttacttagaacagagcatttctctgctgccttctcatctgatgagccagtcgaattttacattactacaacgaagggtgaaaatattaaaataacacctcaaaaaccattctggtttagcgactggaaaaacaataacgggcctcataaatagatttcacgaaaacaccttgtaaatactacttgtgaatatgcaaataggaaatagatatatgcatacaaataagaaacaatgaacagccttgagttctcaaatttgcatatcatttgttacgtaattccttatcaagaccttttatacaacaacacccatatacccataattattcttaacccatacatatttgtctcaagtttatttttcagatgagaatggccctgcatcagtttttttccagaaactaattcatggtaacaaacatttcgcgccctgctacggggaaggagaattctttttctcccgcccagaacgtaaagccttgtttctttctaccgtactgggcccgtctaattctgcccctttgctgggaaatctcctttgcaagctcccctaccttcgccgcaggcttagtggaggtctcactgaacccttccaccttgggccaacttctacgctcacgttagtaggtaatggattatccacaatgtgcccattagttctaaaatattttgtactttttatcaatacttaaaatttcattttgaattaaaattactttttattttaattacactcctttcataataccaagaaaagagactagaaataaccgaccattccaaagatgtctgacaccgaagctccagttgaagttcaagaagatttcgaagttgttgaagaattcaccccagtcgtcttggctactccaattccagaagaagtccaacaagctcaaaccgagattaagttgttcaacaaatggtcttttgaagaagttgaagttaaggatgcttctttggttgactacgttcaagttagacaaccaatctttgttgctcacaccgctggtcgttacgccaacaagagattcagaaaggctcaatgtccaatcattgaaagattgaccaactccttgatgatgaacggtagaaacaacggtaagaaattaaaggctgttagaatcatcaagcacactttggacatcatcaatgtcttgactgaccaaaacccaatccaagttgttgttgacgctatcaccaacactggtccaagagaagacaccaccagagtcggtggtggtggtgctgctagacgtcaagctgtcgatgtttctccattgagaagagttaaccaagctattgctttgttgaccattggtgccagagaagctgctttcagaaacatcaagaccattgctgaaactttggccgaagaattgatcaatgctgctaagggttcctctacttcttacgctatcaagaagaaggatgaattggaacgtgttgccaagtctaaccgttaagaagctaaaaaaagtgaaagattttcaatattacatatgtttttcttattattacttttatcttctttgtacactctattgtttaaatttataacataatacaatcttatcttttgatgtaaaaaaaaataggactatcaatttttaaataatatatcttacgcaaatctatcaagtaaatataaatgctattggttgtacttcctcgtgtgtcagatactttaactgggtactatttacattgtctctaaacgtaacgtttccttgaaatgatctacacatgtttctaagtcactctacatttgctgctgcattaatggcggttcatttgctttttaattttagcgtccactcctaaaaacatgcatgccagtattagatccgccgttatcaccaaggacccactaatgatgtaacatagccataaataattattgttagcaagtatacccgtgaatattggaccaacacaccgagcaaatgtctttccaatgttgaccacccccataactttggttaaatctcttggtttgatgatatttgttaatagaatttgccttggtgtaacgtccatggcagttgttgcaaaatgcagattcaaaaacaaaatagataagggcaagtaattcttggccatagggatgagaatagaaaatatccctgatggaatttggaccaatagtgtggctcttactgggccaaaacatctggcaattattgatgatgggatggtggaagatgccataaccagttgcgtgatgaaaaataaagtacccaacgccagagatcccatcaaaaattgcttactatagtagtaaaccatccagccacttgtcataaacccggacccgagagagtcgaccatgaagattactaacaatttcatcaaaaccgaaacggtctccttagatagtttgttggatctttcttctgggtgagttgcttgtctcattaatggtgcagtttcatcgttaacgtccaatggttcagctgtttcttcattgcaatctgtatgttcataatgcccgtccaattctgtagcatctgataataagagcatgatgaccattttgcaaaaggcgaagaaggcatacagtaagaaaactaatttataacattgcaaatcagtagcagctaaaccagttcttttcaaaagatctacaaatataccacaaattattgcacctagagcgcttccaattgttccaaccaaggcgtgaatagcataaatctctggtcttgcattatgaggactcagatgtgcaatcatggcctcttctatagatttgaaaggcccgacttcatcacttgaaggcgatataacaccgaagatagcaaatactagcaagagggtgaaattttcgctaaaactgaaaaccaacccacttaacaacatcattgcacaaccataaactaggactcttcttcggccccaggaatccgcataccaagtaagaatgtaagagcaaattacatcccctgccagtgttaatgacataaacagcccaattttatcctctgtcatattgatggcatttaaaaaaagcgtcaaaacttgatttgttaaaccatatgatagaagtctaagaaagacggacgcccatagtagctttatgtctctacttgcacacttgaatttaacaaaaatttccggtgccatggttacgttaactttagaaatattggtaaatccttctgcaatgagctttttcgagatgtgaaaaattagtagagttttctttcgtgccttttttttcggtgcgtcaactttaatatatagttataattgctctataatgctaggcaaaaataaacgagaaggaaggtgagttttagttcattgactaaaaatgagcaaaaaaagtcaggagtttttgttttgaagggcacttcaactctcgaactatggatttacagtttcttcctcgtctttttaagtaaagtattttcaaatgaccaaaatgtaaataaatttgaaaagggcccttctttacgaaaaaaagatcaaaaaaatgttcacaaactatttcacgaaatcaagacaaacatataaaggagaaatacagtggagattagatagtaatgttcgtaatacctgttacaaagtactttctattgttataaaacatttacatattgtgtaaaccaataatatcactcaaaaggaaagtaaatcgatttctttggatgatgtatggttattattggtattctgttcttgttgaacagctccaccatgcatttcaccaaattcgtcatcatcatcttgatctgtacttagtgcagttgtgctattagatacaggattagaggcagcggctttcgcttgggatgctttaggagcactaggtgcttctgcagatgcctttgcagttgaaaagagagagctaaaaggatctacttttttaggttccgcaatagctggggtaatcttgccttggtcggtagtggagctgttataaaaaggcattgaactcgtggtggcgggcataccctcaattgggctcgtgtttagcaagttaaacgaattagcagggttggtaacagggacggcgctttgaaattctgaaaactcgtcatcatcgtcctcttcttcgtccgccttcttttcatcttcttgtatgagttctttagatggttttgaagactcactagaaaaaaagtcaacaaagtcctctggttcttgttttccttgcccaggagtagatgtggctctcgaggcattatcgttatatccattttgactaaaagaaccatcttcgttatcttcattgtcactatcgaaatcagcactcacgctaatgccgtgcactttcgttgacgtgaaacctgccttcgaattcaaactgccatcagcagaggcagatcctccagcaacgcccttgtacttctttgccgtttctcttgccttttttctttctgcgcgtatcttattatcgtcgctcaataattcaatcaaagctttgaccctagttctgacattaattccttgatctcttccctgggaatcaatatagtgaaaagtttctaaaatcctaattaagttaatgctattccttgtatcatcgataaacctttcagaaccgtgtttgataaggtaatcgagcaattgcaaggctttataaatttgcctccactcactacctgccttttcagtgaaccttctgaatatcatggacaaaatttcttctctttccctgaaattgtaagttccttgagaaatctggtccattaaagtggatgaggcaccccaaggctcgttgtttgtcgcttcacgaactttcccctccatctcagtataattgaaaacaacattttgagctttacgaaaatatttcttggcgtcatataatgacatgttggctaatgtatcctctaaactcattcttcctaacactaattaacgatgtgatctcctatcgacgtccctacaccttcctgaattggtaatttttgctttcctcaaataactgtatctacaaatcatttcatgattcttctagtccccttttacttttcctaatcacctcgcacaacgtacggtgtgacatgtataagaaattgaagccatgtttatagagtatatacaaaaaagcctctcatggttattattcaaagtcactctacgtatgcaaataaaataaatgtatatactgaggtgaggtacttaaatgcttattgaagtaaatagcgaacgttgctgaattggcttagcaaaatggttaaccactgaatgacctcgtttctatcaatatcagccaatccttcgtgaaggccgggcaaaacttccccgacagatccctcaaacttactaggtgctaaaagagagtacttcatccattccctgtctttcagtcctctgtgtgtaataaataattgatcaatttgctttgatttgctattggatcgttgcagtttaatatagctcttgatttttttgtaaaaagcccaaacaggtaaagcttccctacactctttatagagaataccattttgttggtcaaattggatgctatcttcctgtgtggcaacttttaataagtccagaaccctttttgctaagctgttcacttcatcgtcctggggaaatgctgaagatagattagagtgccatgcgatataccagttatatattttcttcaggtaaacatgtgtattgaatcttgccagttcgttttcactcagcatcagcgttgtcaaacctacaaacatggccatggtgttgtgtaacttgtagtcagaattggtaaatttttccaaccaagttgggctatcgaatacggagttactatgatagactgcgcctgaagtatcattggcattaaactgaaaatgtgcagcgggcactccaagatggtactgaaatgaagtgtaactagacaacccatcaagtagagaaatagtggcattagaagtgtatttccaatggtcgaacaatgaccagtcttcgtgcccattaaattccgtgagcttagcagcttcgtatatcacgtcttgtaaaagtgggttggctttacagtgaaaatttgtcccagagattgcattatctagatttaggtataccaaggcccttctcctgagaatcgcagcatgagcttctgcataatctgtagatcccagaaggccggatcgttcaccatcccaacttattagtttgataggacgcagtggcttccaaccatgcttaagtaatttactcattcctcgtgcaatttctaaaagaatagcgctgccactatttgcatcaccggcgctactcgaggcgagcgaatccctatgagctccgataataatctccccctcagtgaatataccagggatactaacctctacactactcatttccttgatgttgtaagttagctcattatgcaaatggactttatcgatagagcttgaaggtccagtgaatgatccaaaatcttttatattactaccgggcccaatttgaaaacccctgccattcaatctttctaaaattggttggacatctctagcactcatcggcaccgatggtatcctcggcactctccctaccggtgacatatgttcagtgtcggaatccttggagggataccctggagttgtcggatctcctggagtgtcactgaaatagtttacagaatctctcctaatataacttgggtttcttgctggtccataaggatagtgtaaaaacccattttcctcagtaactttaccatcgtcaaatgggtctgtatatataatgacactggaagcgccataaagttctgcattctttacctttaatccaggtaatattttacccgatcgtacgatgtggattttatcttcaatatcaatgtttttcttcaaaagtagcttgtaatcactgatgctaccataattgcaaaacacgtatcgagcagttacacttccattttttgaatattgatggaaacccttttgccttttcctagcgtgagaagcaggatcacctttaactctatcctcgatcatgcttgcttcgtagaccactttaccattttctaaaggagctacgttagtgtctactggttcacctatccatgggtaatatttttcaactttgggtttgtaccccatatctagaaactcgtccaaggtatatttaaacgttgacgaatcacttgctccgttgctcatgtacccagcatacttgtatacatgttctttcgctctattttcctgttgcaaggagttcaagtatatcctataaacctctgcattcgtcaatctggaagagtgaaaccgccgaaagtctcttgataaagacgtcctgggagcaaatgcggcaacaaatcccatgtacaaaaggagactcgctagaatcaagtacataaacttttccttgtccatatgttctttcattatttcataaccactaacaatactagatattgtattacttctgcctctattcctggatgttaaagtgaaagaatcattcatgctttcttcattgtcatcgcgagtggtctcgccactatattgttgtaatccagtggcttcggcctcattgtcatcagggtctgccatattaacaacagttctctcctttaattgaccttcctctttctctctctttctctctctctgtatcattctcatatatctcttacattcttaattgtgcatgttgaaattgttttaataagtacggccccttgccttgtcaaacctttttacccgggccatcaaactcaagcaaactccgaatggaacaatgcctttttgaagcctggtggtatattatgaaagttatgatagttctaagctttaattctgtaaatactatagtatagagacggccgccattatatatttgtaaatcggacttatattctagtgtttctttttttcgtaacactatagatagctcttgattgcaaaccatgagcgaacgataatattataggccaaattggcgcatcacccaatatttgaacacccaaatataaacatttggaggatagacttgccgctacaattagttgaattgtctcatttatatcggtattcgggtccatggccctttgtgcttgttcttcatttagtgctgacaaatctagggcatccttgtcctgccatcttaagaaatcagtgtacgatttcaacacatcacactccttcggtatcaagttcatttgtaatcttctcaaaatcctttctgcttttagccataagacacggtccgaaaaatccaataatgctgagttagggttgttggcattgtacccgcgtgcccaatcctctacacatttcatgtattccgaaatcactaatactgcagtgaacatacatgtggtcgcaaatacaggagtattgaaaattctgcgcttgccctgtttaatgtacgtaaaaaatgaagtccacgcatccaccatattcagtgcatactcggtagcttccctcaatgaacccatgtcatagcaaacttcctccaaagctttattcatattggaccaatctttcaaccagattttctcaataacatgtgccaggtccaaacaccgtctcattttggcaaacaaatataccggaattattaacctcattgctggattggcgtttattgttgacatgctattctcggtaggtgtcaagatgccaccatttttcaaataaaggttttcccagtattttaacattgtatcgatccgttgtctggaagtcatcttccactcaatatcgtccaactcaatgttattgctattggtgttgttattactgatccttgcgttatttctttcaataagtattttctcatggatagatatcaacaatgatagacatgtacttaacgaaaccctagcatttccgtaaaaaaaactatcgcctgtagaaagaaacctcaaacaattttcatatgcctcgttaccattagacaattcaatcaacgaaaatttcgaatctaacgttattttgtattgacataataggtccgaccattcatcggaatttcggcactgatataattcttctttatagcatggaacaccacattttaaatcgactgaatgaaaacagcaatcagcacctaccagtgaagaaaataagttagatataagtaataccgcatggcaagtcctgatacgtgactgcgccaatacaaaatattggtagtttttgttcatttgattcggcgcgttgtattgctctcttatttttgaaaacatatgaggactgttttcatattccataatatgatcactctcaataggcggctggcatagggactctaggggcaaatttaaacgagaggccttcaagagacgaataatagtcgtcaactgaccatgcatccccttgatcacggctgtatttttattgaaaatacagtagaacgttagcaatactaatgtctgtataacccataactctgtcgtctccgggtttttctcactaactttcaagcttttcctaatttgggtgctagctgcattagctaacacttttgcatgcgtcgaatgaaacccatacaatgctccgaccatggagatagataataacaagggataactgtccatattaggtatgatagaaggaagatgaataaatgaaaaaaatggatggaattcttccttatagtaagtcacataatcgttcaattgactagttgtggggaaggctcctgaatcgatattattgtcggctagcatcatactccttagctcattggtaaaaagcacttgagatactgaagggacagaaaacggagataacaaatccgaaggagtaagaacaggcagctgtttctgtgttgcattagaatcagtttcgccggggaaagacaaagtgagaacatcgtcgttcacatgagaattattttgctctgtcccgtttaataccttggaaatatccaattgccttgagctgaaaaaattggatagatcgtagtccatcatgacgctatcacgacgcctcttatgagaactatgggaaatagggtcagaataggaaggctcctttagttggttttgtggtgtacttggtaaatctgtgcttccattcaaactcaagtttaagcgaggtgataaagaagctttttcatgatttaatgaggtagcagaatggtttggaggtgacttgtttggtatagatgaccttgatgaaggtggagaataaataaacccaatgtcattgaaatgattgaagttgatcttgaaggtagattttggatcagagttgttaataaactctgataaccacttgtcatctatggcagcaggatcgatattactatccttatcattgggctccattgatggttccagtaaattatttgtgcctggattgaaattgatcgtggaagaggaatctgaaacagttgttggtgggtttttaggagatagtgacataagcggctgctcattgctcatttgcctataagtttgatttgccaaattactgtaactattagaagccgtagtagaattagacggtatagtattcgggaagcttgacggaaggttaaattcagaaactgtcggtttatcatgactgaagcagcccaaatcaaatggcgaatggtggctagacatgtatcctcccgcacctgcatgtgcagagttcattgtcaaaagatcggttaaagatggaccgctacttaagagatacactccaggtgtagcaactgtacttccattgttgctgttcactatggtactagaggtggaattttgctgttgttgttgttgttgttgttgctgtccggaggggtcattgttaaatagatttaagttaaacttgatagcttgcggtggttcgtccagggttaacggaggtaaatccaattctgacacgctttccatgagctgcttcgcggtcatttgtggagtagaaaagccgacttgatgcggagcgtcttcaacgagctcgaaattggtaattgaatggtgggggctattgctactagacatgtaagtcattgcactggatgcagagaaagacgcatgtcttttcgtcttatgcatggaagagggagtgttcgccctgtcgataacagcatcgcttgatgcagagtgaactggcacgcctttcgtgctgaacttgaactctcgaaatcctagggagcctgccttactaggaggagttttctctcgcttatcgttcattactggggccgagacgggaagttctacattatttgatttggccaaggcaaccacggcctctttcaattcttcagatgtcttaccagcaaggttcttcggggtgggtagaatagtctctttatttccggctattttaatgatatgaaggtcggttggatcatccgccgccacggaatggcgccgcttggaggcaaaagaagaagtcgaatttggtgctggcgtcattcgccgtggatcccccgtacctacaagagcagcatgaagtttttgctgatgcctgagcactaaatctctacgagcaaaacacctaccgcaaaagatacaaagatacggtttctcacgggtatgcgaatgctgatgtctcttcaaatgctcctgcctgacaaaacccctagtgcatgtgggacacaagaacggtcttggcttatcagtcttaataattcgagattttttaggaatgggcagaataccttgaccagcgggcttagcgaaattagattgattaccgttcacaaacatacttggctccggcactaataaaaaatctttatctgccctatctattctagtatcgccaatgtcttttagcttcttcgccctaaagtttctttttggtgcaagagtcttcgagaaaaacgtgtgttgagagaggcaatgtttaacgaagaaaaaaaactctatggaaatccaagaagtccttgtttctttgttttcgtttctaatatatgcagggtcaagcgggaaaaagaaagacagacggaaaagtgcccagcaacacggaacaaaattgtccagatttattcgagcggccgcggttagtatgcataatgcaggcgcccctcgtccaaatgcgaacggttccatccgaaacaggccatttcccaaaaattatttctcttaatagaagttgctcgcgtagttacctattgtcgatgccgcatacgcagttaccttatccgttgccctacggagaatttccgcgatgcagcaccgtgcggcgagatcacaattttccttgtacactctactctgcccctggagtggttcacccccgtctgtgcgtattttcgtgtatgatgatataaggtcgttactaccgttgattcaaaaacagttgcttcttccatatattgtagcacgaacaactatggccggccgcaaattgcgacaattacacctaacgcagcattaaggtcgcaggaaatgttatctgccgagctgtttatctctgttttccaagattttttcaaccagcccatgagtctgctgttggcggcaacccagttacagataatggtgcatgtgataagcttcgtaccactattcgtagtttgttacatcttgtaagccagtatatatatttgttagattgtgccctaacgttccagtaattgaagggtaaccgaggtttccgtggaaaaaaaccgtgtataagcaagaggttccgagcgaaaaaaaaaagtataaaagaaagcacaggcaatgagatttgtttttcgcttttccttcttatttgttaattctatttttgaagtttccttccgaaaaaaagtaactttgtcctaaagtactaatccaccgcattagacagtacgaagatcgagctatttatttgaacactcggtcttattcgtgataagcgtaatgtggagagatcaatttccgggtcatttataagaactcgagtggattgctagttgttttgattagctgaatgagactcgagtgtcagaagatgactatattttttttctttttttttttagttatgttttatttttgaacttgtacttgcacatgtatcttattgtttcgtgatcttgtagatccgtatgggtgcaatcaaaggtttgaattgcagggctttcatcgcgcggatctcgttgtttgcgtcgtactctgtgctggtgactatggtacattttagcccgagtttattgcactcttgagaaaacagttggacagtggattcgcttctaattgtcgcggataggagacacagtttgcatcggtctaaagcaagacattcggccagacactcgcatagatcaggaaggatagttgggtcatacgtaacatctgcccccactactaaatctatatcctcaggaactctatcgctgccccaccataatctttgcaacttgatgtctggttcgttctcacgcacttcattgttcaattcaaaatttcttttcagctgcgtctcaacgagattcgaatcaccatccgtgacgtacatcttatttacgaactcgtgatacttttgtaaaatgacgagactcactatgcctgtgccagcgccgacctcaagaacatttaattttttcttgccatcgtcttgtccttgtaccggtgccaactcttgtaagggcttatgaataaggaaatcacccatgtataaggcagcttcccatgtcctgaaacctgtagtactggccgcactgatcaaattcggtgtttcctcaattgtgatctttacgtcctcgtcaaacctgtacctcacgacgtctttcatcatcgggtctggcttgcctgtgcttaatagttttatgtacttctcatagagataatcatatatctctatctcgtcttcgccatcgttgacaattgtgaatgccttcgcgaaaatccattcgtggtctaagagcatcttgactatggttttgcaataatatgcattcgtcttttgcacaagttccatctcacaaacaaatctcgatgcatgcaggacatcgttagatttgcttgtttccaactcttctagcaagtattttccagggcaccgctgatgtaatctatcgtagaatagatcttcattcatgttatctttgacgaggagggtcaagttttactagctcgatttttctgctttcttttcctttttcatttacttatacattcttcatcatttttgcgatgatgtactaactgctagtatttatttcgctgtttgtcgtgtccggacaatcagcattaaaattttctacagagttttctaatacatataaacattttggctttattcccctaaagctttctcaatggcacgctgaaaaacattgcataaaacgtcgctattttccaaaccgacgctcactcttacaagatttgtttcgacaccatattgagctacctcgtctaattcctggtagtgggcaataatagcatatggacacgccaaagtgaaattcgtaccgagagaaggtcctttgcacaattccagattattgaaaaacttctttgcctcttcaatattgaaaaaagttagtgaaaataaacctccatacccaccatcttttgtagacataacgctgtcataattccgcttggtatcctctgatgttaaactggggtaatatattttcttgaacaattttcccacctgaggcaataacaccctttttaacaatatatcagtgtttgtattcaccttgattgtacgttccacgaagtctctcgaatttctttccaggcataacgcatcttcgcaccataggcaatcttcatatccgtcttcagtcttcataaattttctagcaaactcataaatctttcctctaggatttagtactaaggatcctgcaataacgttcgagtcgccgctgaagattttcgttagcgaactacaaacaatatcggcatacggtaatacatctatattgacaaagccacccacagtttcatcgaccactatgtaaaatgaatacaagtctgatagccttttcagttcttgtaaatctcccattttcaacagtgggttcgatggagcttctataaataccgccagtatttgctcaccagaatgtaaaatatttttcagagcgttcattgacgttgaatctccctgtcccaagaaatgtgtgtgattgaacttccgaagaatgctcagagtatctgtatatgggaatccaaacatgacggtcttcttgaacggaggtccatatccaatcaacttatcttgtctactagaagaccttgataagcgcttggcatcgaagtttaaaagcagcctgtgggcagtgaaaatggacgccattccacttggaaataagtaaacatccgtattagggttgacatgaaacttcaagtcatcggtagctgtgttttcaaaagtactgtttgagccactttctcccatagaagtaattgtttcggcaggtatgtccgaattcaactgatcatcatccagagcctctccactgccaacattgaatggaccgttgctctcgttatagtgttcaaaagagaataggtccgatagaccttcagagtcaattttttcaacaacttttgtggcaatcctctttcgtattagatatttggctttatcagcagcaagaaaatttaaatttctcccaaatctcgtttctatatattcttcgttcactctgttttcatcttcggtcataaattttttaccgttatccactgtttccatcttcttaagattatccttgacttgtaattcatgtaaaatatactccgccattctgctagatacaatctcaccagaatgttgccaatactgcttcatcacggggaatatttcctggtctacaaacaccaccgtgattttacattcccttctccagagcttttcctcttggttcataggtttaggtgtacatagttgtaagatgcgtactttggtagaaagacccgttttcactttgataaactctctgcacctattggcaaccttgtaagaggggaagcaaagacaagcttcatcttccatggagtacttagcggataaaatttcacataatttctttattgacttgtgtatgaaaaatcttggatatccggtagtaagcgagttaattatactgctttcaccctcttcatagcctactgtagcttcccatgtgggcaaacacacggaaacagcatgttttgtgttgggcggaatagattcaccaatggttctagatatcattttttcttctgttcctcttctctctcttgtttatgtaggtcccgaatcggcacatgagcgtcattctactatcgttatatatatgggtatatatatatatatatatccaaaatatatgactaatttttagaccgagatattgtgaagtgcagaggcgctatcatgatttttgttttttacatccacgcatgaagataagtcatatttactaggtttgaagggttttacctgaacaacactggcaatcattgaagttaattgagttcttaaaccgcaagatattttaatatgaatactgctatttttaaataagactgtagcaaaatgtggggttaaacttttacaaattcactttggttgtaacgcattttctgtggaagagcaattatttggaattttcagtttcgccaaacgaaagaatgaaagaaatgtgctttgccaagaaacgaaagacgacagaaaaaggtagtaaaagaggaaaaggttaaacattgaaaaaggattctatgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtggccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtaggttagtgtgctatatagtggccagattcgccttttaaaattcactatgcggtgtgatgatgtgctataccattttttccatgtttaggaaaatgaaaaatttgcaatgcttacttcagcaaaaaagtatatttgaatcaatattcatttatatatttcagcataatcaatcatttttcgtctggatatttgacacaattttgattttgacgaagacattttattctcgatggatattacagaattgttacagtgctttgcctgtactttggaccataacgctgccgtaagaactaatgcagaaacacatcttaaaaatgcaagtaaagtaccgggattcttaggcgcatgcctggatatcattgctgctgatgaagtaccagaaaacatcaaattatcagcttccttatatttcaagaataagattacatacggatggtctgctggtgcaagacagggttcaaatgaattattagattcacatgttgatccggatgaaaaaccagtagtaaaagatatgttaattaaaacaatggtcagtgtgtccaagacctccccgcgttgtatcagagtgctaaaatctgcccttactgtaattatttcagaagattaccctagcaaaaaatggggcaatttgttaccaaattccttagaattactcgcaaatgaagacatcacagtaacatatgtcggacttctgtgtcttgctgagatttttaggacctataggtggaagaataatgatgaaagacaggacttagaagagttgattttaaattatttccctgctttattaaactatggcgcaaatgtccttttccaagatggtaaatatatgaataacgagcaaattggcgaattggtaaaattaatcattaaaatttataagttcgtttcataccatgacctaccatttacattacaacgctcagaatcgtttaccccatgggcatgtttttttgtcagcatcattcagcagccattgcctcaggaagttttgtctatatcagatattgaggtcagaagtaaaaatccatgggtcaaatgtaagaaatgggctcttgcaaacctttatagacttttccagagatacgcatcaacgtcattaacaaggaagtttcagtacgatgagtttaaacagatgtactgtgaagagtttttgactcagtttttgcaagtcgtcttcgatcaaatcgagaaatggggaactggacagttgtggttaagtgacgaatgcttatactacatattgaactttgttgagcagtgtgttgtgcagaaaacaacttggaaacttgttgggccccactacaatgtaatacttcaacatgtcattttcccactactaaagcccactgcagagactttggaggcctttgacaatgaccctcaagaatatatcaaccggaatatggacttttgggatgtcggctattccccagatcttgccgcactggctttgctaacgacatgcgtgacgaaacgcggtaaaacgaccttacaaccgaccttagaatttatggtctcaaccttacaaagtgccgttggtgattacaacaatattatgttggataatgccttgcaaattgagtcctgtttgagaatattctccagcattattgaccgtttgataactaaagattctccatttgccagtgagatggaaaagtttatattgacatacgttttacctttttttaagtctcagtatgggtttctgcaaagtcgtgtttgcgatatttgttcgaagttgggttctatggatttcaaagacccggtaataacctctactatctacgaaggtgttatgaattgtctgaataactcttctaattctttacctgtagaattgacagctgcattggcattgcaaacttttatcagtgatgaccagtttaatatgaagttatccgaacacgttgttcctactatgcagaaattactaagtttgtctaatgattttgaatctgatgtcatttcaggcgttatgcaagattttgtggagcagtttgctgagcaattacaaccttttggtgttgaattaatgaacactttggtccaacagtttttgaaattagctattgatctgcatgaaacatccaatttggatccagattccttcacgaacgttgatagcatacccgatgaatctgacaagcaaatggcggcgctaggtattttgtcgactacgatatctattctgttgtcttttgagaattcacctgaaattttaaaaaacttggaacagtcattttatccagctgcagagtttattttgaaaaacgacatcgaagatttctatcgcgaatgttgcgaatttgtagagaactctacattcctactaagagatatcacacccatcagctggaaaattttggagctgattggagaatgtaatagaaaaccagatagtatggtatcttattatttaagtgatttcatgctagccttaaataatatcctcatttatggaaggaacgaattaaagaagaacgagttttacacaaaaatcatattcgaaatatatcaaaaggctgttactgcagaagataattcgttagacgatcttagagtggtttttgatttatcccaagagttggttcttgcattagatgacagtttacctcaacaatacagagagcgcctactggcggatgttgtcggctctattctaacgcaaaagaatgaattgaaaactaatgttgtatttagtgtgactgcttttaatgtcgtaatctcaaatatgataacagagcctttgatcacgcttcagtacctgaaacagcaaggttgtcttgaaatcttctttcaaacgtggattacagactatattccgaattataaaaggtgctatgatatcaaattatcagttcttgcgttattaaaaattatactgaagttagaaagcaacgattattcagtgttgaacttagaaaatttggttccgcaattagggagtattgttacgcagttagcttcgaggctaccaacggcgttaaggcaattagctaaccaacgcaaggaattctcatcatccggttttgaagaggatactaagtgggatgaaaattttcttgacgttggagacgatgatgaaaatgatgacgagggagaccttactgagaaatatctggaactgataaaaaatagagccgattccttggacttcgtagatggttatgacgcaaaggaaactttcgatgacctagaagaggacccattaacggggtcgatcctggacacagttgacgtatacaaggttttcaaggagtccattgcgaacttacaacatgttgacagcaatagatatcagggaatcttgagacatctgaccccggctgatcaagaactattcatgggaattatgaatgcctaattgaattaaatggcgattgtatattgaaacaaacactggattacataatttagatagaagagagaggatattatgctcaaagtttgttgcctttgcctcggccagttgactttgatttgatatcaagatcttttttttttatctggagtcaatgcgatgaacctaaaaaaatcacaagctttttttatctctaagctggggaaagaatcgtagttaaatcggaaagaaaaatatctgagttttgtcagtctttcttttgcatagcccatccttgtactagatttcataaacattgatcacttcaaaatatacttgtaccaagatggccgaaaatgagagaatgtacatctcctataataatattcacaagctttgtcagggagtggctaaacatatcttagctagaaacgaaagacctgatattattatcgccatcactggtggtggtatgatccccgcaagaattattaggtcctttttgaaaactaaaggacaaaagaatattccgattcaggccatcggcctatctttgtatgaagatttagggttggataatagcgtcgaaactatcggcaaagaggtcatcagaacacaatggctggacttcggtgctttgaaccaacatttcgattccttaattggtaaaaaggtcctaattgtggatgaagttgacgatactagaactaccctccactatgctgtttctgagctggaaaaagagattgctgaacaacaaaaggttttgaatagaatgagtgaggaaaccgttatttctatctttgttctacataataaggacaaaccaaagagagctggactacctgactccatgatgaattctggacgttacattgctgcgcaaactgtccctgataagtggttgtgctatccatgggacgctgaagatatcgaagaacataccatgctcgctaaggctcaaggtcatgactgatgacaaacagtatgttgcgatggggttgcatgtatatagatacatatagttatcattggtaattatttcatatttaacctaaatctaaagataagagtgtatttctagttatctcatttttccttgcatttctaccatttgttgaacttgttgatgcatcatctcttttaaatcggacacatcattttctaattcctccacttgttcagtcttttcacctaatagttgtaaggaggtttccaatttactttgcatctgctcaactctttttaagagatcatctttctgtttatttacctcattgaatttatcgttttcttccagaagtcttaaaatctcatcatttgcttttgtcttttctttcagtaaattatcgtataattcctttgatgctgataattcaccttccaatctttttaactccgtacttaacttgttcaccagatgagcgcttatgtggccgttagaattcgatagctggacgctagctcttctgtatggtattgatgtgttgtttaacgagttcattgattccccttccctgattgcttgtaaagcagcggcctcttctggaatatcgtcaatgctgaaatccacattttttctatcaaaatgttggctttcttcgctacatatggtttcgtgagattcattgtaaatgggttttagagacggatcgctttctaattcgccaagttttgacattgataatgacagcatagaattttcttgaggtaaagtccattcgtcttctatatttccctccatggagtttaaactatctgttaattctacaggtattttatctataattttctcattgctgttttcttgatgtggttttagttcgttctctttttgttccaactgagacctttgaatttcgtacttcttcttcagtagattataatcatcacttatactttgcaatgatgacttcaatgtctccgcccgtctctccaagtctttcacttccaaaactgccttcgaatgattctctttttctttttctaattgcttacctaatgtttcagatgaacgtaaggcagtttgatatttttcttcaatatcatttttttctttcattgtagattcaaagcggttttccaagttcacaattttagtgttcaaagcgtattcaatactatcccagttggcctttgatgactcaagctgttctttgagccgattgtattggaaagatgcgtgttgtttttcttcataactttgttggtcatcgacaaaatctctatttgatttagcgtctaaattttgagtagagctatctaattctattcttagttgttctagtttagtctctagagtggtaacttgatcaactgttgcttcttgtagtgctttcttttccgtttgaaattcacttttttctttttcaagcaatgttctcatattatctaaagattgctgtaaaattgttatcaaatcatctttttcttttatatttttctctaatgtttcaagtgactctttttgtttatctgcatcctttaatttatttgtagcttcagccagttgtccttgtatgttgtgatacaatgattgcagctcattatagttttcgacactctgagcagaactatcgtttagttcagatacctcatactctaagtctttcacttttgttcttaaagctttgatttgatttgattgcctcagctcagtttccgctaatttagctccttcttttctcaactgatctatcaagtcgtccttctctttaatcaatttgaaaaaactagaatccgtggtttcgatttgtgattttctgtttagttcgttagttaggtcatcaatctgtttgtttaatcttaaatattcaggactaatttctttgactaattcttcaacagtaaattcagtgtaatttttaggtagccatgtaggcagtgataccatagtgtcgtcgaagcaatcagtcctattgtgatcgggatgcaccacgtcatcgacagcgattgaatctgccttacctgtatcgccttccacagtgctttctgatcgtaccgcaggatcatctatgttttcagcattgtcaattgacaccacaccggcagccgcatcatcaatggatgtacgagcactttcttgttcattgtttgacagcaccacaggcgatggagacgacaaatttgacgttgaccttttatttttctttcttcctttcttagttgccaaggagagtctctcttccaacgataattttttactcatagcaaaattggtataccactaccatacaacactttttatatactattctggactaaggaccttttaacgacagtctattaaaagaggaagtcaagagctttttggtgaataatctacggttactgccaaattatgatcttctaaattttggcgctttataacatcctcacaccactacgaagcacactttgactacgaagtattacttaagttagactggtctcattgaaatctattagtttgatgtatttagtccctggatttgtagagccctcaattactgttattatattagccctaagtaataatctgtatattggtatcgttttagatgaaaaatcgtttaatgtcagattcaaatcatgctcaattagtcttttcattaacagcatgacttcgttcgttaagctatctattgattcatcattatcatccaaattcggtactagataacccttgagaaagtccgccagtgagtcccaaagctctttatttctggcttttcgtgttctaatatgggcgtgatcttgcttcttactgtccataatggtcatttgatgctgcagttttcgtagcagctctttcaagtcactattaatattattctgtaacaataacatggccttttgatcaactgattgatcattcataagcgagagccattcactggaactttgggctctcaaagacaaaaaattcgatgtcaaactgaaaccaataggatcagctctctctgagaagaacatgggttttcttaataactctgtaaagacctcagaattgaccggtttaccctctgtatccagagatctcttcgtgatctcatcgatggcaccttgagcttgcttcaagaaatatcgtttgtttccgatctggttctccaggttctttatgtagacatccaggacatccttttcaacatccatgtttcctttgtgagactttctgccgtttgctcttgtccctctttgtcgtcatatgcgtcttgtttgttgttacgctgcatatcaaagcgaacggttagttattaactaacgtaaaaattgatggaaacattcatttatatggaagtattgaagaagaggtaaaaaggaaaacaaatttacaaacaacaaagaatgtcttctctatcaacgtctgatttggcctcccttgatgacacttccaaaaaggaaattgctactttcttggagggagagaactccaaacaaaaagtccagatgtcaatccatcaattcactaatatatgcttcaaaaaatgtgttgagtctgtcaatgattctaatttaagttcgcaagaagagcaatgtttgtctaactgtgtgaatcggtttttggatactaatatcaggattgtgaacgggttgcaaaacacccgttaatatgaaaccgatttatctctccgagtcattattctctttaccttaatatatctgtaaataagcaaatgaatattttaatatatgtccaaggtttctttaaaagggattcttcagcataaagggcaaataactctttttgtttatatactgtctagttatatatatatatatatgtatatgcatttgtctgtgtctgtgtctgtttcctatgagaactcaaaaagtaactgaaaccgcggttgcttagatagagtcgataactgttcacccatagcgcagtcacaattcagcaaccagcttatcgtttccttacattgttgtagtattgattcgttcaacgcatcctcttgcgaacacttatcgtatgtaactagaattaatgataaaatgtcgaatctgtgagccactattctttcattcgggcaaacctttatgagagtacttaccactgaaagagtttttgaaataagttttggaaaagttgtgtaaaaaggatttcgtacaatatattcacctaaaacaaaaatcagcctctggagatgtacaacagacccttctctttgaagtctcagtatgttcattgtgcattccaatgcgtataacgtcaaattttcgtatgcaaggctagccctaggaattatgttttgcaagattatctctgacatgaacttttccaggtgatattgatactttgtgtaattgtccaaaaattctactttatataacgactgtatcgttgggaaaacgacccgccatatggctattgtttcatcagcattgtatgagggagggagaaaatagcacatattgattagcgtcttttcgaacagtggaaataaaccagtactagagaactgtatccattttgagtcattggtttcgttcataaaggtatgatttaatagcgtctgtaggagcagaacaccacgaagtttaattcttcttatatcagtggtatcatctagtatgtttagaattcctggaataatccaagaaagattcgtagatatgtctctccttttcaaatgtaacagaattacgtagaataacggaatgcctttcaagccaccctgacttacccacgcctgcattaggttatcttctttcaaagacattccaagcgtgggtttgagaccaagattacgttgctctttgagttcgaagttgcttttgcgttttaaaagtagtggctgtaacttagaaataaggacgcacataatttcgtcatgttcacttttgttacgctgaaagtagtaatctatagtctgcaaaacatctgtgttgatttgtatgtctactcctggagatatggagtgatatgagagagattcaataaggttgacctcatcggacaccgtaattgcacatccagtatctgtcttctttcgtaactggagacacaactctcgaagccttgtagaagaaagactcgaatcattcaattcatcgatgatatcagttacggccgtcattcttttcaatattttgttatatgattttattcttcacctcgttttcattcttcatagttttcgtttctcatctgctattgaaaaaccgaactagccgaaggataacaataatgagtcttaactgttaatatacaagattatacaaataaatatgtttctataaaataaaaagttatattcaattgcgaaaaaaataaataaatgtgggaagaaaacccaatagtatgtcctactatgtcatatgctatcattaataggcatcttcagacacatcttcatggaagtatttaccctcggtggttggtttaatgatacctactcttatacagaaatcaccaaagtgttccccttcttctctttctaaagcataccttttaaacaatggtttgatgtagtcgacaatttcctcatccttcacattggccttatacaatttgtttagcctttggccgaggtaaccaccaccaagcatcaagttataagtatgtggagctttaccaacaagagctaattcacctagccatggacgagaacaaccgttagggcaaccagtcattctcataataatggaatcatggcgtaaaccatactcttctaaacaatcttccaactgagtaataatgtcaggtaggaaacgttcagattcggcaaacgctaaaccacatgttggcaaaccaacacaggaagatgaagataatctcaaaccgctgaaatcggtgttatccaatttataggtctttaaaatagattttattccagcaacatgttcatctgtaatattagagataaccaaatgttgattaccagtcaatctgaaatgaccagaattagtcttaagcatgtattcagcaacctttctaatacctgtcttttgaggcaaatctggtgtatcttcaaccctaccattttcaataaatgcggtaaagtggtttaacccagtttcatctttaatccatccaaagtaatcaatattagatttaaactcaaatggtctctcaggctcgaatttcttaccccagtattcctccactttttgcttgaagccttcgacacccatatcatctacagtatactttaaacgagcatgcttacggtctttacggtcaccgtgatctctttggacaataacgataccttcaagtggtggaataatgtcttcagttttaacaaaacctaagcatgaccctaatcttgggtaagttttcttgttgttatgagtggtacccataccaccaccaacaaaaacattataaccctccacgatttgagtttctgggttaactatagcaactaaaccgacatcgatagataatacatccacatcgttatatggaggaacggcgatgttgaatttaaactttcttggcagataagttggaccgtaaattggttcaatatcgaccaaagcgttaccgctaactagagtcttcttttttcttggaccatcttttctgttttcaaaaatagatggccaggatggatcatcgtcctgttcttctgggccctccagccaaacttcgtggtaggccgtagtctttggtaagaaatgatcagaaatcaattttcccatatcagcgatttgttggtgaaccttggcattggttggtagagcagaaaccatgacatttctgttcacgtcacctgcagcagctaatgtatccataagaactgcattcattcctctcaatgtgtgtttcaagttcttctttagcacaccatgaatctggaaggttgcccttgttgttaatttcagggtaccattgcctgaagtatcagataagtgatccagagcaagccattgttgtggagtggtcttaccacctggtaaacgagctcttgccataaacatatagtatggctctaagccttgtgacttacgtatttctctaatgtcacgatcgtcttgggtgtaaataccgtgaaatttcattaattgttcattagcgtgagtaacaccacctgaagaagtatcctttaagttctcactgatagtacctctcaagaaattagattctctcttaatatcctcgtttgtaacaggttttggctcatcatcaacagcagcgccggaaacaccaagagcttcccataatttaggttcccactcagaataagcagtttggaaaccatcagcatcttgatcatcacccagtcccaagggaattagggctttggcactcaataattccaagcgcttaaataaatcctgtgaaggcttgttaaaataatgtttatcttctttacgtggccaatactcagaatcaccgagaccaaaaacagcaacattcaaactagctaaatccaagtcggtgtcatttttcagagcttcccagaaagacttaccgtcttgggggaattcaccttgcccagccgtggaagtaatgaaaactacattctcttcaccaggtaattcttccaaaataatgtcatccatggacagaacagtagcctttaaacctcttgcagatgcccttgctgctagtctctttgccaagtttgcagcattaccaccgtcagaagcataatagacgtgtagcggtgggccggacaaaccctccaataactgatcgaaggcagccttgcttcttttttcttgtttccttgtcaacgcatcaccagcagattgctttagatttcttgacaaagatggatcttttctggttaatagggtaagcttattctcacggtctaagaagtcctgtaattgttttctgataaccgaagaatccaagctaaatgcctccttatctgttgatggatcgtcataaacaggattaaacctatacaatggccagtaaccagattcaacggcgtttttggtttcctttaagacttctaatggagtatcattttcggaattatacggcaaataagccaagacaatagaaggaccattgtatttagatgcctctattattgcagtcaatagttgggtgtaagaagcatatactgctacagaggcaacataggcactgtaataattcatggcgtacaaaccaacatctttctttctatcctggttttgctttctatggtcatatggctctgaatcaatcaataaaacattaatgtttttacgggaggataaaacctgttgaatacctgagtgacccaaatcataagaccaggcatcggagccaattagccagcttgatttgaaaataaaagaatcgcttgttggagctatctttaagaattttaagacagtagaggaatcttgattagattgtaataactgaaatatttccaaacctgtcgcattggcctcttgtaattgagcttcgtcaagatcgcgtccattgaatgacaaccatttagataatagttgaacaattttatttgcatcctcggacaagtaaagacttggatcaagagaggtttttgctaagctgatcaattcttcacgctgggcttcttgttttaaaaagcgtccaaaaccaaattctggattacttggttcaattgtctcactggaaaattgattcaaaatttgtagatttgatgaaaataactgttttagcactttgatataggcgtcttctaagttcacaacttttttgacagaagaaataagttgagtaacttcagcttgttcctcagccttttcattggattcacctaaaaataagttattatctggttccttcttgttaatattcgatatgacggtgttgataacgttgccataatcattcacattaccaatattagtcaacactacctgctcgatgttcctagaaactaattcattaaaattgccaaagaagtccaaaagaaatggttgaaattcgtttgattgcgatttcttagagacaccctgtaaaacggcgattttggtaacagaagatggcagtatttccaagaacttggaaaaattccatggtctgtatactctaatcttgatcaatcctacgtttgaaggcaatacgctactgaattccgcgtcatatggtgacaggttaacaatgacagtggtaattgactctttacctttaaccagttcaaaatttgtcaatgaatcagtagcttctgataatgctactttagtctcttcgttagcaatctccaaggtaggaaagtcgatgtcttgttcaatagctgtactcgtgccaattttctccaagttaagaaaatggaaaactggggtcagagaacttgtagcaatcttataagaagagtccgcgtttgaaattgcagtttgcaaatcagaagatattaagatggggaaagaaagatcctttaacgcaggaattgcggaataatcttgcaaattcaaatccactgtaatcaccaatggaagtttattaggaagagaatatagatggtggatggatttgaccaaagtagtttcatctgtaaaaacggtagttaaaatgtccttagagagttgatctttgatggtattcaatggatcttgattgttcaatagatgagtagcatctgtggcaacagattctagccctttgaaggatgaatgactattttttgtgctagtagtgtagaacactttattttggggagcactagaggaatattgcgccaacaattgtgggagcgtcaagaggtcagaagcagtcattcgccaatcttttgtttttctctggttcccgttccctactgttactttattagtatataagggatctgaataaatatcaagacgatggaaaaaaaataacaagcaaaggaacctttctatatcccaattttatttcacattaaaaactatcgtcttccaacactttatataactgcttgcagcggccagtaattcgtcgcatctccatgactcaaattttccagtgtctcttagcagttaaaccattcctgcctctgtgtggtggtaattgtggcattatgagttaagagataatacgcacgtgatgaaattcattctgtgaaatatcacgtggacaaattatattacccggattcataaatccacgtattttacctgcatctttattgagtgcttagtaaaagtcagttggtgaaattccgcagataaaacagcatattagttgcctgaaaatagccttatgtgttggtttgatacgtctttgtcattatatacccaaaggtttgtagttcatgttgcgggttggtatgaataaatttttcgtatttagtgattataatacttattacccatttcggcggctaataaggaatctgctaagataggtaaatgtacaataccatcaatggcttctaaaagttttcaaagaagtgggataagggatgaaagttgtgcgtgtgttggttacttaggttctaatttggcttcaatttgaagtgagatgttttgtttaacattagtttcaaattaacagcttttgtgagaaaatatattttggatgaatagcagaaaatagaaatctggaaataaacaaaacagagccaaaattctaagcttaataacatgaatatttgtttatctagcatcttgttcctcccactctttttccgaaaatatggctagccaacttaggtgaatggggaagggtactagattcattcatttatttctattcaaggacaagaacttttaacatagtaagacctttatgttagtttggtgcggctgacaaattcatagctaatgtgctagagctcttatattggtaattactaatccttcattgctattatgactatcacattataaggtaatgaaaaattaaatcattgtgtacggattaagtcctttctctaaaagagatcacgtgactatttgaatcactatctatgttaatcattattgtttaaaagatagtaagtgacagaacaacgaattgtttctgtaactactttttaagcagggaaataactcagcactgacaagggacactttttaaggatgttcgctaaattgcatgggaagaaacaaagaccaatttcttccatcaattcacaaactccaaggactagcaatactactcacgcaaatagcatatccttatcatcgggtaatttgatagtaggttccaatagaaatttaagacaaaagaaagagcagtttggttctcaacaaagggcttccggcagaaagctgatttcaaataaggaaaatgacgataacgtcaacaatggtggtgacaacaattatgacaatggggaacgggtccatcgccatcatattccaggactgaaaataaaggcgtatcaagctgaattaggctatcatgagtcccgattttccgagaatttagtgatgctaaatctagttgagttcccggatataaaacctggtgatttggtagaattgaaaacatatcacaaaaatccatctgcatcgaacggagataagaaaatttattttattgcaaaagattttgacggagagactaaaagaagggcaaaaacatctaatgtttcaatactttcgggtcaactgcaaactttgttagatttgccttctaggtctaggatatggataaaattgaaaccaaacaaatttgacttacaggcagatgtggtagagtttaatatcaaagattgcctactaaatagaggtgatatgtgggttctatcatctaagctggtagatacatgtgtgtttatggatcaaagactggcattcttagactctatcagaggtactattaagggaatttatcgaaatggtaagaagattgtttctggatatattggcgaacaaacaaggataatttttcggtccgaatctgccagattaatttttttgattcaaataactgatgaaatgtggaacttcgaagaaactggtgaacaattatttcaaaagatggttaattcatttttcccgaagatcttcaaaaaatggaaagatgtggacacccaccatactatcactatagccttcgctatatcaatggacttgtctgatacatcattcaaggacttaacacccggcgaatctttgaaaaattcacaggattattttaggatagttgtagatcaagtcagtattatccattgggttgatattatggaaacattaagagaagaatttatggaaatcagaaaagatttattaaacaagcaaacggataagggttacagtgtagcgaatggaagattttcacctgtaatcaagtcgaattttctcgaattggtcaattttgccacgacaattttaacggatcctttcaagcaattagatcttcgacacactacaacgcacgtcatgattatttcaccagggtctggattatttgacgttgattatagtttattaaggctaacaggaaaaaaactactctctcttgaaatgacgatggatttaatatgtctttcaaaagctccattgcacatagttccactttttaggtaccgagactttgagaacaagcttcatcattgtgtaccgctttggttaagtgttttcttttggaatgatcatgacaaaaagagtaactcagaatggactccaagatgtaaaatttatgacttacaaatgatggggattactgaaaatgagttaattcgggaagtggatgttgaatatttacagctgaacaagaaagtcaaatcactatccgagtttatgaatgattacgacaaaaatgccttcgaggtgaaaattttatgcgctggctctaatacgaaacaatctaagaaattaaattcaaagtttgataccgtcttcgagaatgatgttgttgtgaaggcaaggaaaatcccggcaacagcaacaacaacacacggtaacacaaaattcatatggagaggtccaaaagttgctctcccagccattaaggatattcaaaaaccaaacgtaataccagatctatcaataaaaacaatagaggcctctttttatgatgattgtaatactacaaatgataaaattagcactcccaccacttctaacaatgacaatctcgaaatgaatgactcattggtctctgtgagatctgctgataaccaaaacacatctttggcgctggattcgctcaaaggactaagcaaaaggaactcattgaaagattttactcaaagagtaattacaaaatttatttcgaacatagacacaagtaaaaataaaaaaataaagtcaacattactcagagatgatgtggataactcacctttaggttcaaatacaccactaccatcttctgaaagtaaaataagtggcctgaaattacaacaaaaaggcctggcagatgaaaacgttatcagtaaacgtggaaatttgataataaagaaaaacctatccatttttgggctacctagtaatgaaatcatgagtggttcaccctcctcatatttaggctcatcacataccagaacatcctctaaactttctaatatgtcagacaaggctgctttcattacagaagggcaaaaatcaaaacatgatgactcgaacacttatagcctcacacagcaattgaaacatcgtataagtgaaacttgggtggatattaaaagtccttccattccggtaagtagtgaatttgccaacgaattattgcctatacgttggaaagatgtatggccaaaatatgtggccagaaaatatagtaaatggaggtcttttacaaccccagcagagttaccaatcacaatttctgattttccatccaaggatgattttgataggaacttcatcttcagaaatcactcagtgactttaaacacagatcaagaacaatataatcagacatacaaagacttacttcgtgatatgatttatatgcgactgttaactggttttcaaatctgcgtgggccgacaagtagaaaaaatagaactttctagggaaagtggtgaaagtgaaactgtagtcaacaagtatttagatttcaatcaaaatgatgcgttcaaactttatctaatgatcgactctgaaatacacagaataacatgctcgtcaagtggaattattgatgtggagaggtatttgagaaaagatgaagcaaacttgtttgatcaggttcctagttatattccgttggttaaaacgagatacgagagctcatttcgtgatgctatgattgacccacttcatgttaaaagagaatctttgaactggaatcaaattgatcaggttctagcaggttatggcgataacttaatagataggaaatggcacggatttcgagctaaatatgtggtgttaccaacagatatccctcccaacacatattctatggttatcaatggtaaaagcgaaactttaaacccagaagaaatcagagtcgagggtttgagaagattaattggctcaataacgaggtcaagactaagaacagagaaagaaaaaaaaggaagaaaaactaagagagaagaaatacaacctgaagttatgttttacaccggcccgctttacaacttcattaatgagcaacaaacatctttagaaagctcggctataaattttaaagattcaatttttgttaatgataataaccttttaaacagaaatgtagaactatccaagttggcgtatcaaattcaacgtggcgaagatcgcattactttagtcaacagaaaatggcactggaaaaagcatgaaaagtgttttgttggctcggagatggttaattggctcataagaaacttctctgatatagatactcgagaagatgcaattaaatatgggcagaaggtgatgaaagagggattatttgttcacgttttaaataagcacaattttttggacgggcactacttttaccagttctcacctgaatacgtaatggacactaataaactagaaaaaacaaactcccatcgctctacattatccgatccaaagcagatgttgagaaaagcatccactggtagctcaaacgatccaagcgctatgactcctttttcttcagtagtacctgctataagcgcttcgaatgcttcagttgctgacgccaaagagccatcacgccctattttaatgctgagtaactctcttgttatcgatgttgatcccgcgggaaaatcctcgaaacaagaatcgtgtacagtccattatgacagagttcataaccccgaccactgttttcacataagattggaatggttgactaccaccccaaaattgatcgatgatttggttgggaactggtcaaggttatgcgaaaggtacggtttgaaaatgattgaaattccttgggaagaactttgtactatcccttcggtcaatccatttcactcttttgtggaaattaagttagctatcaatccttgggaagatcctgagttcaaggatagggagcttttcgctaaaagcaaattctactaccacgtttatcttttaaaggcatctgggtttttattagacaatagggcatccaaatttttacaaaatcaagatatagagtttgacatcatgtattcatggggcaaaccacagttcaaatatgttcaatatattcatcatacgggtgcttacgtcgcggaattgagggaaaatggctgcctatttttagctcctaacaacatttatatatccagagtgaatccgggaaacataatcgggaaaattcattctgcttcaagctcttcattagatgctcaaaaagtgatcctaaatttcaaatcaacttgcttggactatcagaagttaaggtcaattttccttgacgcaaaggaaatgtggattacaggaaagattgtagaagattgagtagccccatgacatggatgagtttcttcacaaagtaaataatattcgaacgtggatagtaaagcataatgttatctatttatatataaatatacctatgtttttatatgtctgtttactgatctaaagtctttgagcaatcttgataacatcacccaaaacaccagcggcagtaacggcagcaccggcaccggcaccttgaatgacaacaggattggtgtaacgcttagtcttgatggaaataacgttatctgatcccttcaatgatgcgaatgggtgtgagtaatcgtacttttcaattcctacagacacagatttggtggcaacatcgactttaccaatgaatctcaataccttattttcagtggcagcttccttcttcaattgagtcaaatctttatcgtaatcagataatttttccaagaattcatcagcagacttgacagattccaatggttttggaatcaaagactggacagggaaggaagttggagattcaacttccacaccagatatcctaccaacaatggtaacctttctagcaacatccaacccattcaaatcatctcttggatctggttcagtataacccaattttttagcaactttgacaacatcagagaatttgacgtcgttagcttgactagtggagaactcgttgaaaatataagatagagtaccagagaagataccttcaattttttcaacttcgtcaccggtttgaataatttctcttaagaaactgatgataggcaaaccagcaccgacggtagcttcatgatagacaaaaccgttagttggcttatttgagaaaagagccttccaggtagccaaatcagaggaaaaggccttcttgtttggagtagcaatggaaataccattttcgacaaacttagtgtaaaaaccagcaatgtaagcgctggaagtgttatcaaccaaaatgactggcttaggtgaagtcttcaaatgagcaattaaatcatccaaaggcaacgttttagtagtggaggctgctaaagcagccttccaatcagaaccaacatttaatggagaaaagtccttggagattaaagaacgctcagcttcagccaaaagaactagattgtaagtaatggtagacttcatggctaacaattgatccaagaaagctgaaccaacaacaccggcaccgataacggcaacattaacaactttagtgctcattttttttttattattcgattgatgatactatctacgttcttaaaacagtcctgagtacacacacagaagatttagcttcaacaaattgtctatcgctaaccgcaatatttacatattctttatacatttctgttccattcaacccaactttaccaccagggcacacttcttccaaaatatggtcatcaacacacccgtacaccaccatgtgcgttattgaaaaactcacgtgatcttatccactaatagcctcactctatcgaagacttccttctttgtaacacgtttcttaattgcacttggcttagaagtagggtctggagtgctttttgatgtcacagaacctgatgacggtagtgctggattgttttcatcgttcacgtctgtgagggattgatcctgtcgagctagaggaaaatagagatactcgaaataaatgcccaagcaaacgctgtcaaatgcaattccgctatgtccctttttcaactggaaagcaagttttaacccggatgatatttcttcagggtactttccttggtcgaaaacttggttcagttgctcactaatcttcaggaattcttggtagttcaaggttggaaggatttgctccacgtagctcttgtcttgcaattgcagcttgattttggcactttgcgtgtacacattaatggcacgctctaatagttcgtttacgttcacagttccagaaccaaatcgccttagcttttttataacaagacctgttgtattgaagtcttttattgcgaagagtaaatccaaatacaaaaccaggtactggtaagtatagatgaaatgtttccctggcctttcaaaatctggtttccatatattgaccaagtttttgtttatactttttgcggatattaagctatccatctcctccaaagcaccgttcacatcacccaaatcgtcaaacaatatgcgcgctattctgtaacgaggtctgtgctgccatttttttttatcaacagatagtaaatggcgaagtagtcttatgattttgtcaaaaaagaatttttcttgataatcccatgcaagaccttcgtcgttgacccaaaattcctcttgttcctggaagaattggttatctttagacagtaaggtcagagcttcgttaacacctatgacgcctctttttacccacttgtaacaagcattaactaacagataatggggttctatgatcggatctttagcaggtgatgactcataagctatttggcaaccctgagtaatatatttggcaactaatttacaattattaccaccatctgttttgaaaaagaacttggccagattgtaaaaactagaccaattcaacacgaatacatcgtcctgtgacttgatatcgccggataaagaacaagccctattaaaacataaaaatatactttgctcgatgttaaagtctgagattgtggtgattttcttagttttttccattactacttcaccggtttcagacaatctcattgtattctcagcactgcttttccagctaaaacaaagcttattcatgggattatagtagccgctaatcagcatagatcctaagtcatccaatgcctccaatataatctttttatcgtcaatagttcgatccaacttactataataaatggaaatggccattaaataacacaatattgcctttctttgagtcaaagcaataacatcttttttctcagggacagtgatcttatctgaggtccatattaaatcatcttcaacaatataactgtaacactttccgagtaatatccaactttcgaaacggtttgtgttgtatataatgtcattctttaacattctgataatggagtctaattcagaaggtcttgcttgcatagacttctttctcattttatacaaacccagggactgtaagctggatacgtagaacaagccggctgtcatgccttgctgtaactcgtcgtttggagaagttaaatacaaacttgttgcaccagaaaatgtatgcttcaacaagtctgccgttattggccttgataaatattcatttaatagaaatgagtttctagatatgatatgattgtccagcgttgatgggtcgccaattttttctataatattatccattatctgttttagggtggtctttgacgacgacaggtaagggttcttattttgatactgtaatttgattagatatgtacctaaaggcaaagagtgtatcttttccatctctaccgcttttgtatcatgcagatcaggactgaagttatcactagctatcgcgtagtgatatctacaccacagtatttgcttcaattgtaaaaaagaatcattattaatgaactggcacaatagtttttcagctaaatctaggaactttccatttgatgcatcacaaaaatggaaatgtccaaaaagagtgtgtaaggaccaaattagttccgttgtttcaataccttgttcagcaggtgtcctgagctttgcttgtaaatcataataataaagtatcaacgtcgctaaatctatcattatatccttcattttccctgatgatttcgatgctcttttgaaaaaagacttattagaaacgtcgttaaccgcagagctttcatagaaaaggacagtataaaagaagaagaatgtttgcagcagcttttcaaacatatagtcctccaagacaaaatcgctgctttcccacctatttgaatttagtatcgctgtcagttggcttgagagatagccaattgctgtcaacactgttaataacatttggtgccttccgtgtgggttcgattctttgtagacaggtgacgtcaatgcgcccttcataaaatcaagtacgtggaaataaattctttgaacatcctgtatactggattttttgacatatgacgaaaagagaacgccccaaagtctaattttcaataaaaatggtgagttgaaaataaaggaaaccatctcctcatcaatatttgaatgattagtcgaagggtgtaatatatgtaaaaggactttttctagtgtctctagatgattttctgaatgagtgtcagagttcgtgtcttcagatatatcttcgactgttatgttttgtattattcttattttccttttctgggattgaactgtgtttaggtttagtgccggtatatgacggtaattcggataggcaatgtctaaagaagaatctgaatcctttatagtattttctaaagacgtcaaagtttcagagagtctgctatcgactatatcacatgtatattgcaagaagcagtaatgcgtccattgaaaatgtacatacagttctttatctttttcgtcagcaatttgttctaacagagtatgccacgaccttattcttttctcgactttatttctttgactttttaggtctgctgacttatgtccttgaatccgtttatttgtgatttcctccacaatattccctaaatggttaacaagaagttcgtaaatcgataaagccaaatatttgcattgccttttgtttttgttaataagtgcaaaaatgttcgattcgattccaaatacaaaccataaaacaatttttagaagctgagactcccaaaggtagtctataatgagacgccttccgtttccttcatcgtaagttccaagcaatttgaataataatttcaaacgcacttgatggaagtgaagattgcctgcattcacttcggaaataaaagatctgatgtgatccgagtccaaatcatttaaatatctaggaaagctctccttatcatcaaatgcattagatttcaggagcgcatttagttggaataattcctcattttcgttagaaccactggacaagtagtcattttggttaaaaatatcagtatatctactactccaagatttcaaacattcatagagatcagtatagggaataaatttttcgggttgtttgtcactagagccaatgataaatttggaagcaaatgtgtcaaaatcgcaaaagggtagaatgtgaatatatgacaacaacgtgttgaactcaccaaaaaatcttttatgaacgtccataacaagctcttttgagttttcttgttctctttctttaaagcgtttactacttctttgaagaggcttcgtgctatcgatatgttcatcagttctcttgttaggccttgcttcttcattagtttggatatccgatggagctaaattcccactcttatcatctgctcgtacactctcattatcttgctcttcttcttgtcgctcagactctctatctaaagatggtgtattattaattgcttccgatagttcaaacttaaccgcttcaataggttcttcaatttcgttatacggatccatattccttccaataagagacgatgttttaacgctgggtagtaagtttttcaaagccttcgcaacttcatcccatgattcttcattcaaagtgacattaaacacgtccagctttttcattatttcctcatcttgctttttcatttctgatattctagaaagaattggaccaaaagctagtggttccggcttaatatctttgtacttctccaaatgatatctctcaaagattgtgttatccgataagttggggactaatagtttgttcgtgagttctacgtagttattcatcatcagagtcaaatcgttcaaaagaaatttacgatgtcgccccaacaaaagtgaaagattttcctgcttagtgaattcatattctgatattaaacgttccaacttgacactattaaagctcttgaagatgcgagccagcaaatctgtaactgcaaaatcagcatcgctatgttgaatagactcaaccaagttctcaactgcttttaaaatacaattaactagttcttgtgagttcaacctttcatagttattctccaaatacagatgatagtacatccctctgttcctataacatagatatcgcaggttatctagcgtaggagaagaattgcgatacatgccccacctatcaggcttgacgacatcaatctggaagagctcttggaatttgctgtccgacttttcgaagtccttgttttttagatcaatcagagcgtcctgcaaaatattaaaactctgttctatttgaagctctcttgaatgctcctctgcttcatattgttcaccttcgatgtttgaattgagggcattgaacatagacataataagctttatctagaatctgtgttgaggttctaactccttaaagtgcctttacggacctgccttgctaccgtctatttgtatttctgctcttcccaacgtaaacaattcaataaataatttcgcgatggcacatagtaacaagctgttaaatcgaagtaaagaaaaggaaagtcaagaaaacaaagagagaaacaaatgcaagggtgatggttcaatatgtggtagaatggttaccaaggatacagagcatttcagtggtagtagaaggttggaagcaggtggagataaagaacttgaaggacacactcatgagcatatctggtgatgaagaacaagttgaagatattttacttccagtagaagttgaagaaaaagtagacgcttcttacaagttcaaaaacagaggtaaagacttagaatggatgacgaagttaagaagcaaatcctctaagatatatgacagttctatcatgtcgcttccagatggaagatggactaaagaagagcttcgctcagattctgatttctcgatagaatgtcttaactgtaagcaaaaaattataagcaaagataactgtcaagttttgaatgatatgccttcagagttttggttcgagttaatggattattggcattgccacaaacccgatgttaaggaagacaagtcttcctacacaagatttgaaacgctaaaaccatctaaaaacgaaattttaattggaagctcttattttcaaggcactcctgcgacttttgaaaatgtagcgactacaaaggaaaatgataatgttttatgcataaagtgctcagcagtgttaggccaagtaactgctggttcgctttataaactacacaaatggaaactgcagttaatacgcagtggaaacacatacaaatttcctccagaatgtgacattacaatttctttaataaacgtagttaaggcaaactcttgtcgttacgtactagtaaaatgtaaaacggaatcattgctagtttggatattttccgttgacattggagtcacattgacgggaaacaaaagcttcaagagagcgatgaagttgctttacacaaacagcgttaccacaataaatcgatgtctcaatcgacaagtcgtcgaggaattagatttccaagaaacatcgtttaatgctttttacagcgcccttcaacatactaatgcacttttaccctcaagcatgaaaaaaattggtgaatggaccattagctatacatcactaatctaattttaagaaccattctctttcaaatttgtacaaatattgtcatcaagtaataaatagcttctttttttttttaacatacagttgtagaattaacttcgttggccgaagaattgcacaacaatagcgtttgttatattactaaatataggggctttcttgggaacgaaagtgaaacaaacgcttttaatacaatgaaggtcgagaaatcatctaaaggcttggaagttttagtgaggacacaggaggatgatctagaggggttctctttcctggagattatggaccgcgtagaccctttaccattagacttcgagaattacaaaaatttcaaagagggcatttactatatgtgtacacacgatggcacaaagatcggtttcgtgttgaaatttgcgataaatgaaatggagactgtttgctcggaaatcttcgaagaaaccttccaattagatgaatctagacatgagttaaggtttaaaagtgaagattttgatcatagaaacaatctaattgaccaattggctcgtaaaatgtatttagaatcatccttgagtggtgtgaagggctggagaaacgagaaatatgccgtttgggttaataaaaaaccctatgtactggttgagcgtgcagtagcaggtgttcttggtataattacctacgggattcatattaatggttatgtgctagatccaaagtcaaaaaaagttcagttttgggttccaagaagatctaaaacgaaacaaacatggccgctaatgcttgacaacattatcgccgggggattaggttatccttatggtatctatgaaacagttttgaaagaaagcatggaggaagccaatctagaaaagagtgttattgaggataacattaaagcaactggttcagtttcctacctttactttacgggtgatatttctgtaacgaagttcaataaggaatcagattttatcgtaggggaagtacaatatgtatacgatctaaaactcagcgaagacatcattccaaaaccaaacgatggtgaagtcgagagtttcaatttattcagcctgcaagagacgattaatgctttaagaaaaaaagagttcaaaccaaattgtgcattggtaatggtagatttcttgattagacatggctacatcactccagaaaatgagcccaattatcttgaactagtaactagaatgcacagaaggttaccattccccaccttgaattaacattcaagaggttaccggttgatatctaaacaaatataaagaatttttttcatatatacacatctaggtacatactatctaagatcaaaagtactctattttgtcactaaacggaggaaggcgttcagttcgtttgtggttagtgaacagaaaaagttacttggagaaatttaattctatgtcaaaccactctctagaaacaacttccgatggtgacaagctgacatctccatacactagtggtgaaaagtatacaaaaaaccacgcaacagcacaggagacacacaccaagaagacggtatagggtttaacgtagaccttagggttccgttcatatgatgcacctgaaatatcctcgtctttctccaaatccaatgatttgcaatcactgaaaattacttcccatagtgctcctgagaataagcacgcgattaaatgagctggtaagtaatgatgcaaaaacttttgacgcgccattaaaaagaatggaaaataatgacagcaccaggagacgaagaaaaacatcaatgggccatacagcttttctctggtcatcttgtttagggcataatagccacgatgtctagtaattaaatcggccacgataatgccaacaaaaacagccaatgatatgacttggaaccaccacccaatgatgttaccaatgaaatatatttgcttcttttcgtcaccgttggtccagaacgaaacaccacttaaactaccgggccaactgtaaggttcagaggcaaatggatgctctgatgatagtttattgttatgttcgaacatagatttttgagtttcaatccatttcttcaagaatggtaatggcttaacaaccttcggaatatataccttccgaacctcgtccaggttaacaatttcatcaacaacccagttatttgaaggatcaataacttttttgttaccattaatttcttgttgttggaacccccaatccggtaacaactcgtcgttgtgagtccacaaagctacggaggtatcaacgtggaaaagacggaaagaaaccgttttactctttaaaacgtgaccttcatctgattttttcagtggttggaatgcaaaaagtgtttcaggatataattccccatcaccttcttctaaagttactgtagtgatttcttcattggtagggtaaaatggggaggcgacatcatgggctaacaagtaggtatcggtggctacatgtctcaatcttatatgctggttcaatagaacagcttgtcctttaccgacatcactgccatggggtggtaacacttcccattgattgttgaagtcaggatgcgtgtaaccagtaacttgttgaccagcggatgagatacgaccatcttcataccgttgtgggtaacgtgccaagtgagaatgtaagaatgcgtcagtatcttgatgtttgatagtgataatatcaaaataattgacggttttagagtcaacacttaagggagagtccttaagtgtttcttgaaattcagcagacataaatgcgtcgccaggacctgaagtattcaaaacggtgaaatgaacccagaaccaaaacaagtaaatcacaaatggaatcaaaactaaaccattcagccttttactaaaatgtctcatgaactgcctcaaggacaaacccgccttgatgtccagtaattgccataagttgaccacagcagcaaaaccaatagcggaatatgtcataacaccaacatattttgtggaaatcacgaaggataaagacaaaccagtagcgtgtaaccaaatataccaactccatgtaaaaggttgacgcaattggcacttgtagaaacgaacgtaacaatacatagtagcagcaatagaaataatcaagatggcatccagtaaaatcagcctagtttctgtaacatgcgcagtatcgattgcaaccaagagagatgcaaacgcacatgtaatagccctgaaattcagttccttcaaagtgttgaacataattggtacagtcaatgtgcccaatatcgcgttgaaagaacggtacgcgatatatggagctggatgagtttcataagaatacccaatctcatcaaacttaaaggaaccatcatagccacataaccaaccaatgaaggcaatcatcatcttagcaaaagggggatgaacgtcaaagaaataagacctttctaagtaatacgatgcaaatttcccgaaatgtacctcatcaaaaacaacttcttttggataccagatcttataaaatctagcagcaaacgctaataaggtaacaattgttacccaaaagctataacgtgattccggttccggtagtggctgcaagagccaatgttcagcaacttgttcacatttaggcgcggccttcgtgtacttcaacgaaggatcgtctacgtccttagtggaaggtggtaacttcccatggttacgttttttgggcacagacatctgtacttctgtggactgtcagaaaatatcttggtaaaatatgtatcgacaaacttcttagtacagttaatatagaagtaaggattcgagtgagtagttttgataaagcgcgtttcattatgcatatttttcattttttattttttttgtcaagaaatacacgaataacatcacgaaatttatcgacagaataatggaagaaactatttaaaaagacggtagagactaaaaaaggaaagaaaggacaagtaggaagatcagcgtacgatgaaaagcattttcaaggttagaggatgtgtatcgcatgctgctcaattttgccaaaaaagaaccgtggtgagtaccggcactagtaacaccgcaacagccggtgcagtgaggaaaagtttcaacagtaccgaaaccaagcctgtatttgcaacaaaatcggaagctggcaatggaagccacatgaaggaatattcaagcggcattaactctaaactcggcgggacccctttggaaacccgcagcaccgccgatgattctttgaacaatagttataagcaagtcaagggagacattgactggtatacttcatggtatggcctaggtatgaagccctttgaagcaaaagtgcaaaaggatctaatcgagcctctggaccctaaggatatagaaatcaagccagatggtttgatatacttgcctgaaattaaataccgtagaatactgaacaaagcttttggcgcaggcggttgggggctagtgccaagatcacaaacaatagtgacatccaagctggtcactagggagtacggtcttatttgccatggtcaattgatcagtgtggcaagaggcgaacaagactatttcaacgaagccggcataccaactgctacagaaggttgcaaaagtaatgcattaatgaggtgttgcaaagatctcggcgtcggttctgaattatgggaccctgttttcataaagaaattcaaagtggatcattgtactgagaagtttgtggaacatgttaccaccaagagaaagaagaaaatttggttaagaaaggacagacaagttgaatatccttataaatagtcaatatgcgaaccatataagctaattttagtaagtatatatattccaatacaatcacacacacacacacacacacacacacacacacatacgcatatattgtggtagtgcgtagtgtcagtacgtcttatcatacgccttctatttcagggttagcgtatttttactatcaatattacaatacggatatatatacacacacctaatatatatattatacgttatattactgccagtcgaaaaaggaagatacgatgtattattttaaaattcaatttctaataaacattaatggagatatacaaaagaagaaaataattaagttgttatgaaatttataaaccttgttgagctcttcttctgtcacgttcttcagcaatagacaacttgatacccttaccctttggcaaagaaatgtaaggcttaccttgttcaccgatgacgaagacattgttcaatctagtgacgaaagtgttgtccaaggagtccttgatgtgaactaaatcgaaaccaccatcgtgtctttccttgtgaacgatagtaccgatacgacccaagttacgaccaccagtaacgtaaaccaacttaccggcatcgaacttgatgaaatcagtaatcttaccagaggccaagtcgatcttaacagtgtcattgaccttgatgtttgggtctgggtatctgatagttctaccatcgtgggtaacaacgtatggaacacccttcttacctaattgaaccttcttgaccttacccaacttgtaagaagcttcttcatcggtgatacggtggacagcgaatctacccttgacatcgtagaccaatctgaagttttcattggtggcatctagagtgatgacatccatgaaaccagctgggtaggtagtgtcggttctaaccttaccgtccactttaacgtgacgttgcatcaagatagccttgacttcacggccgttcaaagcatactttaatctgtttcttagaaagacaatcaatggcaaggattcacgcaatttgtgtggaccagcagatggtcttggggcgtaacaaccggacaacttgtccaataaccagtggtgtggagctgctaatctttttagatgcttctttctgtacggaaaaaaatgagaaaaaagggcaaaaatgaatgtataatgaagatacagacattttatttttttcattgtgctcgttagtaaatcattactcgtaaaatatttgtacaatcccaggatgatctaaaattaaatggacataaactggttcattgttgttcctattcgtttggttaagactccacttgtttcttgtctatcattcttctcatccttgcgtaattataatcaaagtctatagtcaaacatacggtcctctagccatctttgcgtattgattctttggtttgttttgggcagaaaaatcgctatataagaaagtatttcaacactagattaaattatagtataatttttaatatactagtattgccgacaatctctgaaatttcaatactaccacacagaacaggacttgccagggccagtccgagccagcctaactccaagaccacgtactaagtgaattgctactcccccttaccacgactacaaagagctacacggcctcccggcctaggccgctgctactttcaactgatgtcaccgaaaaaaataacggaaaacgacagttcaagaaaaaaagaacgcaggaagaaaaaggaagcaaaattacagaatgtacggctgtttaaaaataaatagtggatgcatgggtgcttccacgcgtctctgggaaaaaaaaccaggatattttaatgtttgtttatttgtttatttcctgctgaactgaatattgaaaacatcgaaaaaatgcagtacccagctctccattaggactttttacgtaatgacgaaaatggacaagctgcgcaggaaaggactacgaaaagtatgctgccataatgacaagataaggcgcaacacacgtaatcatgactaatggttgcacagacggtaggccaggagaaggattagatctcgtgccgaacgacagcaagctagctagactatgttatctgagtgtaaacgaaagcgcagcagtctctgcaagagcacgtgcgacgtgtctggtgtgcaaaaaccctctagagaaacattgctaaggtttaccgatgcaggaaatctttagttctaaaagatgaaagtcggaaaagccaaaaagaaaccggaaatcttctctgcgcattgttctgtggccacggccttcctggacccgtccttcttttacccgaactttgtcgcccaaaaggcatctcattataatgacaaaactggatctgcaaatatttggacatatatctccagaacgggctcacttctcctcttcacccaggtggtatataggaagagtaagtggacgcatcagtccgcgacatttgcggactgtatatattgccagtcagggcagtcgccaagtgtgtctctttcgtgtagcgacgcacgtcagacatggatgcaacatcgaggatggagcagcctgatgtctttgtaagcaaactctaccacctgctgcaggggaacgcttactcgaacataatacaatggtcgactgatggcagcaagctcgtcatttggaatccggaccagttcaccaaagtcatcctagagcgattttttggtattcacacctttgcagcattcgttaagcaattgagcaaatataacttccagaaggcgggccgcccggactgcgtggagttttccaacattcattttcaaaaagataacattaatagcctctcactggttaaagctcatcagtctgccgccactcccaatgtcgccgccgtcaataatatgaataagcagtgtacttttcactgggaccctttcaaagtgaactccattctaagcaaggccatcggcaagccttccttcgagaaattagtgaaaaatgttgacaggcttcagggcaatcttgatgagcttaagtcgacaaacgcagatagtctgcgtattataagggaaattaacgccagcttacagacaatctcctaccaccagtttcacgcctaccaaaccgctaacttccttcaagaaaattttgaagccatcaaaaaggttgtatgcccggactcttgtctacaacaccagcaacgccaaccaaagcgccccaaacgctactcgttgctgttactaataccaaacgcatccgaattgtcagaaacacctttgatgcgcttcgccggcgtgttcgaatttatgaactgctctttggatacggccactcagtggcacccgcagttgcatcccgaggcatacgaccttcttttcgtcaccgtgtcgcccaacatgcaacaagaacatctcatctacttcaagagactgagaaacctactcccaagctttcctgtaatagccattattaacagacccgtctcccctcaagataccagcattgctccctccaactactctcgctattatttccaccattttttgcagttggggttcagtgacatcctagttagccccttcaccccaacacaacttataacgctcctttccaaacatcttcgaacgtgaaaacctgcctctgagggtcattcacgacctagcataccactatatacgtgtacgattttttttttctgtgaccgcactacaccaaagtttaatgttccattggccccggaaccattcttgcaaacggcgttctttttccgctttcgggtgacacttaatttagcttcttttccctctctgacacctcttgttatctaatctgtagatccgactctttttctttttggtgtcgttcttctatgtccgtttttctgtcaacaaaaacggaaataataggtagaaattaagagccgtacgtgagtgagaggagatccgaaatgagctgacagtataactaatataagcttacaagatattcgactatttcctgggaaaaaattcattcctttgagaaatccttaataaaaacagactaactactaaaattttagaaatttaagggaaagcatctccacgagttttaagaacgatatgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactgaagtatcgctattgctacgtaaagtaattaaaagttaaaaagaataaaactagagcgttttttctactgagttaaggggtcatgtcagaatataacataccctttgacattgtatatatgaattcctggattttgcagtgatctgataaaaaatgtatgtcgaaacctgcaattatcctttcgttttttttcttgtcatctagtgctggcctatcggtatcaaggacatcttttgcgcggatagaaaagggcccatacataccttagaagcaactcaagacaattcatgtactttttaaaccaactaatatttcaagacgtttccgtaatgtcggtggataaaagagaagatatgagcagatctttccaaaaatgtttaaacttgagataccctatcatccaggcccctatggcgggggtcacgactattgaaatggccgctaaggcttgtattgcgggcgccatagcttcactacccctatcccacttagacttcagaaaggtcaatgatattgaaaagcttaaactgatggtttcacaattcagagatcaagtagccgatgaatctttagagggcaatctcaacctaaactttttttgccatgatatcgttgataaaccgaccgatcttcaaacagctaactgggcgaagctatacagaaagtctatgaatgtgccgattgatatgaatgagattaaattcgataatggtaatgtatcttttaaggcatttgaaaaagaaaatgctcttcaagattttttccagtacctatcagatggctttaggcctaaaatcattagtttccattttggccatccgtcgaaatctacaatagaatatttacaaaaaattggaattctaatttttgtgactgccacctctgtaagagaagttcgattgttagcacgtctcggcattaatggcatagtgtgtcaaggctatgaagcgggaggacatagaggaaatttcttagtaaatgaccccaaagatgatgaaaacttatcaactgtacaattggtgaaaagaacagttgatgaacttgctgaaatgaaaaataaaggtcttatacatgctactccctttgtcattgcagcaggtggtataatggattccaaagatatatcatacatgttatcacagcaagcagacgctgttcaagtggggactgcttttcttggttgcagtgaatccaatgcatcaaaaaacttttcaagccccttcactcgagaaacaacaactaaaatggttaatataatatcaggaaagcctgcaaggaccatctctactccttttatcgaaaaagtcattgctaattttcaaggtgaggagcttcctccatatggctacatgtatagtgctttcaagcaagtaagaaaaaagtatccagaattggctaactttattttagctggacaaggatttcagaatgtccaatcaggaatcacaacagacaagaaaattgaaactatgggcgcaagattgaaaattgtcggaaaataatataaatacatataaaagacctgatacttattgacacaaattttctggatgacctttttctatatgatatataaacgtcgctattggatcgtaggttacttggccattatttgagcgtaaccgttcacaggatgtgggctttaaggaatacaaaatccaaatatggaaaaaatttgatatcaatttagggctttaatatctaaaggtatttatttttttcacagttttttttctgttaagctgtctgcaataaggaatgctcctgacatgaaattcgaaaaggaccggaaatagttggagcacaagactgcaaactaaaaaacaaatttctttggaatttccttacgcttatagtatatatcttataaatattaaaattaagagaattcaattattttacatcatttatacaactgtacagggccgcacatgatcactataacaatagagcggcggcaccagcaatagcagcggcaccgaaaacaccgttattgaacttgttagcaccgttagtggtaacgtcaataacacgagatgctgacgatgtgacagaagtagctgtagattgagctttggaggagactggcttagtcacagttgaacagacgttatttgaacaactagttatggtagtttcaacagtggaagcttgagtctttgtgacggtgctgtcagtaccattttggaccactggagtgactgagatagaagatgtagaagaaactggagctgtggtattggcaaaactagcagagcttgcaacagagcttgcaacagagcttgcaacagaactttcagcagaacttgcaatggtgcttgcagcagagctagattcagatgaaacagtagcttgggtggaagcagcgtttgagctggtctctgctgaactttcagaggagctagaagactcagtggcggcactagaagcttctgaagtggaggtggaagaagcctctgtggtagaagctggtactgcagtagcaatacctccattcgcaagtgcttcggaaatagcacccatcaatctagtagagtaccatggcacaccggtgatcattctggtcacttcatcacctgaaataccagtcaacatggtggtgaaatcgccaccggcaaaaacagccttggcaatttcaggtgggtatgtttcagtcttatgcaaagcctggaaagcgtaatattcagataaatgggcgccaatatcagaaacgtaaacagccaattcaatcaaattgaccctttcatcataaggggatagagtggtggtcacggatgcggcggttgcacttgccactaatgctgcggcgacagctaatatactaattctagacattacttggggtatatatttagtatgctacacttttatctgaaaaagaagaaatagtaccgtgtcgacataaaaatagtatcatttagtcgtgctattttatacgcagtattttcaatcatttctattcaatgagtacccagggacccttttgcatttctagcattctctgttcctgaacgatgttttgttagaggcctcgtatagatcttggcattttcaaaggcacgcgttgtattgttttattgcctatcaaaggaacgcgcaggaaacatgaaacttttcagaggagcgtctacggaggatacattcatcaatttttcctcataaattaaacgatgtgtacaaaaaggacgaattgaccccgtcgttcggcgaaaccttatgtattttcctggccatatgtgctaaacgacagataaaataggaaattctccccattttcgactaataagataagcgggagatagcatcatatgaacttttgcactcaaacgaagaaagcacgtgaggattgaagaaaacggatcgccgaatccagcgtgaattgagctcaacaatttttaactatatcaatctctttcactttaaacactaccacttaaatctttttaaaacgctttgcccaatgaccctttttttattaaggttgctgagctattttttctatactattgtcaaactccaaagatattttgagctttattttcttgcaaacaaaataccctactgcttaataaatgcaatgtatacatagttttcaaggtacattatattttaaagttacctcaggcctgtttgcccttgcattctacagtccctttgtaagggtgtgagacaaaaggcctcgttagctacgactgttgaaatcgtttgaattcggcttacaatctaactttgactgcgcaattgttcatgaatttatagtgtgcttgcgaggggcaacttcatacgaaggcttgtaggacccctaagtgcatccataaacatgctcaaagattgtcttagaaaccacaaggagaacgcacagtatgaattaaataagttgcgctctgctagaatattttgacgattacaaagtcagagatcgaaacatttccgctgtgcaactaagtaattttcccaatctttggagaaaatcaataatcacaagattagtacttatcctcttgtaggcttctctctttcgctataaatagagcagaaaaatatgatacagaaggtcgaaagtttgcttcgctgactgaagctttctgtcaagagttgacaaaaacatacaagattcagtattgataataaatggcctgcacttaagactcaaccatcccaataagttacctagttgtgttacctaagctaggaaaatacacattgaaagatgttttacaaagtattgtaaaggtacaatgcattctaggccgaatgttcatttcggattgtaatatgtagtcaacgataacgaacctcatggttatggttatttctgttccaaatttgcaaaatagatcttcattgtcgttgtcggaacgggtggtttataattttagtaaccatagtaactgaataaagtgaccaaacagtatacttcatagctccaggctaggaaacaagatactactgcgaaactagcggaagaagttacgttaaagatctattaattcaatgttaattcaaatttaatatacgtagggatgcgagttattacattggaaatatagcaaatcactgaaataccatcattttgaatacattcgtcatcgccgcatcagttatacgtttctgctataccgtataagaatacttgcttctattcttagttatactgaattttagacattaataaactactaacggttgctactacactacactattcttctaccaatgtcgatgagagcgaactcttcagaaagcagtttacttgaataaattttttcaaaggccctcatttctaatgccttgtgacctagaatttagcagcgtcaactttatggagcgttatttctcaattccatctttgtgccgcgtagttctatcttacataactttattttaagaagagctttagttcatgttcttggaagaattccttttttgacacgatttttaacctaaaggctaaattttatttaaactaacagtgaacaaagtatttaaagcttcatatgtgagttgtcgaacacgtcaataaacggaggtaataaaatgaaggatgagggaaaaaaaaaaccataattttaggctgaagcccatattgtgatatttttaatgttttcttagaaaaattaaaaaacttctcaattaaatgtaaaattttacttgttggcgataccttagaggattcaaatttaactagtgttaatatacgaactggtaacactaatgtttagatacctgtatatcatacaaaccattcaaagtgtataggagtatgttcacaaaccgtagtattatgtgctacatgaatcaagtatagatttaaaatttctttcaagtcaatttaaattattttacaattgtttatatgcttgtgaagattatattgtatcactatagcagtaataaagcgacaacagcaacgatagcggtaccaaaaatgttatctttatcgaaattataggcaccgttggtattgatactgacagtataagaagcagatgaatgagcaatggaagtagccgaggaggcttttggaattggtgagatgactttgctggtagcggtcgcgattggtgcagttaacatggtacaggttccacctgagcagttggtcacagtagtttgagtgatagacaatccggttctggtaaacatgctaatccctgcatcgacagtagtcagggtggtacaggcacccgcagagcaactgactttaatcgctttggggatggtcgactctgcattgttcgatgtagtggctttggagttgaaactactaaccggagacatcagcgtggtgcaaataccacccgaacaactagtaatagtagtttccatagttagcaactcggttttagtagaggcgacatcttcttcattatcttcgcaactaatggtagcggtggtagttgcttcgctggtgattgtagtaactggaacagtcagggtcgagcaaacaccaccagagcatgttgttatagttgtttcgaccgtggaagtttctgtagttgttaatgtgttcgccttagcattaatagtagtaaccggagacatcagcgtggtacaaataccacccgaacaactagttatagtagtttccaaagttagcaactcggtttcagtagaagtgatatcttcttcattatcttcgcaactaatggtagcggtggtagtggcttcgctggtgattgtagtaactggaacagtcagggtcgagcaaacaccaccagggcatgttgttatagttgtttcgaccgtggaagtttctgtagttgttaatgtgttcgccttagcattaatagtagtaaccggagacatcagcgtggtacaaataccacccgaacaactagttatagtagtttcaacggtagaaacttgagttttcgtcaaaacactatcttcattagtacaactactcttacagctcgtgatgacaatttcatctgttgataggtttgtaaatgttgaggttgcattacgaacattttctatcgtgctgaacagaccgctactgatggtgttggaacttctggcatcactgcaattacttcttgaggatactaagagaggggaacttgatgcaaaagatgcgactgacgatgtaggttccatagaaaatgaagagacgatcgattgggaaacagtgaaagtacttaaagtgaaacttgacatatttgatgacgaaagatataaggaagaagtccgctcagcaatgaagctagtggatgtagacgtaattgcagtagacgactctggagaggaactgatttcactgaagggaatattaggagaaactgaatcggtagagctagtgaccacagttgaagaaacagcaagtggagtggaaggcgtagcaaaaaaggtagtagattgggtagaggagttaccagagacatcagatttagcagaaacagtggatctggtaaagaaatcagcagccttgctcgaggaaacaacggctgaagtgaaagtggatgtcgcagatagactttcagtagaagaaatggattcatcagaagaaggtccaaccaaagaagtgggttcaactgatgaactgatcccgcttgaagtaagtacttcaatggaagaaggaatctcagaagaggaagtaattacactagaaactattagttcactggaaatggtgatttgattagaggagatagattctgcggaagtggttgctttactgaaagagagaggttcagcagaagaggtgatttcactgaaagtagacccgaaggaagaaacaggttctgtcgtggtcacttgactagacctgataggttcaacagaagaggtgacttcacttacagtagtaggttcagcggatgaagtgacttgactagacctgataggttcaacagaagaggtgaattcactgacagtagtaggttcagcggatgaagtgacttgactagacctggtaggttcaacagaagaggtgaattcactgacagtagtaggttcagcggatgaagtgacttgactagacctggtaggttcaacagaagaggtgaattcactgacagtagtaggttcagcggatgaagtgacttgactagacctggtaggttcaacagaagaggtgaattcactgacagtagtaggttcagcggatgaagtgacttgactagacctggtaggttcaacagaagaggtgaattcactgacagtagtaggttcagcggatgaagtgacttgactagacctggtaggttcaacagaagaggtgacttcactgacagtagtaggctcagcggatgaagtgacttggctgggactacttgaactgatatatgtatcgctcgtagtagtagtagttgcagaagtagtgaatgcgttagttgttgagacactagaggttgtatggtcagtagaagccgtagatgtggcaggtgtagtaagactggcaaaagtggtagaggttgtagcagtggtagaaatgacagaggatgcagaggcactagaagtactgaaagtgcttgaagttgtagaggtcgtgggagcggtagaaatggtagaagtggtagaggttgtagaagttgtagaagttgtaggagcggtagaggttgtagaagttgtaggagtggtagaagttgtaggagtagtcgatgtgcttgaagtagtaggagtagtcgatttggtggaagtttgagaagtggtggaggttgtagaagttgtaggagtggtagaagttgtaggagtggtagaagttgtagaagttgtaggagtggtagaagtagtagaggttgtaggagtagtcgatgtggtagaagttgtaggagtggtagaagtagtagaggttgtaggagtagtcgatgtggtagaagttgtaggagtggtagaagtagtagaggttgtaggagtagtcgatgtggtagaagttgtaggagtggtagaagtagtagaggttgtaggagtagtcgatgtggtagaagtagtagaagtgatagtggtggtaggagtagtcgaagtactagattttgtagtcgttgtagaagtagaggttgggatagccgtgtaaataccatcctttgaaagcgctgaagagatagccggctttaatctggtagagtaccacggaacaccagtgatcattctagttacttcatcacccgaaataccggtcaatcgagtagtgaaatcaccgtagtcaaaaacggctgctgcgatttccgaaggatatgtttcagtcttatggtgattccggaaagagtagtactgaaatatgtgggctctgatgtcagaaacataaacagccaattcaataaggttgactctttcatcgtaaggagataaagtagtggtcgctgtaatagcagccgcactagtagctaaggctacaattcctgctacgatgcttatattaaccattgctttcttcggagtttttcggatatcgcagattcgacaggaactggtacttatttcagtttgagcatactctcaatacagccatttacacaggccatttataggctttcgaaccaaacagctgttgtataaacgaatatattggagcaaaatcactatctttgccaatgcttcttgttttacagttcctgaacgatggagatcttaaacagatctcgtataatttttgacatctttaaaggcacgcgatgtactgtctttttcaccgccaaagaaatgcgcagcatgtaaaaacttctccggagaaaacgcctacggatgggcagatcgatcgaatttccccgtgcctaaattgttctgctcttattatctgtgattaagtgacagaactgcaaaaaaagttaatttgatgtcgtcgatcaatagacattcacataactttactctacgtgctatacgcgctaccaaacagaaagatcactttttcccagtcagtagacactgggtcacttggggtttagcacactcgaaaaggagtaaatatgctgcaaacgagaatgtgcaagcaccattcagaggatcttagctcgtagagagagagaagctgtttgtgctatccaattttgatcctagcgctccgaaaaaggtccgtattaggaaactagatcttgttaattgaaatatctcctcatttttttgcagcccgccactcaatgcgctttgtaacctgtcatagcttgcacagagaagtatcaaagtctacatgtgacacaaagaaaacccaaatacttcttggctatgaatgttatcgtttgatgataacatccattcctccaattggaaaataattactcacgaaggttctatgcatccaaagcggaaccgttgctttcatttaatagaatccacagaacttttagtgtgatttatacgaattccaagggagacctcgacgtgtgacttgaattaagaaaaagccttgccaatcataatagttcatatatgataaacggtcttgattcgggttcttatagcaacagtaacgaaaaatctctaccctcataacttagtattgttgtgttagcggtcatgaaatcttttgtatttcctttaacatatcagttatattttcttcacgctacgtcagccccattattgtgccaacagtttacatcctttgcattcagaggtggttcattagtcgcctacagctgcccgtttggaatgacggcccgtagaggacacgttaatagaagacattccccgcgattcgacgagtacggcgcactctcaatgatttgtaaaggtttcatatcaaactatcaaaatatgcggggctctgcgtaaacagaagcaatcagactacataaggtcctcagtgtaatcttaccgtaggccgatatgtcttccattgtgagaatttctcaacattctgtggttaatcaaccaaatcatgcgatactaatgatcttgacgggcatacataatagaagctaaaaaaaaaaaactagcctgaagcttattctggggcccatatgctcgaaatgccaaattttcaaaaatctagccctacatgcacaacaaatgattgtgcctgcctcctggcaggaaaagggttgatatgaagatgtccggcggcctcttaaacttaagattgaaagacatgctaaccttgttccgttttaaggataaagaggagcctcaataaatgtgtagttatcccttgctaataaaatagtcttattatctcgccactataaaagtcgaagtaaacagacagagacatgttcgatactccacttgcacttcgaaaaagtaattaggaatcctatatatgcgatgctatcgttaatcttttaccttcgtttcccatcttatataaggggatgacgaaaatacctttcggcttacaaatccatctgtaacagctgaaaaaaaaacccagatctgttgatcagttgtaatcgtgtaaacgagtacaaaaggccagagacagcttctactccaagcttaagatacgtatacacaaaagatttttacttgagggagtagagccgaagcgtgtgagtatgacagcgctgcgtaaaacatcagagacgtatgtaatcttcttgtctaatccattattgtcaataactcaagctatatttacatctttagcgaagtcagaaacttattgtcatcctttcaagcctcgccgttgacatccgctgtcagcatcaccctcacctaaagtgttattacacgaagaactgattaaatacgccgagtttgggatgacctgttcttacccgttcattcctttttatggcacactacggttagtatacggcgttggccgtgtgatagggaaaaatagggtaggtaatagagaacaattgatgagttttatgtaattgtattcgcgcaaaaataaaagaatatcaacaaaaaattttgattcgtttacttcataaaaaaaaatcctaaaatttatgaaaatgattaaaaaaagacatccacttccccatagtgctaaattggtatggacgttaaatagcttttatcgtcgttggttttcagacaaatgtgtagcaccctaagtgtgagatatcatatatttcagagaatatagcaccaagtatcgttatgcgttctggtccgtacctgagagctgctcataagaataggcaaaagcaagaaagagtgttctgtcaggaattttcaaactatttacaagctaggaaggctatacgtagtaaataacagccacgattcgacgtggataaacaaacatctacgaaatcccattttggcatgaaaaagtggagcaagaaagacttgaggtatgaaatacttgcaatctttcacatcaacactactttcaagatgttattgcaaacagaaagtgcgattctctttctttcatccgggcgttacagatgaccatatcttcagtgaggataacgaaagataaagagtgctggctcacattaatggaaaaagaaatctacccgctaattgtgatggctcagagtttcttcttatgataaggatgttagtttatatcttgacatgtgtgtttctattgtacaccgtaatagcagattagataaacgagaggtcattcgtaaggatgaaaaaatgaacatctgtttaactttcaagctttctaccatatagccgagatgagcaaatacattaaaacatcaaaaagtggtgcttgaatgcttattttatgacgcaaagcagatgtaatgcatcccgagtaaaacagaatacttaatttgacttcagcaaaataactacccagaatgaacaccgaatttgacattgataacaagacaatctaggaatacttttacatcagcacaatatccatggtggatcccggcggatttttctttcttattgcaccttaatcaggtttacagcctatgactgactctggagtgtcctttcccagtatctgattgtttccgcaacatctatgcatatcagagaagcgttctcatcagtcacttgacaaatgctcgaggagctatcatttgctgataaggtgctacagcgcgctcctgccgcacgctttgttccttttcgataagagtccctcgcgttagtctgagtgaagtgcggaattcagcaaacgaataacaatcgaccttatgatcatgtggattatcggggcaaaagatttggccaagatgtcagagaacgttatcaccaatcactcacacaattaagtggtagtgtaactccgaagatacggctaatacttatcattatctggttttccgaatatacagattggatgaagtaatatatgtatataaatggaccaaggaaacatcaaattaggagatcatgagggaaaggtttaacataacaacattgaagaaaacaacaaaacaaggataatcaaatagtgtaaaaaaaaaaattcaagatgtcagcggatgctagtacaaattcgaatgcttccctagacgaaaaaaatttaaacatcacttcagaagctgaaatcaagaatgaagacgtaaccgcggagccagttctaagcacggtactatcacccaacggtaaaattgtctacatcagtgacaaggttgatgaggccatgaagttggctgaagaagccaaagaaatcgaagtgacaccagaagaagatagaaaacttcgttggaagatcgactattgtatgtttcctttgatgtgtatattgtatgctgttcaatttatggacaagatttccactagttcagcggcggtcatgggattaagaactgacttgaaaatgcatggtgaccagtattcatgggttacttccgccttttatttcggctatctatttatgaacctaggcccggtacagttcattttccaaaggaccagtcacatgtcaaaaatgcttgcggtttttattgtcatatggggaatgttattagctttacatgcagctccaacagttaagtatccttctttcattgttttgagagtacttttaggttgcgcagaaagtgttgtcacaccttgctttaccattatcactgctcaatactggaagacagaggaacaattcacaagagtatcaatttggtttggtatgaacggtcttggctccatcctgatcaacgcaattgcgtacggtgtttacattcaccaggattcttatgctattaaaggctggagaaccttatttgtcattactggtgtgataacaatcttcattggtatcttgatattcctgtggatccctgacgatccatcaaaagcaaggtttttatctaaaagagagaaattaatggttgtccaaagaattaggtctaaccaacaagggttcggtaatcacgagatcaaaaaataccaaattatagaggcgttgaaggatgttaggacgtggttatatttcctctttactgtgagctctaatattcctaatggtggtatttcaagttttatgagtattctattgaatagtgattttggatattcatcaaaggaaaccctattaatgggtttacctacaggtgctgttgaattggtaggttgtccactttttggtattctagcagtttatgcagccaataagaagataccattttggaaatataagttgagttgggctatttttgcagctgtcttagcattgattgctagctgcatgttagggtttgcaacaaactccaaaaaagcaagactggctggtgcttacctgtggtacatctcgcccgtctcatttatttgcgtactttccaatatcagtgcgaattcctcgggatatagtaaaaaatggactgtatcttcaataaacttagtagcatatgctgcagctaacttggcaggaccacaaacctttattgctaagcaggctcctaaatatcatggcgctaaggtcgctatggtcgtatgttatgctgttatgatcgtgcttctatctatactgctcatcgtcaatttaagggaaaacaagagacgtgataagatagctgccgagagagggttccctgaagaaacagagaatttagagttttctgatttgactgattttgaaaatccaaatttcagatacactttatgaaatagtggtgagatacactgacattattgttatcagagaagaatatataaaactaaaatacttaatatcaaaataaggaattttttatcaaagtagaatttctgtaagctacattctcttggtgtagaagatttctcgactgatgtaaaggacaagtcgacttgtcctgcctcatacatacttgacgatgaagagcaagatactgagcacgtgaatcgaggaacaggtaaggatacctcgagaaatgaaaaaaaaaagttgatcagccgtacttgaaaattaaatttggcggtgagaaagacaatatcgtaatgaaaatgattctgacgaccctttgatagtggcaatgatcaaaaagaaaaaaaaaagataagacggtagtgtgaagatgacatatagcgctactctatactcgtccaacttcgaaaataatatgtggtcgttggtacgttcagataagagaatacatctcgcgcgtacgcataattgtggtctaaaaaaccgctgaaattttctcaatactgaatagaatcacgctactacgacaagactcggttactgtgcctaaaataatcctgtgataaacgagttatgttaaacgcagtacaggggttaaagggcattgagtttttgtgagtggaaatgcccccgttatagcttccagtttaattacaaattatcaatttaagcaaatataactggaggattggggaggcgactaaaaatggctaccacgctattagacatacaacattgagtattttatgtaattttgttactgctagcacggccatgcaattggcaactgaaagctatctgacaacttaaatgattcttaaaacaatgacgactataatcttctctaagaagtttcatatccatcttcctcattattcagtttctttttcctcttgaaagtatcgtaaagaacaacgtcttcacattagctattagaagaccattgaactaccggatatgagtaagagtgatcttgccggagagataatagctgcacaaaggccaaggattagattaatgggtgcattgtacgaaaaaaaatagtttacagtcatttattcgcaataaatcaatttttttttcaaaaaatatgtaagtctgataaaaaattcttcactgaagagagatgcttacattctaattcttgaataaaagactctctaacgctgtgaattctctttagctgtaacggaaacagagagttattccgtagtcactgaattttttttttttgacgctattatttaaaacctaggatatccgtcccatacaaaacggccacgagtttcaatcccagaatgtacgagttataattctcctagatgcatgatactcgtgcattcgtttaacaatcataccaatttcccattttcgggatattaaacatgaacatacttttttactgtgagaatgtggtttcacaattattccatacaggtataaaaacgcacagaacttcaaacgggaagactatctacccacattgatggacaaacgcaatgatttctgctaattcattacttatttccactttgtgcgcttttgcgatcgcaacacctttgtcaaaaagagattcctgtaccctaacaggatcttctttgtcttcactctcaaccgtgaaaaaatgtagcagcatcgttattaaagacttaactgtcccagctggacagactttagatttaactgggttaagcagtggtactactgttacgtttgaaggcacaaccacatttcagtacaaggaatggagcggccctttaatttcaatctcagggtctaaaatcagcgttgttggtgcttcgggacataccattgatggtcaaggagcaaaatggtgggatggcttaggtgatagcggtaaagtcaaaccgaagtttgtaaagttggcgttgacgggaacatctaaggtcaccggattgaatattaaaaatgctccacaccaagtcttcagcatcaataaatgttcagatttaaccatcagcgacataacaattgatatcagagacggtgattcggctggtggtcataatacggatgggtttgatgttggtagttctagtaacgtcttaattcaaggatgtactgtttataatcaggatgactgtattgctgtgaattccggttcaactattaaatttatgaacaactactgctacaatggccatggtatttctgtaggttctgttggtggccgttctgataatacagtcaatggtttctgggctgaaaataaccatgttatcaactctgacaacgggttgagaataaaaaccgtagaaggtgcgacaggcacagtcactaatgtcaactttatcagtaataaaattagcggcataaaaagttatggtattgttatcgaaggcgattatttgaatagtaagactactggaactgctacaggtggcgttcccatttcgaatttagtaatgaaggatatcaccgggagcgtgaactccacagcgaagagggttaaaattttggtgaaaaacgctactaactggcaatggtctggggtgtcaattaccggtggttcttcctattctggatgttctggaatcccatctggatctggtgcaagctgttaatcctcttttaaagtactcatatgactatacataccttcttttcttttctttactattcaatacataacagaacaaagatgcaggaaaatattggtatttgttcggcaatttatgctgggtttttttgtaaattcaggtctaattattactgttgatttgtatcaagttggtatcttttttgccatttaataatagagatacgctatgctcatccggatagcaacaatgagagcctaaaagtcctaattgagaagaaaatctctgttcaagactatagtttatgtttcattctggacccttgggatcgtctgaaacaggaaggtcaataattggtaaaaaaaatggtaaatgcgactaagtactacaattgaaacgaatgagcgcacttcatcttcctacaaaacgctgcggctgaaaaagttacataaaaaaccgtcctcaatagcgttaatccagcgtacatgagaaagtaatgacaaagtcttcggtaatatcagtgcatctaccaatatgacacaattgtgaaacttcgctgactcaaataatagccctgtttttttgaccattgttacccatcgagccagtgagaaaaaagccaaaatatctttaaggccttctccattttatgtttatcgatattgtgttgtctgcaatattgaaattttaaaggctatttactttgcctcttgttataaactaagtctgccgaattatgcaatatatagcaaaagctgaaaatagatgtaattacataattcgcagttgtatatgagtatccttaactcgtacattccagttcatctgtgacaaggcactgttttccctaataattattagggaaacgtccttcaaaaatcaaaataattttagagagtctcatcaaccttcgccatagttcgtgatgaaaactttacggtacgtcagactttagatattgatttttttattatttctcccatcgtgagtacaattaccctagttcgaactatatctttcattactggcggaaaaaaaattcaacgaatgttcttggctcaatatagcttagtatttatgtttaaagaatttgtaatatgcgttactagtaattcctttgaatttgtgaatgctttaactgtgagttggcgtacatgcagaaacggccgtttaaaattttaccgattgcagtgacagaaaagctagttgaatatttgtttacataagcgattcagatagacccctaataatatcaagctagatatgcctgttggaaacttctcaaaacctgcgctagacgtcccacgcaatcaacttacagatatgtcagtgctagggaaaagccatagaatgttgaaaaaagcgaaaagggtttactaacttaggcaggttgaaaagcttctcgaaaaataataccttttggtaaaacaacgtaaagaagtactgccataacgtagaattctgcagttatgaacatactacaggcgaaattgctaaaattaatgaggatagtcaaaattgggttatgaatcaaagttttttatagattttcagcaccggtgtggctagtagtcgtccatacatgactcaaagaaaaaaaaaataagtgacataacgcgaagtgaggcattattgggctgctaaagaattttacgttggaaaagaggcaagattgtctcattttccttcaaaatgaaggtactgctgccccggagtaatagtaatttattctcaacagaaatagaatatttaattaatcagagtctaacattaaggtcatgtgttgatagcaggtgacgcgtctgtaaaactaataaagtatataaagcacatccatgagatcttaagacgagagatttcccctactcaaagtacaagcaggacagattcaaaacgcaatccatacgatgaacacagattcacacaaccttagtgagccatacaatataggtggccaaaaatacattaatatgaaaaaaaaggaagatcttggcgtatgccagcctggcttaacgcaaaaggcattcacagtcgaagacaagttcgattacaaagcaattattgaaaaaatggaagtatacggactttgcgtggtcaagaattttatagagacctccagatgtgatgaaatattgaaagaaatcgaaccgcatttttatagatacgaatcatggcaaggctcaccgtttcctaaggaaactactgtggcaacgagatcggttttacactcatctacagtcttaaaggatgtggtatgcgaccgtatgttttgtgatatctcaaaacattttttgaatgaagaaaactactttgcggcgggaaaggtgattaataaatgcactagtgatattcaactgaactccggtatagtctacaaggttggcgctggtgcaagtgaccagggctaccaccgagaagatattgttcatcatacgacccatcaagcatgtgaacgtttccagtatggaaccgaaaccatggtagggttaggtgtagcttttacagatatgaataaagaaaatggctctacgcgaatgatagtcggttcacatttgtggggtccgcacgattcctgtgggaactttgacaagaggatggaatttcacgttaatgttgcaaagggagacgcagttctattcttagggagcctctaccatgcagccagtgcaaatcgtacgtcacaagacagagttgctggatatttttttatgacaaagagctacttgaaaccagaggaaaatcttcacttagggactgatttgcgagtgtttaagggtttaccattggaagccttgcaactgttggggctcggaattagtgagccattttgtggtcacatagattataagagtccaggacatcttatcagttctagtttgtttgaaaatgatatcgaaaaggggtactatggagagacaataagggtgaattatgggtccacgcaataatcattgtaacgggaaaacatatcaccacaagttcgctgtaaatgtgcagactgggtggcatgcttcaaaagcctattctagtacttccctgctgttttcgcacggaaccggtaagaaaacttcgtaccgaaatcgaacaactttcattacttgcacttgtacaaatttaagggagcgggattttaaaacatataaaaggatagtggcacaactaggaataaggtgtattacccaatatgattctcaccttcggttggggactggttaattaattgaatagcttcataacccaccgccccaaaatgtgctcttcgaaatgtctgaggcttttggacctgcacctgaaccacctaccgagttaggacgtcttagggtcctatctaaaacagctggtataagagtttctccactaatcctgggaggtatgtctattggtgacgcctggtctggattcatgggatcaatggacaaagaacaagcttttgagctacttgatgctttttaccaagcaggcggaaatttcattgatactgcaaataattattagtatgagcagtcagagacttggatcggtgaatggatggcatcaagaaaactgcgtgaccagattgtaattgccactaaatttaccacggattataaggggtatgatgtaggcaaggggaagagtgccaatttctgtgggaatcacaagcgcagtttgcatgtaagtgtgagagattcccttcgtaagttgcaaactgattggattgatattctttacgttcactggtgggattatatgagctccattgaggaagttatggatagtttgcacattcttgtgcagcagggcaaagtactctatctaggtgtgtctgatactcctgcctgggttgtttctgcagcaaattactacgccacatctcatggtaaaactccctttagtatctatcaaggtaaatggaatgtattgaacagggactttgaacgtgatatcattccaatggctaggcattttggtatggctcttgctccatgggatgttatgggaggcgggagatttcagagtaaaaaggcagtggaagagcggaagaagaaaggagaaggcttgcgtaccttttttggtacttcggaacagacggatatggaggttaaaatcagcgaagcattgttaaaagttgcggaagaacatggcactgagtctgtcactgctattgccatagcttatgttcggtctaaagcgaaacatgttttcccattagtgggaggaagaaagatcgaacatctcaaacagaacattgaggctttgagcattaaattaacaccagaacaaataaagtacttagaaagtattgttccttttgatgtcggatttcccactaattttattggagatgacccagctgttaccaagaaaccttcatttctcaccgaaatgtctgccaagattagcttcgaagattagtcaaatcaatagttttagtatgttcataatgtgaaaaatgtttatatatacgcttacacacacagtttgatgattcaaatacttagagaaaactttgccgctcatgcatttgcaggcatcttttattgtgttgattttgcgaggaaataaagtgttaagataaagggagttcatttaaagcttgtatacatgctctgatacataaatatgtatgtctatatatcgagtaggaaacaacagctaatgtgaaatcataaacaagtcgtagaggaaggctgggctgaacgagtgacgaagcacgtttaagctggaagagccaatctcttgaaagtaccttcctgtctgcatttttcttgatgaatagccatcaatctttgagcttccaaaggatcagaaacctcttctggttctggccaggacaagtattcattagtgtagttcgagacatagtctggtggcagaatggctaatctcttaccgtaaccggtaaccttcttccagtcacggtgaacattgtacaaagatgaagagaagtaagcgtaacatctttggtattgcttgtatgatagatcgttgttcaattgaggcttgaagtcgatgtattctttccaagccttcacagggtcggctagaacgtagtcggttgccttcttgatggctttcaagaactttctgaccttttcagggtttttcttcaaaaattcatcgttgcagatgtaaagaacggtacagaaacaacagcaacccaagcaagccaacttgtcaattctcaacattttagcatcagaagctggtctgccttgcttggccaagtactcttccaattcgacttgttgcatacattcgataccaataccagcatcaatcttatcttcgatgatgtacttggcgacattcataccacatctgacagcagtgtagtcttctggcttcataccgtagtgcttggtcaattcatcgatttggatcttaccgaattcaccaacgtaaccgatcttcttaccctttagggactggaagtcttcagtgataccactgccctttaagtacaagacaccggtgaatggttcgtccaacaaagaggcaacagaggtcactgggaaaccacgggccttggcagccaaggtgtggatcatggctttcaaacccatgtcgaccttaccagatccaattaactcagtgacatccgaaggattggttggttctaggatggcaatgtctagaccttgctccttgaagtaacctttggtttgagccaagaaaattggaatatggtatggggttggttgccagttcaacaaaaatgtgatcttgtctgtagacatagcttggaagtatgtgtattgttgttgtggtatttttatataattgaaaaggtaaaagaacgaaagaatggacaagaatattgttcatgaagatgataatacgaggtttttatatgttttgtttgctgtcgtcacaagagattgatgttgcttattttgctataacagcaccattttacataacctggataagtaatatttcaagccttctgctagttgaataattcgtatatttcatagttcataagccatccaattcgaattgagctcattgcatcatagccaaaaatcgataaatgcattaacgctgttacctccaggtgattgctgtctttatgcattaacgcgccaatcttattcccttaaaacattacgccggcaaaacgcttaatcgcatatcccagttggcccgaaagagaatgcacatatacaaatatatatgtaaagggaaataccttgtgactacacctatgcctaagtttcagtatctgaactaggataatttcgattataactctaacattttttacgttttctccatatttcgaattgttccttcttcaatcaaaataataaaaaaaaaaaatcacaaaaatgactatagtattttgagcccaacatgactgcgaaattgctattaacaatgattagtcagtagtattgaataacttagaatttaaaactaccttatacaagatgggcatataaaggacatgccaaatggacatattaaatacgctcgatgtaccagaacatccaggaacttaccatagaaaaatatgtaacgacttataaactttaaataaattagagattcaatgaatctctaattttttccgcccgcctattgaacttttactttgtcattaatctattctgaaataggtacagagcgacgccagtgtaaacatatgtgtgatggacatcagcattcaatgtatatcttatcacaccagtttatccaaagatagatgcagttttgaaattggttacttagaatatttctactacatttcgataacaaatataactattttgaatttaaaagttgagtatccaaaaattttagaaatacatacaattacttcccaattacttcccaaatattctcccccctggtttgatatcataaaagcaccttatggcaacaagattcccgggatagtaatgctatttaaatgtatatctatttctcgaatacttgtatctttactccactacccctatgcaagaagatacgcgatagtttttgttccttcctcttcctactctgttaattaactgaaaattatttatattgaaaaggtacttgtagcaaattagacaaggaattctcctggtataaagttagagaaacagaaatatgaaacggccaccccaggtatgaaatattatcttaagaagagccatgaacacacatgaatagattcttgagacatgcttagggtaacaaagactgtaacgccttgttgcaatactgctttattcaaatttttaaattgtacggaattgtggtaaggagaatgtgcaaataacttagcatgaaacggtgctatagttgaatcattgtatgaggtaacatcacttcaacgaaaagaagaataaaattgacctgcacatggagaaagcgtaatatataaaaaatgtttacaattttggcgcactatatgggagaacagctgctggataatattatgcccttacttcatttcaccatatccgtttacagttcaaatctcgccgtcgagccataaattctcaaaattcctttgcaaatattttgcttacctgtaaccggcagcttacattcttccgtcataatttctcagacggatgacataaaccattttttcagaatcctcgataacataatcgatcaaaacagtaataaacattctcttgcacaaaatggactttggcagcaaatcctgaaatattgtggagtattgccagaggtaaaagcaacgttgaacaaattatgacactagacctcttaggcataaagatgacatcatctaggtactcgtaaagatcctaaccacagattccaccttaaaagacgacaatagtaactttgtccttgatctgggttactaaatcagcgatatgatcattaaagtgaatatccccttcttaaaatgtaccaaatatcttatacgtttgcagtttttcttttcctttttctttatttctttggtaaggactaggtaattatttccgtatttggctcctttggcgcttaaaaaatcttgtacgcaaatttccacaagatattgcgtgacaattactattactgaagttgaacttgtttcatgtctccgcctgtgttaactccgttttgcttaactccgtctcgtattacagtaaattcatgatgtgcctatgaatatgcagctagcctgctgcaggcaaaattatttttagctttgtgcgctacagtggtagtaacttaaaacttaaaagctaaaatgcaaaaacagtagagtgcggggtatgcttttcttttgaacgtgcactgcgcagaggcacaatttagcaaagaagtcaggcaaggtagatgatgtaaacaaacgaggacttgtactgcgcatcttgaacctttcaatatcataagtgcaatcagctaaaggtttgattttccgaatgctctgcaaaaaagttaaacatggttatataactcaagtatgataactccagtgttggcctgtaatcaccaactttcaaacgtataaagaaagtaagtaattcattgtttgcttcaggtttagtcttattactatccatagaagtaaaactattgatattattgacagaaaaggaggaaaggaaactaaaggaaaaaaatggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcgacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaacccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattgatcaatatgcgcgcttgataaacatgctaagagataaattcttgaaaaaaaatagggcctactgtaaaacgaagtgacacgtaatttcaaatttaatcaacaaaaaactacgagtttctttgcaaactccctttttcggactactagtactatataaaataacgagttatttagtgaaagaaagcgtttggttaaggcaacattgtacgaagttctgtttctttaaggcaaagcagagtataaaaagtaggatgcttatggagtgaaaacggagtggtgatgaagatggggaagtcaacataggtccacttgagtgcttatggaagatccttaaaaatgcatttccaggaacgtaacactgtaccattcctctaaataaagtgtatacaataatatagaaatatagattcttcccaaatattcagttgttactataaagggaatatttgagctcgttattagcgtggccgcacaaacaaccatcatattagaagagataactttgtttcaactcgggggggcaaactttctcatgcttcgttaacttggcaaatacaacaagcatactttttgcggtgaaaacattttgaggcatgtttccacacaacataatagcgaatggagtaagattttttttgtagtacagtaaaaagacctcatataggtacccgtacaaagtctctgacctctctgggtgacctgggtcattagtagttcaaggagcatctgccactaaaagatttgtgacctaactgtggtagtaaccgttaaagacacggtattgaaacaatgggttcaaaacagtcgagggttttagcatttaagtcggcatatgtccatttctatcctttttccaagtctattgagtttctttatctttttacttatttcctttttgaaaggtcttacgacaaagttcaaagcttgatgaattgtctattactttatttgctaaattgaaactctggatgagtaccaattcttcttttcattttgcgataattgacattatgatttttcaactaattaacatgatattgtacataattttttaatatcaaagcgctacgtccactgaaactatagaaccgttcatctgtcgaatcaacatctctacaattagtacgaaagcttagtttatcaattttttgtgaaaactttgactaatgacgtattattgtggtgtgcattacgaccaaaaggcgggctaacaattccaaggaaaaaagctggtgtaaacctgactgtttgccacggcttttcttactactaaatcggtagcaggcatgaaggaatcgtgaatggtgtgacctgagacaaggagaggcaggcatgaaggcaaacaaattacgggggaaggcacaggagatacccccactaaagattaccccacaatcccttattttctcgagctccctgcaggagagtaagttttaggcacatataggtgcagaaaataaagttttcgcggacagctactgccgagtggcaaaatctatgttgaagttggaaagttacgcctagcttcaggaaccatcgggcttggttggggtgaataatgaaggaacttcgttcagaaaactgttgtctttaccaagcactttaatgctttcttcctcttcaacagttaaggttcatcatattctattatctccggtctcgtatctcctttctccggtcacatgaagcctctgtatcaccttgctaaccgcatttcttccatctaaagtatgttcattgccataagttgcttactctctctttaatatatagaaaaaaattcgacatataaaaggctcaatgtcttaccgttcatctttatgaagagatatagtataagtggaaaaaagaaacatcaaacaatcaacaagaaaaaatactaaaaaaaaaaattgaaaaatatgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggaggtataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatgaaaagtgaatacttttcggcactggttcatgtccatatatatagaccaattcaaaagcagtaatacttgaaaataacaccgaaaaataaaaatttaaatagtagacacgtttaatgacttaaaaactaactttttcatatctaatattgtaaaatgggcggaaaaagcttaagaatatgttattttacaaatcagagcgctgacacatatagagagctatatgatatgagtgagagcaactctcccgtatatgctaagaatattgtcgcttattaggattgaaagataggatcaatgaggaataaatgttacccttttttcttaaaaatgtaagaggaaattatgaaatatactctgatttgtttattattgattaagaacaatataataaccgctctggtagctactgtacatataatttgacggcatatattgctcatatataaaactaccgcattacttccagttgatagatttttaactcagtttcagtactgccagaactgctcattcgagattttttctatttttagaataggtaaaattgcacttaaatgtataagggatgtacgaagtgagtgcccagactgttactatgacaattaaactaatgtcgatgaccatttgtttcgacaactccatcttcattttcttcacgcgccatactcggatgagaaagaatcttttctctaactatacatttccaaacgcaatgatcaagaagaaagctaaatgttactttgagttcaattactgagacatgtcatgggaatatgaggaagaaacaaatctacgtgtattatactccgtaacatgtagagtaaataccatagttacctatttacctgtgtcgataaatgttcattagctcataagtgatgggatacattgctattcctctgcaatggaagcttcgatatctcccttggggtcgttatgagagacgtctttagggggggttttgacaacaaacggatctactttcgtcgatttgaactttcttgcagaaactccaagtttaaataactcatttatttccacgaaagtctttccggcagtttctggtaggtcaaccacagcccagattaaagtacaaaagcataagacaccccagaaaaagcctgacttagcgccccagttccacttcttagagttcagttggtataagatgagaacgctacatatgatactgaccacattataagtgttacgtgctagaatgattgttttcgttcttagtcttgaagatggcatttcagagactaggcaaaaaacgaccggggcaattcctaaattgtaaaaaaatgctacagccattaaaagagaaccacttcccattttggaaccgtgcgtacttgagcaccccaaaccgccaataatgaaaaaaacaatggtttggaaggctagtccaaaagcgtaaaggtcatatctaccaaaatactttgacgcccaccaagatagaaatgtagcacaaataccgagacagtattgaataatactaaaagtgaaggacatttcagtactaacgccagccttttcgtaaaagtaagttgaataacctattagtattgaaccacaagtggcttgaccagcccagcagagacaagtaattctcgttcttcttcgattaatcttgtcttcaaaacaatcactataggagccttctttacttgtgagtctcttttccttatctatagtcacttttattttgtccacctccagagttactagtatttctttttcaggtcccttgccgcttaaagttcttctaagtgatctccttgcctcatcaaaccttccttttttaactagccaccatggagattcaggtgcaaaaaaaattcccagtgctaaaggaactggcaaaatccactgtagggcaaatggtagtttatatcctaattctgaatccgcatattttttttgagaatttttcatgattccagctgcaaaaagttgtccaaataaccagcacaagtttgaataggttgtaaggtaatatctcagagccaatgggcatatttcagaagcgtaagacaccgtcaaacactgaaaacaaccccatggcatcccgcacaatgcttgtcccacagcaatcatgcctaaactattgcaaaagtacagtataaaagtgaaggcagctaaaaaaaacaatgcaataatcaatgtgtaacgatttccaacaagatccacggagggccccgttagctgtagccccacaatttcacctgccatataacataaggtcagcccgatttgccatgacgctgaaatttcccattctccagttttgtcattttgtgagccaaactttctctgaaaaataggcaaggcgtagaaagctccaagaatagctgtgtcgtacccttccatgattaaagttgtagagaccaatagtgaccaagctgctgccttgggatatgtattcaatgctgtcgcaagtggcattcctctttcactttcgtctgcctccttggcatcctcagtagcgtcaaatatctctgttattactttattgctatcgcttggcgctcttgtatccggactgaactcaacatgaacaatatctaagccgtccttcttagtttgatcatccatttctatccagctgggttcatgcgacttagcctttcctgggtatacattcgagtcacttgtattttcctttcttctgtttatgagaaaagataagtttttcatagctaggtaatggctttacaagacctgtatctctatttgtgttagattttgtgatggtaatctttgcataataattccaagaacaggcctctaagaattacaaacaacgattacagatgaccccaccttttttttatattctatagtcaacactatcatgaacttgtggcatactcattgcatatggctgacaggatgtcaaatgctcccttctacgaaagattctgtgcacgtaaaacgcggggtgtggaatgtcgcgatgactctcgagcagagaaaaagacaaacatataacgagctgattcctctccagaagaacaaagccaacattgattcaaactgaggacttaatatgattgactctctggaaactgcaacagtgtgattatagatcagaaattcatgctgtaattttagtatatcgacctgtcgcgatgttgcaagcgtgacagatctatacatatttcgctaaaactgtcggtaaaataccaacacgctgcactgcagaccacagattcgaaccgaagcatattttcagaaatttacgagaggtctttatagtcaccaaaatatccaaattgagtaattagaaagaaaaaaacacacatactgtagtccacaacctgtttacggacaggttctggctgatgggataaccactctacctgactgctctcctacttcatatttacctcccgaacaacgtgaaatctttttgcttggagaaaaacaagtaaaaagtataaatggagatgaaagatccaccaataaattccagcttgatttttcaacatatgatgacaaatgtgagtgctaaatctaagtcgtaagacaaataagaacttttaccataatcagtatcctgggaaaagtggtagaactacagtttatcaagcttacccacaaagcattaaatatgctcccacaataacctctggagtgatataacaggtatgactttcaagttatagtatattaaagatcttggaattgggcggtttaggcttgttcatttcaaagctcgagtaagattttagtatacttttccctatagaaatatttccgacatagattttttaatataagcacttcttccatgacattttgtttcagttatctctctttcgtcgctacttgagaaaactatatggttgtacgaaaaagaaatggccaaaatattctttgggccttattaatctcattactattgtaagagttggcccttaattttatagaaacactgttttaaggccaaaaaaaaaagatgccaaacatagaaaggaaatgtcgctttacttggctaattggctctaaatcacaggtcttaatactcgaaacgccattgatgtactgtgcacaatttccattccgggttaattataaagatatcagcgtttattttcatccatggcaatgaaaattgtaaaataatcatcatcaaaatttgatatggttgcaatagagggaatgatttgatttttatgagacttatacgcatcaccctgtatttttgcaattacggcgatttataaaacttataacggaatttaagagtttcatcctaccaagcgtaatcatagatataaaaattctattgtgcaactcatatttgtcattgaaacagggacttttctccgaagtttaatatctagtatgagctatacaccttaaccactccttacttgtaaaggtacgaaaaagttgtcgttttagcgcgcacttactgatggatgctgaatcagtatagtgtttgactgcggcagtaaactactcacagtagcaggcacgtactatggaagttgtttcgaggcgcatgataggaaaaagggtaccaaaaaggattagaagagaaaattttcataatgggaagtcactgacgagggttggtggttatccgttttaaaaaaatattatgcaatcaagctacaacatcctgtaaattttgtagtagaaaacttctattataacggtttctgaattggcatataaaatagtcaaaaggtgatctttaaatcaacggtaaaaacagtgaagctggtcctgttgtagaatcgccatttcctttgtggtgataggtctttaagtaaagtaatggtgaatttagttaatttgttaaccaacgcgactccagctaactgagcgcatggtctaatacagttccgttagaaacatattttcattttgatgaggtatcagtatttggcgactattatttgaatgcatctgtaatctggatgaatgaaaccttttatgaaaccagaattgtcccagctattatcaatgtccgtgaatggcttgaccatatggaggcaaacgatccttcacctagtgtaactaacccactcgaaacttcaattattatgccttttcaacggtagctcccgctttaatggaggatatgaaagtagcataaatgaattagaaaagtgtattcactgttctggaatatacatggtacgcaagagatataaaaatttataataaacgtacgttatgcccgaagtgtatcccgaactacgggttaaactaaagctttttaattactagtaggttggaggtttaccaatatgcgttcttctttaggccttacattactgaaacaatactggaaaatcactcttatgatgcttttaagttatcacatttaactttatggcatggcctccgtttgagcgcacggaaagattttatagtactttagtatgactattcgttagcattgctttatggtcgtactcggagtaagaatattttgtgagtgagctggtaagatgaggatattgtagaatagcatttttgctcttatgtgtattcctggtatgatatataacatttgtgcagcttcttactgatgaatagcatatttcctgtttaagagaggtagtagtgattaattagtaatattagtattactgcatgataaatcgcttgataaaagtgtccactcgccttttaaagtcactcaatagagtgtagtattcatatctaacagaatgcaaaagtatgaatttttaagtccagaagggcgttctcatttcttcattaaagactcttcattgcgggacaattgcgcttctttaatatatggccatagttccacattcaatggtaaaagccacatagatttctttgcagatagaaggcggtagaagaagtggctaaaaaaccattcacagtcaatcccctcgaagaaaaactcttcattcttccaggcttttttctcaaacaagtacctattcattttccttgcaatttcgtcccatccattcgcaccactttcttgctcatttataatagtcaacaagaattgcatcttgtgttccattttcacgagtaaagcagtcgtcctcatattttggaaaagccacaccatcatgaggaaaaacaatccaggacacaatatacgaaatgcaaggcaaaaatgctgtgacacgcagatacagttcaaaaaagcaagccataatggtagagagtaaatagtgaaaatccgctttaaaaaccaagtaagcttggaccgatgaatatccttgggaagctgaacgtcttccaggccaacagggctccatgatttttcagtattaaacaacttccattgtttttcaacttctctaaaataaactcccaatgcttcttcaatgtaagggacggaatccttaaatgacttaaccttggcagcttcgtcttttttcaaagagaagggttcgagaagggttgttctgaacgcttcttggcagcccatggcattgaagaaaaagtacctagtattccaagccttattttcatataagtacgaatttagatttgctgcaacaacttcccaatcatgaggatcagaacttggtgtgttttcagtaacctctttgcaaaactgaatgagttgtttcgataaggaacgcttacgagaaagtccacaaataacaaggacaaatattggtcccagaaacaggaccagaagtgaaactataagtgggtaaatacaattgttggaaagtttccaccagacgctaagtggtagccataatagcatccagatcggaaacgctaaggacttgtaaatttcataacaaaaccaggtaaagctgcttctgaaaagatcttgaggtagaacaatcttttgggattcgagctgtttgaaggataatacatctacactcttctcatttttaagttcattctctttcattttcggtagtgagatggcagttcgaggggttttttattcgagatagtaacttctgacttttcgcttttatacagcacagcagaaaaaaaaagccgccgaggcgcgcgcgttcatgcaatggctcagtaacctcgtgatagaaaaagggcaacaatattgggctattttaggcaaagaaactcagctattcgaaaagggcatccatttcatttccggttttctatctagccaactcgataatcgtaataacgaatttacaaaactttaatgcgggtacatcacggtgtgccgtaactttggtttacatttaaggtgcgaccagcaatgtcactgctcgtacagcggttaccgcttgaatgaaatacatattttaagcgtagatttcctgtgacaaaactgtgtaaacatctagtagaaaatagacgtagctgtcacaaatatttacacaggaaagagtctgtcctacgtatctgacatgaagattcatagaaccaagttacttcccaatgtggacaacctttcgataccatgtcaatagcttccccttatgttcggtgtcactgtaaaacggatcaaaacaaaacctagaggtacggtggtactcagatcatgcatgacctctgggtaattagcacttctcccgcttgttttgagattctgtatataaatattgcaaacaaaaggatagagcgcggatggcagcccttacagtaaaaattattcgttttaatcatgcgtcagtgtgagattctatgacaatagtatgagaagatggggtgaagtaaaagcgtctgtatgactatagagtacagttatattacaatatatggaatagagcatagtggtatgacgatattaaggaactttaagttaatgataccatgatagtattaagacgcaattaagtgtgtttatgtattatggttgaagaatagaatatttttatgtttaggtgattttagtggtgatttttttgtaatattggcataagtgtatataaattgagtggttagtatacggtgtaaaagtggtataacgtatgtattaagagcagttatacaatatttggggccgccgaatgagatatagatattaaaatgtggataatcgtgggagttatgggtaaatggcacagggtatagaccgctgaggcaagtgccgtgcataatgatgcgagtgcatttggtactgatggtgagagatgggtgatggagtggaatgtgagagtagggtaagtttgagagtggtatatactgtagcatccgtgtgcatatgccatatcagtatacaagtgcaagtgagtatggcatgtggtggtgggattagagtggtagggtaagtatatgtgtattatttacgattatttgttaacgtttcaatatggagggtagaacaacagtacagtgagtaggacatggtggatggtagggtaatagtagggtaatggtagtggagttggatatgggtaattggagggtaacggttatggtggacggtggatggtagtagtaagtagagagatggatggtggttgggagtggtataatgaaatgggacagggtaacgagtggggaggtagggtaatggagggtacgttaagagacaggtttatcagggttggattagaatagggttagggtagtgttagggtagtgttagggtagtgtggtgtggtgtgtgggtgtgggtgtgggtgtgtgtgtgggtgtggtgtgtgggtgtggtgtgtgggtgtggtgtgtgtgtgggtgt
